US011882838B2

(12) United States Patent
Franco

(10) Patent No.: US 11,882,838 B2
(45) Date of Patent: Jan. 30, 2024

(54) BACTERIAL INOCULANTS

(71) Applicant: The Flinders University of South Australia, Bedford Park (AU)

(72) Inventor: Christopher Milton Mathew Franco, Stonyfell (AU)

(73) Assignee: The Flinders University of South Australia, Bedford Park (AU)

( * ) Notice: Subject to any disclaimer, the term of this patent is extended or adjusted under 35 U.S.C. 154(b) by 832 days.

(21) Appl. No.: 16/608,421

(22) PCT Filed: Apr. 27, 2018

(86) PCT No.: PCT/AU2018/050387
§ 371 (c)(1),
(2) Date: Oct. 25, 2019

(87) PCT Pub. No.: WO2018/195603
PCT Pub. Date: Nov. 1, 2018

(65) Prior Publication Data
US 2020/0045979 A1 Feb. 13, 2020

Related U.S. Application Data

(60) Provisional application No. 62/568,763, filed on Oct. 5, 2017.

(30) Foreign Application Priority Data

Apr. 27, 2017 (AU) .................................. 2017901523

(51) Int. Cl.
*A01N 63/10* (2020.01)
*C12N 1/20* (2006.01)
*C12R 1/465* (2006.01)

(52) U.S. Cl.
CPC .............. *A01N 63/10* (2020.01); *C12N 1/20* (2013.01); *C12N 1/205* (2021.05); *C12R 2001/465* (2021.05)

(58) Field of Classification Search
None
See application file for complete search history.

(56) References Cited

U.S. PATENT DOCUMENTS

| | | |
|---|---|---|
| 2,200,532 A | 5/1940 | Bond |
| 4,642,131 A | 2/1987 | Hoitink |
| 4,940,834 A | 7/1990 | Hurley et al. |
| 5,041,290 A | 8/1991 | Gindrat et al. |
| 5,113,619 A | 5/1992 | Leps et al. |
| 5,229,291 A | 7/1993 | Nielsen et al. |
| 5,292,507 A | 3/1994 | Charley |
| 5,300,127 A | 4/1994 | Williams |
| 5,415,672 A | 5/1995 | Fahey et al. |
| 5,730,973 A | 3/1998 | Morales et al. |
| 5,919,447 A | 7/1999 | Marrone et al. |
| 5,989,543 A | 11/1999 | Davide et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,602,500 B1* | 8/2003 | Kharbanda ............ C07K 14/32 424/93.46 |
| 6,681,186 B1 | 1/2004 | Denisov et al. |
| 6,689,880 B2 | 2/2004 | Chen et al. |
| 6,823,623 B2 | 11/2004 | Minato et al. |
| 7,037,879 B2 | 5/2006 | Imada et al. |
| 7,080,034 B1 | 7/2006 | Reams |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,435,411 B2 | 10/2008 | Park et al. |
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,019,694 B2 | 9/2011 | Fell et al. |
| 8,143,045 B2 | 3/2012 | Miasnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,049,814 B2 | 6/2015 | Marx et al. |
| 9,113,636 B2 | 8/2015 | von Maltzahn et al. |
| 9,277,751 B2 | 3/2016 | Sword |

(Continued)

FOREIGN PATENT DOCUMENTS

| | | |
|---|---|---|
| AU | 2015201322 | 4/2015 |
| CA | 1041788 A | 11/1978 |

(Continued)

OTHER PUBLICATIONS

Jin et al. Accession GU328691, deposited Mar. 30, 2011.*
Jin et al Microbiologia (2011)80(1):117-124.*
Janda et al (Journal of Clinical Microbiology (2007) 45(9):2761-2764).*
Petti. Clinical Infectious Diseases (2007)44:1108-114.*
Rasmussen, S., et al., "Grass-endophyte interactions: a note on the role of monosaccharide transport in the Neotyphodium lolii—Lolium perenne symbiosis," New Phytologist, 2012, pp. 7-12, vol. 196.

(Continued)

Primary Examiner — Medina A Ibrahim
(74) Attorney, Agent, or Firm — K&L Gates LLP

(57) ABSTRACT

The present disclosure relates to bacterial inoculants, and methods for their use, to control a fungal root disease in a plant and promote plant growth in water limited conditions. In particular strains of *Paenibacillus* and *Streptomyces* are disclosed.

16 Claims, 3 Drawing Sheets
Specification includes a Sequence Listing.

(56) References Cited

U.S. PATENT DOCUMENTS

| | | |
|---|---|---|
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 | 4/2017 | von Maltzahn et al. |
| 9,652,840 B1 | 5/2017 | Shriver et al. |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 10,104,862 B2 | 10/2018 | Vujanovic et al. |
| 10,136,646 B2 | 11/2018 | Von Maltzahn et al. |
| 10,212,912 B2 | 2/2019 | Vujanovic et al. |
| 10,306,890 B2 | 6/2019 | Mitter et al. |
| 10,362,787 B2 | 7/2019 | Mitter et al. |
| 10,499,652 B2 | 12/2019 | von Maltzahn et al. |
| 10,499,653 B2 | 12/2019 | von Maltzahn et al. |
| 10,499,654 B2 | 12/2019 | von Maltzahn et al. |
| 10,640,783 B2 | 5/2020 | Riley |
| 10,645,938 B2 | 5/2020 | Riley |
| 10,667,523 B2 | 6/2020 | Ambrose et al. |
| 10,750,711 B2 | 8/2020 | Djonovic et al. |
| 10,932,469 B2 | 3/2021 | Mitter et al. |
| 11,119,086 B2 | 9/2021 | Mitter et al. |
| 11,151,379 B2 | 10/2021 | Freitag et al. |
| 2001/0032162 A1 | 10/2001 | Alsberg et al. |
| 2002/0059091 A1 | 5/2002 | Hay et al. |
| 2002/0120555 A1 | 8/2002 | Lerner |
| 2002/0142917 A1 | 10/2002 | Triplett et al. |
| 2002/0147670 A1 | 10/2002 | Lange |
| 2003/0050901 A1 | 3/2003 | Jester et al. |
| 2003/0195822 A1 | 10/2003 | Tatge et al. |
| 2003/0236738 A1 | 12/2003 | Lange et al. |
| 2005/0008619 A1 | 1/2005 | Park et al. |
| 2005/0070435 A1 | 3/2005 | Chopade et al. |
| 2005/0072047 A1 | 4/2005 | Conkling et al. |
| 2006/0046246 A1 | 3/2006 | Zeng et al. |
| 2006/0178269 A1 | 8/2006 | Medina-Vega |
| 2006/0185207 A1 | 8/2006 | Mitcheltree |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2009/0300781 A1 | 12/2009 | Bancroft et al. |
| 2010/0064392 A1 | 3/2010 | Yang et al. |
| 2010/0095396 A1 | 4/2010 | Voeste et al. |
| 2010/0114753 A1 | 5/2010 | Osmanski et al. |
| 2010/0130365 A1 | 5/2010 | Notten et al. |
| 2010/0205690 A1 | 8/2010 | Blasing et al. |
| 2010/0227357 A1 | 9/2010 | Redman et al. |
| 2011/0033436 A1 | 2/2011 | Chen et al. |
| 2011/0182862 A1 | 7/2011 | Green et al. |
| 2011/0195406 A1 | 8/2011 | Sorenson et al. |
| 2012/0108431 A1 | 5/2012 | Williams et al. |
| 2012/0116943 A1 | 5/2012 | Abramson |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0134629 A1 | 5/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0218568 A1 | 8/2015 | Jones et al. |
| 2015/0230478 A1 | 8/2015 | Vujanovic et al. |
| 2015/0242970 A1 | 8/2015 | Avey et al. |
| 2015/0282490 A1 | 10/2015 | Wachendorff-Neumann et al. |
| 2015/0289518 A1 | 10/2015 | Andersch et al. |
| 2015/0296802 A1 | 10/2015 | Wachendorff-Neumann et al. |
| 2015/0296803 A1 | 10/2015 | Andersch et al. |
| 2015/0296804 A1 | 10/2015 | Andersch et al. |
| 2015/0305348 A1 | 10/2015 | Andersch et al. |
| 2015/0320050 A1 | 11/2015 | von Maltzahn et al. |
| 2015/0320051 A1 | 11/2015 | Wachendorff-Neumann et al. |
| 2015/0335029 A1 | 11/2015 | Mitter et al. |
| 2015/0342199 A1 | 12/2015 | Carrion Villanovo et al. |
| 2015/0366217 A1 | 12/2015 | Vujanovic et al. |
| 2015/0368607 A1 | 12/2015 | Arnold et al. |
| 2015/0370935 A1 | 12/2015 | Starr |
| 2015/0373993 A1 | 12/2015 | von Maltzahn et al. |
| 2016/0000091 A1 | 1/2016 | Andersch et al. |
| 2016/0021891 A1 | 1/2016 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0260021 A1 | 9/2016 | Marek |
| 2016/0286821 A1 | 10/2016 | Sword |
| 2016/0290918 A1 | 10/2016 | Xu et al. |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0350855 A1 | 12/2016 | Lerner |
| 2016/0366892 A1 | 12/2016 | Ambrose et al. |
| 2017/0020138 A1 | 1/2017 | Von Maltzahn et al. |
| 2017/0064361 A1 | 3/2017 | Pinca, IV et al. |
| 2017/0161560 A1 | 6/2017 | Itzhaky et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0060771 A1 | 3/2018 | Mangin |
| 2018/0092365 A1 | 4/2018 | Sword |
| 2018/0153174 A1 | 6/2018 | Riley et al. |
| 2018/0177196 A1 | 6/2018 | Sword |
| 2018/0189564 A1 | 7/2018 | Freitag et al. |
| 2018/0213800 A1 | 8/2018 | Djonovic et al. |
| 2018/0249716 A1 | 9/2018 | Riley |
| 2018/0251776 A1 | 9/2018 | Riley |
| 2018/0322426 A1 | 11/2018 | Schmaltz et al. |
| 2019/0130999 A1 | 5/2019 | Oppenheim et al. |
| 2021/0372997 A1 | 12/2021 | Von Maltzahn et al. |

FOREIGN PATENT DOCUMENTS

| | | |
|---|---|---|
| CA | 1229497 A | 11/1987 |
| CA | 2562175 A1 | 4/2008 |
| CA | 2916678 A1 | 12/2014 |
| CA | 2960032 A1 | 3/2015 |
| CA | 2935218 A1 | 7/2015 |
| CA | 2953466 A1 | 12/2015 |
| CA | 2953697 A1 | 12/2015 |
| CN | 1604732 A | 4/2005 |
| CN | 1948459 A | 4/2007 |
| CN | 101311262 A | 11/2008 |
| CN | 101423810 A | 5/2009 |
| CN | 101570738 A | 11/2009 |
| CN | 101693881 A | 4/2010 |
| CN | 102010835 A | 4/2011 |
| CN | 102123596 A | 7/2011 |
| CN | 102168022 A | 8/2011 |
| CN | 102352327 A | 2/2012 |
| CN | 102533601 A | 7/2012 |

(56) References Cited

FOREIGN PATENT DOCUMENTS

| | | |
|---|---|---|
| CN | 103642725 A | 3/2014 |
| CN | 103865837 | 6/2014 |
| CN | 104250616 A | 12/2014 |
| CN | 104388356 A | 3/2015 |
| CN | 104560742 A | 4/2015 |
| CN | 105886428 | 8/2016 |
| CN | 106434493 | 2/2017 |
| EP | 0192342 A2 | 8/1986 |
| EP | 0223662 A1 | 5/1987 |
| EP | 0378000 A2 | 7/1990 |
| EP | 0494802 A1 | 7/1992 |
| EP | 0818135 A1 | 1/1998 |
| EP | 1389767 | 2/2004 |
| EP | 1621632 A1 | 2/2006 |
| EP | 1935245 A1 | 6/2008 |
| EP | 1967057 | 9/2008 |
| EP | 2114118 | 9/2012 |
| EP | 2676536 A1 | 12/2013 |
| EP | 2959779 | 12/2015 |
| EP | 3041338 | 7/2016 |
| EP | 3659414 | 6/2020 |
| JP | 2003300804 A | 10/2003 |
| JP | 2009/072168 A | 4/2009 |
| KR | 20050039979 | 5/2005 |
| KR | 20100114806 A | 10/2010 |
| KR | 101066283 | 9/2011 |
| KR | 101091151 B1 | 12/2011 |
| KR | 20120004958 | 1/2012 |
| KR | 20130023491 A | 3/2013 |
| RU | 2043028 C1 | 9/1995 |
| WO | 1988/009114 | 1/1988 |
| WO | 1994/016076 | 7/1994 |
| WO | 98/35017 | 8/1998 |
| WO | 99/59412 | 11/1999 |
| WO | 2000/029607 A1 | 5/2000 |
| WO | 2001/046774 | 12/2000 |
| WO | 2001/083697 A2 | 11/2001 |
| WO | 2001/083818 A2 | 11/2001 |
| WO | 2002/065836 A2 | 8/2002 |
| WO | 2003/038066 | 5/2003 |
| WO | 2004/046357 A1 | 6/2004 |
| WO | 2005/003328 A1 | 1/2005 |
| WO | 2007/021200 A1 | 2/2007 |
| WO | 2007/107000 A1 | 9/2007 |
| WO | 2008/103422 A2 | 8/2008 |
| WO | 2008/107097 | 9/2008 |
| WO | 2009/012480 A2 | 1/2009 |
| WO | 2009/078710 A1 | 6/2009 |
| WO | 2009/126473 A1 | 10/2009 |
| WO | 2010/109436 A1 | 9/2010 |
| WO | 2010/115156 A2 | 10/2010 |
| WO | 2011/001127 A1 | 1/2011 |
| WO | 2011/011627 A1 | 1/2011 |
| WO | 2011/082455 A1 | 7/2011 |
| WO | 2011/112781 A2 | 9/2011 |
| WO | 2011/117351 A1 | 9/2011 |
| WO | 2012/016140 | 2/2012 |
| WO | 2012/034996 A1 | 3/2012 |
| WO | 2013/016361 A1 | 1/2013 |
| WO | 2013/029112 A1 | 3/2013 |
| WO | 2013/054272 | 4/2013 |
| WO | 2013/090628 A1 | 6/2013 |
| WO | 2013/122473 A1 | 8/2013 |
| WO | 2013/148290 | 10/2013 |
| WO | 2013/177615 A1 | 12/2013 |
| WO | 2013/190082 A1 | 12/2013 |
| WO | 2014/046553 A1 | 3/2014 |
| WO | 2014/079728 | 5/2014 |
| WO | 2014/082950 A1 | 6/2014 |
| WO | 2014/086747 | 6/2014 |
| WO | 2014/086749 | 6/2014 |
| WO | 2014/086750 | 6/2014 |
| WO | 2014/086752 | 6/2014 |
| WO | 2014/086753 | 6/2014 |
| WO | 2014/086756 | 6/2014 |
| WO | 2014/086758 | 6/2014 |
| WO | 2014/086759 | 6/2014 |
| WO | 2014/086764 | 6/2014 |
| WO | 2014/086776 | 6/2014 |
| WO | 2014/121366 A1 | 8/2014 |
| WO | 2014/206953 A1 | 12/2014 |
| WO | 2014/210372 A1 | 12/2014 |
| WO | 2015/035099 A2 | 3/2015 |
| WO | 2015/069938 A1 | 5/2015 |
| WO | 2015/100431 A2 | 7/2015 |
| WO | 2015/100432 A2 | 7/2015 |
| WO | 2015/114552 | 8/2015 |
| WO | 2015/116838 | 8/2015 |
| WO | 2015/192172 A1 | 12/2015 |
| WO | 2015/200852 A2 | 12/2015 |
| WO | 2015/200902 A2 | 12/2015 |
| WO | 2016020371 | 2/2016 |
| WO | WO 2016020371 * | 2/2016 |
| WO | 2016/050726 | 4/2016 |
| WO | 2016/057991 A1 | 4/2016 |
| WO | 2016/090212 A1 | 6/2016 |
| WO | 2016/109758 A2 | 7/2016 |
| WO | 2016/179046 A1 | 11/2016 |
| WO | 2016/179047 A1 | 11/2016 |
| WO | 2016/200987 A1 | 12/2016 |
| WO | 2018094027 | 5/2018 |
| WO | 2018/119419 | 6/2018 |
| WO | 2018102733 A1 | 6/2018 |
| WO | 2018160244 A1 | 9/2018 |
| WO | 2018160245 A1 | 9/2018 |
| WO | 2019/046909 | 3/2019 |
| WO | 2019084380 | 5/2019 |
| WO | 2019113468 | 6/2019 |

OTHER PUBLICATIONS

Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.

Redman, R. S., et al., "Thermotolerance Generated by Plant/Fungal Symbiosis," Science, Nov. 2002, vol. 298, 1 Page (with 4 pages of supplemental material).

Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.

Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.

Result 11 from a search in the GenEmbl database, GenEmbl Record No. EU 977189, Smith et al., "Bioactive endophytes warrant intensified exploration and conservation," PLoS ONE 3(8):E3052, 2008.

Result 3 from a search in the GenEmbl database, GenEmbl Record No. KF011597, Paenibacillus strain No. HA13, Park et al., "Isolation and characterization of humic substances-degrading bacteria from the subarctic Alaska grasslands," J Basic Microbiol, 2013.

Riess, K., et al., "High genetic diversity at the regional scale and possible speciation in Sebacina epigaea and S. incrustans," BMC Evolutionary Biology, 2013, vol. 13, No. 102, 17 Pages.

Riken, GI No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.

Rodriguez, H., et al., "Expression of a Mineral Phosphate Solubilizing Gene From Erwinia herbicola in Two Rhizobacterial Strains," J Biotechnol., 2001, pp. 155-161, vol. 84.

Rodriguez, R.J., et al., "Stress Tolerance in Plants via Habitat-Adapted Symbiosis," ISME J., 2008, pp. 404-416, vol. 2.

Rodriguez-Navarro, D., et al., "Soybean Interactions with Soil Microbes, Agronomical and Molecular Aspects," Agronomy for Sustainable Development, 2011, pp. 173-190, vol. 31, No. 1.

Roessner, U., et al., "Metabolic Profiling Allows Comprehensive Phenotyping of Genetically or Environmentally Modified Plant Systems," Plant Cell, 2001, pp. 11-29, vol. 13.

(56) References Cited

OTHER PUBLICATIONS

Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.

Rosenblueth, A., et al., "Seed Bacterial Endophytes: Common Genera, Seed-to-Seed Variability and Their Possible Role in Plants," Acta Hort., 2012, pp. 39-48, vol. 938.

Rosenblueth, M., et al., "Bacterial Endophytes and Their Interactions With Host," Molecular Plant-Microbe Interactions, 2006, pp. 827-837, vol. 19, No. 8.

Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.

Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Samways, M.J., et al., "Assessment of the Fungus Cladosporium Oxyspoum (Berk. and Curt.) As a Potential BioControl Agent Against Certain Homoptera," Elsevier Science Publishers B.V., Jan. 1, 1986, pp. 231-239.

Sardi, P, et al., "Isolation of Endophytic Streptomyces Strains from Surface Sterilized Roots," Applied and Environmental Microbiology, 1992, pp. 2691-2693, vol. 58, No. 8.

Sarkar, S., et al., "New report of additional enterobacterial species causing wilt in West Bengal, India," Canadian Journal of Microbiology, 2015, vol. 61, No. 7, pp. 477-486.

Sarwar, M., et al., "Tryptophan Dependent Biosynthesis of Auxins in Soil," Plant Soil, 1992, pp. 207-215, vol. 147.

Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.

Schmieder, R., et al., "Quality Control and Preprocessing of Metagenomic Datasets," Bioinformatics, 2011, pp. 863-864, vol. 27, No. 6.

Schneider, C., et al., "Endophytes for plant protection: the state of the art Proceedings," DPG Spectrum Phytomedizin, Proceedings of the 5th International Symposium on Plant Protection and Plant Health in Europe, May 26-29, 2013, 347 Pages.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

Senthilkumar, M., et al., "Biocontrol Potential of Soybean Bacterial Endophytes Against Charcoal Rot Fungus, Rhizoctonia batatiola," Current Microbiology, 2009, vol. 58, pp. 288-293.

Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.

Sha, T. et al., "Genetic diversity of the endemic gourmet mushroom Thelephora ganbajun from southwestern China", Microbiology (2008), 154, 3460-3468.

Shankar, M., et al., "Root colonization of a rice growth promoting strain of Enterobacter cloacae," Journal of Basic Microbiology, 2011, pp. 523-530, vol. 51.

Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.

Sharma et al., "Detection and identification of bacteria intimately associated with fungi of the order Sebacinales", Cellular Microbiology, Aug. 5, 2008, pp. 2235-2246, vol. 10, No. 11.

Shiraishi, A., et al., "Nodulation in black locust by the ammaproteobacteria *Pseudomonas* sp. and the Betaproteobacteria *Burkholderia* sp", Systematic and Applied Microbiology, vol. 33, No. 5, Aug. 2010, pp. 269-274.

Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, vol. 46, pp. 381-387.

Singh, A K., et al., "Uncultured *Actinomyces* sp. Clone Emlact 80 IV (New) 16S Ribosomal RNA Gene, Partial Sequence," NCBI GenBank Accession No. JQ285908. Submitted Dec. 13, 2011, 1 page.

Soares, M. M. C. N., et al., "Screening of Bacterial Strains for Pectinolytic Activity: Characterization of the Polygalacturonase Produced by Bacillus SP," Revista de Microbiolgia, 1999, pp. 299-303, vol. 30.

Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.

Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.

Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.

Song, M., et al., "Effects of Neotyphodium Endophyte on Genmination of Hordeum brevisubulatum under Temperature and Water Stress Conditions," Acta Agrestia Sinica, 2010, pp. 834-837, vol. 18, No. 6. (English Abstract).

Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.

Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.

Staudt, A. K., et al., "Variations in Exopolysaccharide Production by Rhizobium tropici," Arch Microbiol., 2012, pp. 197-206, vol. 194.

Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.

Strobel, G. A., "Endophytes as Sources of Bioactive Products," Microbes and Infection, 2003, pp. 535-544, vol. 5.

Sturz, A. V., et al., "Weeds as a Source of Plant Growth Promoting Rhizobacteria in Agricultural Soils," Can J Microbiol., 2001, pp. 1013-1024, vol. 47, No. 11.

Sugita, T. et al., "Intraspecies Diversity of Cryptococcus laurentii as Revealed by Sequences of Internal Transcribed Spacer Regions and 28S rRNA Gene and Taxonomic Position of C. laurentii Clinical Isolates", Journal of Clinical Microbiology, Apr. 2000, p. 1468-1471.

Surette, M.A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.

Suto, M., et al., "Endophytes as Producers of Xylanase," J Biosci Bioeng., 2002, pp. 88-90, vol. 93, No. 1.

Sword, G., "Fungal Endophytes to Protect Cotton from Insects and Nematodes," Power Point Presentation dated Dec. 7, 2012, 20 Pages.

Sword, G., "Manipulating Fungal Endophytes to Protect Plants from Insects and Nematodes," Power Point Presentation dated Aug. 7, 2013, 48 Pages.

Sword, G., "Natural Enemies—The Forgotten Basis of IPM?," Power Point Presentation dated Sep. 6, 2013, 33 Pages.

(56) References Cited

OTHER PUBLICATIONS

Sword, G., et al., "Field Trials of Potentially Beneficial Fungal Endophytes in Cotton," Power Point Presentation dated Jan. 7, 2013, 17 Pages.
Sword, G., et al., "Manipulating Fungal Endophytes for the Protection of Cotton in the Field," Power Point Presentation dated Jan. 7, 2013.
Taghavi, S., et al., "Genome Sequence of the Plant Growth promoting Endophytic Bacterium *Enterobacter* sp. 638", PLoS Genet., May 2010, vol. 6, Issue 5, e1000943, pp. 1-15.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Taylor, A.G., et al., "Concepts and Technologies of Selected Seed Treatments," Annu. Rev. Phytopathol., 1990, pp. 321-339, vol. 28.
Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in *Spodoptera litura* (Lepidoptera: Noctuidae) Larvae by Endophytic Fungi Nigrospora oryzae and Cladosporium uredinicola,", Annals of the Entomological Society of America, May 1, 2014, pp. 674-679, vol. 107, No. 3.
Theis, K. R., et al., "Uncultured Bacterium Clone GM2GI8201A64RC 16S Ribosomal RNA Gene, Partial Sequence," NCBI GenBank Accession No. JX051943, Submitted May 14, 2012, 1 Page.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (*Pisum sativum* )," Applied and Environmental Microbiology, May 2002, pp. 2161-2171, vol. 68, No. 5.
Trichoderma definition, 2016, 6 Pages, [online] [Retrieved on Sep. 16, 2016,] Retrieved from the Internet <URL: https://en.wikipedia.org/wiki/Trichoderma>.
Trotel-Aziz, P., et al., "Characterization of New Bacterial Biocontrol Agents *Acinetobacter, Bacillus, Pantoea and Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
U'Ren, J.M., et al., "Host and geographic structure of endophytic and endolichenic fungi at the continental scale," American Journal of Botany, May 1, 2012, pp. 898-914, vol. 99, No. 5.
United States Patent Office, Final Office Action, U.S. Appl. No. 14/614,193, dated Dec. 22, 2016, 13 Pages.
United States Patent Office, Final Office Action, U.S. Appl. No. 14/410,537, dated May 5, 2017, 9 Pages.
United States Patent Office, Final Office Action, U.S. Appl. No. 14/614,193, dated Jul. 18, 2017, 14 Pages.
United States Patent Office, Final Office Action, U.S. Appl. No. 14/614,193, dated May 3, 2018, 10 Pages.
United States Patent Office, Final Office Action, U.S. Appl. No. 14/964,429, dated May 31, 2017, 9 Pages.
United States Patent Office, Final Office Action, U.S. Appl. No. 15/107,973, dated Jan. 26, 2018, 20 Pages.
United States Patent Office, Final Office Action, U.S. Appl. No. 15/034,862, dated Jan. 12, 2018, 14 Pages.
United States Patent Office, Non-Final Office Action, U.S. Appl. No. 14/766,065, dated Oct. 27, 2017, 11 Pages.
United States Patent Office, Non-Final Office Action, U.S. Appl. No. 14/964,429, dated Aug. 9, 2016, 6 Pages.
United States Patent Office, Non-Final Office Action, U.S. Appl. No. 15/034,862, dated May 19, 2017, 8 Pages.
United States Patent Office, Non-Final Office Action, U.S. Appl. No. 15/063,350, dated Nov. 10, 2016, 18 Pages.
United States Patent Office, Non-Final Office Action, U.S. Appl. No. 15/107,973, dated Apr. 10, 2017, 39 Pages.
United States Patent Office, Non-Final Office Action, U.S. Appl. No. 15/212,038, dated Sep. 21, 2016, 10 Pages.
United States Patent Office, Non-Final Office Action, U.S. Appl. No. 15/436,592, dated Aug. 30, 2017, 17 Pages.
United States Patent Office, Non-Final Office Action, U.S. Appl. No. 15/436,609, dated Aug. 30, 2017, 21 Pages.
United States Patent Office, Non-Final Office Action, U.S. Appl. No. 15/143,398, dated Sep. 22, 2017, 16 Pages.
United States Patent Office, Non-Final Office Action, U.S. Appl. No. 14/916,514, dated Sep. 20, 2017, 31 Pages.
United States Patent Office, Non-Final Office Action, U.S. Appl. No. 15/107,965, dated Jun. 21, 2018, 27 Pages.
United States Patent Office, Non-Final Office Action, U.S. Appl. No. 15/143,394, dated Sep. 25, 2017, 15 Pages.
United States Patent Office, Non-Final Office Action, U.S. Appl. No. 15/143,398, dated Sep. 22, 2017, 17 Pages.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013, 10 Pages.
Valencia, E., et al., "Mini-review: Brazilian fungi diversity for biomass degradation," Fungal Genetics and Biology, 2013, pp. 9-18, vol. 60.
Van Der Lelie, D., et al., "Poplar and its Bacterial Endophytes: Coexistence and Harmony," Critical Rev Plant Sci., 2009, pp. 346-358, vol. 28.
Verkley, G., et al., "*Paraconiothyrium*, a new genus to accommodate the mycoparasite Coniothyrium minitans, anamorphs of Paraphaeosphaeria, and four new species," Studies in Mycology, 2004,; pp. 323-335, vol. 50.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Gene, Partial Sequence," NCBI GenBankAccession No. GQ169380.1, Submitted May 15, 2009, 1 Page.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report and Written Opinion for PCT/US2017/064292, dated May 11, 2018, 20 Pages.
PCT International Search Report and Written Opinion for PCT/US2017/064361, dated May 11, 2018, 22 Pages.
PCT International Search Report and Written Opinion for PCT/US2018/051467, dated Feb. 4, 2019, 22 pages.
PCT International Search Report and Written Opinion PCT/AU2018/050387, dated Jul. 12, 2018 (Filing date is Apr. 27, 2018).
PCT International Search Report and Written Opinion, Application No. PCT/AU2015/000360, dated Aug. 5, 2015, 12 Pages.
PCT International Search Report and Written Opinion, Application No. PCT/US2014/054160, dated Dec. 9, 2014, 21 Pages.
PCT International Search Report and Written Opinion, Application No. PCT/US2014/072400, dated Jul. 8, 2015, 38 Pages.

(56) References Cited

OTHER PUBLICATIONS

PCT International Search Report and Written Opinion, International Application No. PCT/US2014/064411, dated Mar. 27, 2015, 15 Pages.
PCT International Search Report and Written Opinion, International Application No. PCT/US2014/072399, dated Jun. 26, 2015, 22 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
PCT International Search Report and Written Opinion, PCT Application No. PCT/US2017/064292, dated May 11, 2018, 20 Pages.
PCT International Search Report and Written Opinion, PCT Application No. PCT/US2017/064351, dated Apr. 9, 2018, 25 Pages.
PCT International Search Report and Written Opinion, PCT Application No. PCT/US2017/068255, dated Mar. 19, 2018, 14 Pages.
PCT International Search Report and Written Opinionfor PCT/US2018/051467, dated Mar. 25, 2019 26 pages.
PCT International Search Report, Application No. PCT/US2014/044427, dated Dec. 3, 2014, 9 Pages.
PCT Invitation to Pay Additional Fees, PCT Application No. PCT/US2017/064292, dated Mar. 5, 2018, 15 Pages.
PCT Invitation to Pay Additional Fees, PCT Application No. PCT/US2017/064292, dated Mar. 5, 2018, 15 Pages. (Attached document is dated Mar. 6, 2018 and is 16 pages).
PCT Invitation to Pay Additional Fees, PCT Application No. PCT/CA2013/000091, dated Mar. 27, 2013, 2 Pages.
PCT Invitation to Pay Additional Fees, PCT Application No. PCT/US2014/064411, dated Feb. 5, 2015, 2 Pages.
PCT Invitation to Pay Additional Fees, PCT Application No. PCT/US2014/072399, dated Apr. 14, 2015, 2 Pages.
PCT Invitation to Pay Additional Fees, PCT Application No. PCT/US2014/072400, dated Apr. 16, 2015, 6 Pages.
PCT Invitation to Pay Additional Fees, PCT Application No. PCT/US2015/038110, dated Sep. 22, 2015, 8 Pages.
PCT Invitation to Pay Additional Fees, PCT Application No. PCT/US2015/038187, dated Oct. 14, 2015, 5 Pages.
PCT Invitation to Pay Additional Fees, PCT Application No. PCT/US2015/068206, dated Apr. 12, 2016, 5 Pages.
PCT Invitation to Pay Additional Fees, PCT Application No. PCT/US2017/064351, dated Feb. 9, 2018, 18 Pages.
PCT Invitation to Pay Additional Fees, PCT Application No. PCT/US2017/064361, dated Mar. 7, 2018, 18 Pages.
Pearson, W.R., et al., "Rapid and Sensitive Sequence Comparison With FASTP and FASTA," Methods Enzymol., 2011, pp. 63-98, vol. 183.
Pedraza, R.O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M.A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol., 1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, [online][Retrieved Aug. 11, 2016] Retrieved from the Internet URL:http://www.philrice.gov.ph/2012-rd-highlights/, 52 Pages.
Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol., 1997, pp. 354-361, vol. 43.
Powell, W. A., et al., "Evidence of Endophytic Beauveria Bassiana in Seed-Treated Tomato Plants Acting as a Systemic Entomopathogen to Larval *Helicoverpa zea* (Lepidoptera: Noctuidae)," J. Entomol. Sci., 2009, pp. 391-396, vol. 44, No. 4.
Quadt-Hallmann, A, et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R-25project.org/, 3604 Pages.
Rae, R., et al., "A subset of naturally isolated Bacillus strains show extreme virulence to the free-living nematodes Caenorhabditis elegans and Pristionchus pacificus", Environmental Microbiology, vol. 12, No. 11, 2010, pp. 3007-3021.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Hain, T., et al., "Chitinolytic transgenes from Streptomyces albidoflavus as phytochemicals defences against; herbivorous insects, use in transgenic plants and effect in plant development", International Journal of Systematic Bacteriology, Jan. 1997, vol. 47, No. 1, pp. 202-206.
Hallman, J., et al., "Bacterial Endophytes in Agricultural Crops," Canadian J Microbiol., 1997, pp. 895-914, vol. 43.
Hamayun, M., et al., "Cladosporium sphaerospermum as a new plant growth-promoting endophyte from the roots of *Glycine max*(L.) Merr," World Journal of Microbiology and Biotechnology, Kluwer Academic Publishers, DO, vol. 25, No. 4, Feb. 15, 2009 (Feb. 15, 2009), pp. 627-632.
Hanshew, A., et al., "Characterization of Actinobacteria Associated with Three Ant-Plant Mutualisms", Microbiol Ecology, August, 6, 2014, vol. 69, No. 1, pp. 192-203.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hanson, LE., "Reduction of Verticillium Wilt Symptoms in Cotton Following Seed Treatment with Trichoderma virens," Proceedings Beltwide Cotton Conferences, 2000, vol. 1. (Abstract), 1 Page.
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P.R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).

(56) References Cited

OTHER PUBLICATIONS

Hepler, P. K., et al., "Polarized Cell Growth in Higher Plants," Annu Rev Cell Dev Biol., 2001, pp. 159-187, vol. 17.
Hiatt, E.E., et al., "Tall Fescue Endophyte Detection: Commerical Immunoblot Test Kit Compared with Microscopic Analysis," Crop Science, 1999, pp. 796-799, vol. 39.
Hibbett, D.S., et al., "A Higher-Level Phylogenetic Classification of the Fungi," Mycol Res., 2007, pp. 509-547, vol. 111.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hill, N. S., et al., "Endophyte Survival during Seed Storage: Endophyte-Host Interactions and Heritability," Crop Sci., 2009, pp. 1425-1430, vol. 49.
Hinton, D. M., et al., "Enterobacter cloacae is an endophytic symbiont of corn," Mycopathologia, 1995, pp. 117-125, vol. 129.
Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., "Fungal Endophytes that Confer Heat and Drought Tolerance to Wheat," Doctoral dissertation, University of Saskatchewan, 2012.
Hubbard, M., et al., "Fungal Endophytes Improve Wheat Seed Germination Under Heat and Drought Stress," Botany, 2012, pp. 137-149, vol. 90.
Hubbard, M., et al., 2011. "Agricultural Potential of Fungal Endophytes of Grasses, Cereals and Wheat," In: Wheat: Genetics, Crops and Food Production. Nova Science Publishers Hauppauge, pp. 333-345.
Humann, J., et al., "Complete genome of the onion pathogen Enterobacter cloacae EcWSU1 ," Standard in Genomic Sciences, Dec. 31, 2011, vol. 5, No. 3, pp. 279-286.
Hung, P.Q., et al., "Isolation and Characterization of Endophytic Bacteria in Soybean (*Glycine* sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, H., et al., "Complete genome sequence and comparative analysis of the industrial microorganism Streptomyces avermitilis," Nat Biotechnol. May 2003;21 (5) :526-31. Epub Apr. 14, 2003. (Year: 2003).
Ikeda, S., et al., "The Genotype of The Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Impullitti, A.E., et al., "Fungal endophyte diversity in soybean", Journal of Applied Microbiolog, vol. 114, No. 5, May 1, 2013, pp. 1500-1506.
International Search Report and Written Opinion for PCT/EP2013/062976, dated Dec. 22, 2014, 9 Pages.
International Search Report and Written Opinion, Application No. PCT/US2014/054160, dated Dec. 9, 2014, 21 Pages.
International Search Report and Written Opinion, Application No. PCT/US2014/072400, dated Jul. 8, 2015, 38 Pages.
International Search Report and Written Opinion, International Application No. PCT/US2014/064411, dated Mar. 27, 2015, 15 Pages.
International Search Report and Written Opinion, International Application No. PCT/US2014/072399, dated Jun. 26, 2015, 22 Pages.
Invitation to Pay Additional Fees, PCT Application No. PCT/CA2013/000091, dated Mar. 27, 2013, 2 Pages.
Invitation to Pay Additional Fees, PCT Application No. PCT/US2014/064411, dated Feb. 5, 2015, 2 Pages.
Invitation to Pay Additional Fees, PCT Application No. PCT/US2014/072400, dated Apr. 16, 2015, 6 Pages.
Invitation to Pay Additional Fees, PCT Application No. PCT/US2015/038110, dated Sep. 22, 2015, 8 Pages.
Invitation to Pay Additional Fees, PCT Application No. PCT/US2015/038187, dated Oct. 14, 2015, 5 Pages.
Iverson, C., et al, "The taxonomy of Enterobacter sakazakii: proposal of a new genus *Cronobacter* gen. nov. and descriptions of *Cronobacter sakazakii* comb. nov. *Cronobacter sakazakii* subsp. *sakazakii*, comb. nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.
Jalgaonwala, R., et al., "A Review on Microbiol Endophytes from Plants: A Treasure Search for Biologically Active Metabolites," Global Journal of Research on Medicinal Plants & Indigenous Medicine, 2014, pp. 263-277, vol. 3, No. 6.
Janda, J.M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Joe, M.M. et al., "Development of alginate-based aggregate inoculants of *Methylobacterium* sp. and Azospirillum brasilense tested under in vitro conditions to promote plant growth," Journal of Applied Microbiology 2013, 116 (2):408-423, XP055225426, Nov. 22, 2013.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Johnston-Monje, D., et al., "Conservation and Diversity of Seed Associated Endophytes in *Zea* Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013, 17 Pages.
Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Khan, A.L., et al., "Salinity Stress Resistance Offered by Endophytic Fungal Interaction Between Penicillium minioluteum LHL09 and *Glycine max*. L," J. Microbiol. Biotechnol., 2011, pp. 893-902, vol. 21, No. 9.
Kim, M., et al., "Towards a taxonomic coherence between average nucleotide identity and 16S rRNA gene sequence similarity for

(56) References Cited

OTHER PUBLICATIONS species demarcation of prokaryotes", Int J Systematic Evolutionary Microbiol., 2014, vol. 64, pp. 346-351.

Klaubauf, S., et al., "Molecular diversity of fungal communities in agricultural soils from Lower Austria," Fungal Diversity, Aug. 13, 2010, pp. 65-75, vol. 44, No. 1.

Knapp, D., et al., "Inter- and intraspecific functional diversity of fungal root endophytes of semiarid sandy grasslands," Acta Microbiologica et Immunologica Hungarica, Nov. 2017, vol. 64, Issue Supplement 1, pp. 1-101.

Kruger, M., et al., "DNA-Based Species Level Detection of Glomeromycota: One PCR Primer Set for All Arbuscular Mycorrhizal Fungi," New Phytol., 2009, pp. 212-223, vol. 183.

Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.

Kuklinsky-Sobral, J., et al., "Isolation and characterization of soybean-associated bacteria and their potential for plant growth promotion," Environmental Microbiology, 2004, pp. 1244-1251, vol. 6, No. 12.

Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.

Kumar, S., et al., "MEGA7: Molecular Evolutionary Genetics Analysis version 7.0 for bigger datasets," Molecular Biology and Evolution, Mar. 22, 2016, vol. 33, pp. 1870-1874.

Kusari, S., et al. "Chemical ecology of endophytic fungi: origins of secondary metabolites," Cell Press, Chem & Biol, vol. 19, pp. 792-798, 2012.

Labeda, D.P., et al., "Phylogenetic study of the species within the family Streptomycetaceae," Antonie van Leeuwenhoek, 2012, vol. 101, pp. 73-104, Springer.

Langille, M.G.I. et al., "Predictive functional profiling of microbial communities using 16S rRNA marker; gene sequences," Nature Biotechnology, 2013, vol. 31, No. 9, pp. 814-821.

Lanver, D., et al., "Sho1 and Msb2-Related Proteins Regulate Appressorium Development in the Smut Fungus Ustilago aydis," Plant Cell, 2010, pp. 2085-2101, vol. 22.

Laus, M. C., et al., "Role of Cellulose Fibrils and Exopolysaccharides of Rhizobium leguminosarum in Attachment to and Infection of Vicia sativa Root Hairs," Mol Plant Microbe Internet., 2005, pp. 533-538, vol. 16, No. 6.

Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.

Le, X.H., et al., "Isolation and characterisation of endophytic actinobacteria and their effect on the early growth and hodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.

Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62. (Year: 2005).

Lehman, S.G., "Treat Cotton Seed," Research and Farming III, Progr. Rept., 1945, 3, 5, 16 Pages.

Lehman, S.G., "Treat Cotton Seed," Review of Applied Mycology, 1945, 24, 369, 16 Pages.

Leonard, C. A., et al., "Random Mutagenesis of the Aspergillus oryzae Genome Results in Fungal Antibacterial Activity," Int J Microbiol., 2013, vol. 2013, Article ID 901697, 6 Pages.

Li, H. M., et al., "Expression of a Novel Chitinase by the Fungal Endophyte in Poa ampla," Mycologia, 2004, pp. 626-536, vol. 96, No. 3.

Li, H., et al., "Endophytes and their role in phytoremediation," Fungal Diversity, 2012, pp. 11-18, vol. 54.

Li, M., et al., "ATP Modulates the Growth of Specific Microbial Strains", Current Microbiology, May 30, 2010, vol. 62, No. 1, pp. 84-89.

Li, Q., "Agrobacterium tumefaciens Strain TA-AT-10 16S Ribosomal RNA Gene, Partial Sequence: GenBank: KF673157.1," Submitted Dec. 16, 2013.

Lind, A., et al., "Drivers of genetic diversity in secondary metabolic gene clusters within a fungal species", PLOS Biology, Nov. 17, 2017, 26 pages.

Liu, D., et al., "Osmotin Overexpression in Potato Delays Development of Disease Symptoms," Proc Natl Acad Sci USA, 1994, pp. 1888-1892, vol. 91.

Liu, M., et al., "A Novel Screening Method for Isolating Exopolysaccharide-Deficient Mutants," Appl Environ Microbiol., 1998, pp. 4600-4602, vol. 64, No. 11.

Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.

Liu, Y., et al., "Phylogenetic relationships among ascomycetes: evidence from an RNA polymerase II subunit," Mol. Biol. Evol. 1999. Vol. 16, No. 12, pp. 1799-1808.

Liu, Y., et al., "Study on Diversity of Endophytic Bacterial Communities in Seeds of Hybrid Maize and their Parental Lines," Arch Microbiol., 2012, pp. 1001-1012, vol. 194.

Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.

Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.

Lorck, H., "Production of Hydrocyanic Acid by Bacteria," Physiol Plant, 1948, pp. 142-146, vol. 1.

Lugtenberg, B., et al., "Plant-Growth-Promoting Rhizobacteria," Ann. Rev. Microbiol., 2009, pp. 541-556, vol. 63.

Lundberg, D.S., et al., "Defining the Core *Arabidopsis thaliana*Root Microbiome," Nature, 2012, pp. 86-90, vol. 188, No. 7409.

Lundberg, D.S., et al., "Practical Innovations for High-Throughput Amplicon Sequencing," Nat Methods, 2013, pp. 999-1002, vol. 10, No. 10.

Ma, Y., et al., "Plant Growth Promoting Rhizobacteria and Endophytes Accelerate Phytoremediation of Metalliferous Soils," Biotechnology Advances, 2011, pp. 248-258, vol. 29.

Madi, L. et al., "Aggregation in Azospirillum brasilense Cd: Conditions and Factors Involved in Cell-to-Cell Adhesion," Plant Soil, 1989, pp. 89-98, vol. 115.

Mandyam, K., et al., "Mutualism-parasitism paradigm synthesized from results of root-endophyte models", Frontiers in Microbiology, vol. 5, Jan. 12, 2015, pp. 1-14.

Mannisto, M.K., et al., "Characterization of Psychrotolerant Heterotrophic Bacteria From Finnish Lapland," Syst Appl Microbiol., 2006, pp. 229-243, vol. 29.

Mano, H., et al., "Culturable Surface and Endophytic Bacterial Flora of the Maturing Seeds of Rice Plants (*Oryza saliva*) Cultivated in a Paddy Field," Microbes Environ., 2006, vol. 21, No. 2.

Manoharan, M. J. et al., "Survival of flocculated cells in alginate and its inoculatin effect on growth and yield of maize under water deficit conditions," Ep J of Soil Biology, Gauthier-Villars, Montrouge, FR, vol. 50, Mar. 7, 2012, pp. 198-206, XP028421147.

Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.

Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.

Marasco, R., et al., "A Drought Resistance-Promoting Microbiome is Selected by Root System Under Desert Farming," PLoS ONE, 2012, vol. 7, No. 10, 14 Pages.

(56) References Cited

OTHER PUBLICATIONS

Sato, I., et al., "Suppressive Potential of Paenibacillus Strains Isolated from the Tomato Phyllosphere against Fusarium Crown and Root Rot of Tomato", Microbes Environ, vol. 29, No. 2, 168-177, 2014.

Soe, K.M, et al., "Evaluation of effective Myanmar Bradyrhizobium strains isolated from Myanmar soybean and effects of coinoculation with Streptomyces griseoglavus P4 for nitrogen fixation", Soil science and plant nutrition 59.3 (2013): 361-370 (Year: 2013).

Ngom, A et al., "A novel symbiotic nitrogen-fixing member of the Ochrobactrum clade isolated from root nodues of Acacia mangium". J. Gen. Appl. Microbiol. (2004) 50: 17-27.

Trujillo, M.E et al., "Nodulation of Lupinus albus by strins of *Ochrobactrum lupini* sp. nov." Appl. Environ Microbiol Mar. 2005; 71(3): 1318-1327.

Bal, H.B et al., "Isolation of ACC deaminase producting PGPR from rice rhizosphere and evaluating their plant growth promoting activity under salt stress". Plant Soil (2013) 366: 93-105 doi: 10/1007/s11104-012-1402-5.

Chakraborty et al., "Evaluation of Ochrobactrum anthropi TRS-2 and its talcbased formulation for enhancement of growth of tea plants and management of brown root rot disease." Journal of Applied Microbiology, 2009, 107(2):625-634 DOI:10.1111/j.1365-2672.2009.04242.x <https://doi.org/10.1111/j.1365-2672.2009.04242.x.

Sulistiyani, et al., "Population and Diversity of Endophytic Bacteria Associated with Medicinal Plan Curumma zedoaria ", Microbiology Indonesia 8.2 (2014):4.

Bevivino, A., et al., "Characerization of free-living maize rhizosphere populatin of Burkholderia cepacia: effect of seed treatment on disease suppresssion and growth promotion of maize", FEMS Microbiology Ecology 27 (1998) 225-237.

Ciccillo, F., et al., Effects of two different application methods of Burkholderia ambifaria MCI 7 on plant growth and rhizospheric bacterial diversity.

Estrada, P., et al., "A N2-fixing endophytic *Burkholderia* sp. associated with maize plants culitvated in Mexico", Canadian Journal of Microbiology (2002), vol. 48(4), pp. 528-536.

Sharma, V.K., et al., "Enhancement of verticillium wilt resistance in tomato transplants by in vitro co-culture of seedlings with a plant growth promoting rhizobacterium (*Pseudomonas* sp. strain PsJN)", Canadian Journal of Microbiology (1998), vol. 44(6), pp. 285-294.

Grady, E., et al., "Current knowledge and perspectives of Paenibacillus: a review" Microb Cell Fact (2016) 15:203.

Li, J., et al., "Antitumour and antimicrobial activities of endophytic stretomycetes from pharmaceutical plants in rainforest", Lett Appl Microbiol. Dec. 2008; 47(6): 574-80. (Year: 2008).

Hamayun, M., et al., "Gibberellin production and plant growth promotion from pure cultures of *Cladosporium* sp. MH-6 isolated from cucumber (*Cucumis sativus* L.)", Mycologia, 102 (5), 2010, pp. 989-995.

Shupeng, T., et al. "Advances in Study of Interactions between Mycorrhizal Fungi and Bacteria", Journal of Qingdao Agricultural University (Natural Science Edition), vol. 30, Issue 4, pp. 240-246, Dec. 31, 2013.

Kim, S., et al., "Physiological and proteomic analyses of Korean F1 maize (*Zea mays* L.) hybrids under water-deficit stress during flowering", Appl. Biol. Chem. (2019) 62:32.

Halligan, B., et al., "Cloning of the murine cDNA encoding VDJP, a protein homologous to the large subunit of replication factor C and bacterial DNA ligases", Gene (1995) 217-222.

Arend, J., et al., "Hydroquinone: O-glucosytransferase from cultivated Rauvolfia cells: enrichment and partial amino acid sequences", Phytochemistry (2000) 53:187-193.

Enchev, R., et al., "Protein neddylation: beyond cullin-RING ligases", (Nature Reviews: Molecular Cell Biology (2015) 16:30-44.

Bais, H., et al., "The Role of Root Exudates in Rhizosphere Interactions with Plants and Other Organisms", Annual Review. Plant Biol. (2006) 57:233-266.

Goepfert, S., et al., "Molecular Identification and Characterization of the *Arabidopsis* D3,5, D2,4-Dienoyl-Coenzyme A Isomerase, a Peroxisomal Enzyme Participating in the b-Oxidation Cycle of Unsaturated Fatty Acids1", Plant Physiology (2005) 138:1947-1956.

Thomas, P., et al: "Endophytic Bacteria Associated with Growing Shoot Tips of Banana (*Musa* sp.) cv. Grand Naine and the Affinity of Endophytes to the Host", Microbial Ecology, Springer-Verlag, NE, vol. 58, No. 4, Jul. 25, 2009 (Jul. 25, 2009), pp. 952-964, XP019757395, ISSN: 1432-184X, DOI: 10.1007 /S00248-009-9559-Z.

Database Geneseq [Online] Sep. 30, 2010 (Sep. 30, 2010), "Cellulomonas fermentans 16s rRNA gene SEQ ID:39.", retrieved from EBI accession No. GSN:AWL84299 Database accession No. AWL84299; & JP 2009 072168 A (Univ of Occupational & Environ) Apr. 9, 2009 (Apr. 9, 2009).

European Patent Office, Partial European Search Report, European Patent Application No. 20171870.7, dated Nov. 20. 2020, 18 Pages.

European Patent Office, European Search Report, European Patent Application No. 20171870.7, dated Mar. 1, 2021, 15 Pages.

GenBank Accession NR_041978, dated Aug. 8, 2011. (Year: 2011).

GenBank Accession AF394537, dated Jul. 2, 2002. (Year: 2002).

Andreolli, M., et al., "Endophytic Burkholderia fungorum DBT1 can improve phytoremediation efficiency of polycyclic aromatic hyrocarbons", Chemosphere, Pergamon Press, Oxford, GB, vol. 92, No. 6, May 21, 2013, pp. 688-694.

Extended European Search Report for EP 20202875.9, dated Apr. 19, 2021, 16 pages.

Douglas, G., et al., "PICRUSt2 for prediction of metagenome functions", Nature Biotechnology, vol. 38, No. 6, Jun. 1, 2020, pp. 685-688.

Kemp, N., et al., "Sarocladium zeae is a systemic endophyte of wheat and an effective biocontrol agent against Fusarium head blight", Biological Control, vol. 149, Publication No. 104329, 10 pages (2020).

Wicklow, D., et al., "A protective endophyte of maize: Acremonium zeae antibiotics inhibitory to Aspergillus flavus and Fasarium verticillioides", Mycol. Res. 109 (5):610-618 (May 2005).

Pan, J., et al., "Effects of host plant environment and Ustilago maydis infection on the fungal endophyte community of maize (*Zea mays*)", New Phytologist, vol. 178, pp. 147-156 (2008).

Wicklow, D., et al., "Occurrence of pyrrocidine and dihydroresorcylide production among Acremonium zeae populations from maize grown in different regions", Canadian Journal of Plant Pathology, vol. 30, pp. 425-433 (2008).

European Patent Office, Partial European Search Report, European Patent Application No. 18791606.9, dated Jul. 26, 2021, 16 Pages.

Abaid-Ullah, M., et al., "Plant Growth Promoting Rhizobacteria: An Alternate Way to Improve Yield and Quality of Wheat (*Triticum aestivum*)", International Journal of Agriculture and Biology, vol. 17, No. 1, Jan. 1, 2015, pp. 51-60.

Colla, G., et al., "Coating seeds with endophytic fungi enhances growth, nutrient uptake, yield and grain quality of winter wheat", International Journal of Plant Production, vol. 9, No. 2, Apr. 1, 2015, pp. 171-190.

Larran, S., et al., "Endophytes from wheat as biocontrol agents against tan spot disease", Biological Control, vol. 92, Sep. 11, 2015, pp. 17-23.

European Patent Office, Search Report, European Patent Application No. 17825317.5, dated Oct. 12, 2021, 9 Pages.

Yuan, J., et al., "Roots from distinct plant developmental stages are capable of rapidly selecting their own microbiome without the influence of environmental and soil edaphic factors", Soil Biology and Biochemistry 89 (2015): 206-209.

Frichot, E., et al., "Testing for Associations between loci and environmental gradients using latent factor mixed models", Mol. Biol. Evol. 30:7 1687-1699 (Year: 2013).

Bicego, M., et al., "Investigating Topic Models' Capabilities in Expression Microarray Data Classification", IEEE/transactions on computational biology and bioinformatics, 9:8 1831-1836 (Year: 2012).

(56) References Cited

OTHER PUBLICATIONS

Gerber, G., et al., "Inferring Dynamic Signatures of Microbes in Complex Host Ecosystems", PLOS Computational Biology 8:8 e1002624, 14 pages (Year: 2012).
Holmes, I., et al., "Dirichlet Multinomial Mixtures: Generative Models for Microbial Metagenomics", PLoSONE 7:2, e30126, 15 pages (Year: 2012).
Kim, Y., et al., "Deciphering the human microbiome using next-generation sequencing data and bioinformatics approaches", Methods 79-80, p. 52-59 (Year: 2015).
Anesi, A., et al., "Towards a scientific interpretation of the terrior concept: platicisity of the grape berry metabolome", BMP plant biology 15:191, 17 pages (Year: 2015).
Hill, S.T., The pursuit of hoppiness: propelling hop into the genomic era. Thesis, Oregon State University, 80 pages (Year: 2016).
Li, M., et al., "Persistent homology and the branching topologies of plants", American Journal of Botany, 104:3, 349-353 (Year: 2017).
Schuerger, A., "Microbial Ecology of a Crewed Rover Traverse in the Arctic: Low Microbial Dispersal and Implications for Planetary Protection on Human Mars Missions", Astrobiology, vol. 15, No. 6, 2015, pp. 478-491.
Timmusk, S., "Paenibacillus polymyxa antagonizes oomycete plant pathogens Phytophthora palmivora and Pythium aphanidermatum", Journal of Applied Microbiology, GB, vol. 105, No. 5, Jan. 5, 2009, pp. 1473-1481.
Fatima, Z., "Antifungal activity of plant growth-promoting rhizobacteria isolates against Rhizoctonia solani in wheat", African Journal of Biotechnology, vol. 8(2), pp. 219-225, Jan. 19, 2009, pp. 219-225.
GenBank Accession No. AY148074 published Nov. 30, 2002.
GenBank Accession No. FM998026 published Feb. 10, 2011.
GenBank Accession No. KJ494315 published May 3, 2014.
International Search Report and Written Opinion for PCT/US2022/026051, dated Oct. 28, 2022, 38 pages.
Langner Dos Santos Miriam et al: "Benefits Associated with the Interaction of Endophytic Bacteria and Plants", Brazilian Archives of Biology and Technology, vol. 61, No. 0, Jan. 1, 2018 (Jan. 1, 2018), pp. 18160431-2018.
Database GenBank [Online] NIH; Jan. 29, 2016 (Jan. 29, 2016), Wu JR: "Chitinophaga pinensis strain CSB3-50 16S ribosomal RNA gene", XP055948434, accession No. KU305719 Database accession No. KU305719.1 abstract.
Database Genbank [Online] NIH; Mar. 10, 2017 (Mar. 10, 2017), Shaffer JP et al: "Uncultured bacterium clone EHB-PS0362 16S ribosomal RNA gene", XP055948435, accession No. KU978322 Database accession No. KU978322.1 abstract.
Database GenBank [Online] NIH; Jan. 15, 2019 (Jan. 15, 2019), Hu C. J. et al: "*Chitinophaga* sp. strain N15203 16S ribosomal RNA gene", XP055948438, accession No. MK389338 Database accession No. MK389338.1 abstract.
Database Genbank [Online] NIH; Nov. 26, 2014 (Nov. 26, 2014), Han J. H. et al: "*Chitinophaga* sp. NR 1-07 16S ribosomal RNA gene", XP055948440, accession No. KM253104 Database accession No. KM253104.1 abstract.
Database Genbank [Online] NIH; Sep. 2, 2017 (Sep. 2, 2017), Jiayu T. J.: "*Chitinophaga* sp. strain PRd7 16S ribosomal RNA gene", XP055948441, accession No. KY203972 Database accession No. KY203972.1 abstract.
Database Genbank [Online] NIH; Oct. 1, 2010 (Oct. 1, 2010), Aslam Z. et al: "*Chitinophaga* sp. Z2-YC6856 16S ribosomal RNA gene", XP055948442, accession No. GQ369124 Database accession No. GQ369124.1 abstract.
Database Genbank [Online] NIH; Jun. 10, 2014 (Jun. 10, 2014), Zhang B. G.: "Chitinophaga oryziterrae strain ZBGKL4 16S ribosomal RNA gene", XP055948443, accession No. KJ734873 Database accession No. KJ734873.1 abstract.
Chung, E., et al: *Chitinophaga oryziterrae* sp. nov., isolated from the rhizosphere soil of rice (*Oryza sativa* L.) II, International Journal of Systematic and Evolutionary Microbiology, vol. 62, No. Pt_12, Dec. 1, 2012 (Dec. 1, 2012), pp. 3030-3035.

Proença Diogo Neves et al: "*Chitinophaga costaii* sp. nov., an endophyte of Pinus pinaster, and emended description of Chitinophaga niabensis", International Journal of Systematic and Evolutionary Microbiology, vol. 64, No. Pt_4, Apr. 1, 2014 (Apr. 1, 2014), pp. 1237-1243.
Elad, Y., et al: "Control of Rhizoctonia solani in cotton by seed-coating with *Trichoderma* spp. spores", Plant and Soil, vol. 66, No. 2, Jun. 1, 1982 (Jun. 1, 1982), pp. 279-281.
Harman, G.E., et al: "Trichoderma hamatum effects on seed and seedling disease induced in radish and pea by *Pythium* spp. or Rhizoctonia solani", Phytopathology, Dec. 1, 1980 (Dec. 1, 1980), pp. 1167-1172.
Harman, G.E., et al: "Factors affecting Trichoderma hamatum applied to seeds as a biocontrol agent", Phytopathology, Jun. 1, 1981 (Jun. 1, 1981), pp. 569-572.
Giczey, G., et al: "Homologous transformation of Trichoderma hamatum with an endochitinase encoding gene, resulting in increased levels of chitinase activity", FEMS Microbiology Letters, Jan. 1, 1998 (Jan. 1, 1998), pp. 247-252.
Freitas, R., et al: "Cloning and characterization of a protein elicitor Sml gene from Trichoderma harzianum", Biotechnology Letters, vol. 36, No. 4, Dec. 10, 2013 (Dec. 10, 2013), pp. 783-788.
Database Genbank [Online] NIH; Jan. 1, 2008 (Jan. 1, 2008), Hanada RE et al: "Trichoderma hamatum strain Dis 65G 18S ribosomal RNA gene, partial sequence; internal transcribed spacer 1", XP055973221, Database accession No. EU264000 abstract.
Database Genbank [Online] NIH; Sep. 6, 2013 (Sep. 6, 2013), Samuels G J et al: "Trichoderma hamatum strain Dis 240j actin (act) gene, partial eds", XP055973271, Database accession No. EU856256 abstract.
Database Genbank [Online] NIH; May 23, 2005 (May 23, 2005), Steyaert J M et al: "Trichoderma hamatum alkaline proteinase (prbl) gene, complete eds", XP055973243, Database accession No. AY258899 abstract.
Database Genbank [Online] NIH; Apr. 11, 2019 (Apr. 11, 2019), Chaverri P et al: "Trichoderma hamatum strain GJS 04-207 calmodulin (CAL) gene, partial eds", XP055973272, Database accession No. FJ442285 abstract.
Aerts A et al: "NCBI Reference Sequence: XP_024757499.1: glycoside hydrolase family 18 protein [Trichoderma asperellum CBS 433.97]", Apr. 26, 2018 (Apr. 26, 2018), pp. 1-2, XP055973177,.
Database Genbank [Online] NIH; Jul. 25, 2016 (Jul. 25, 2016), Steyaert J M et al: "Trichoderma hamatum endochitinase (chit42) gene, partial eds", XP055973252, Database accession No. AY258898 abstract.
Database Genbank [Online] NIH; Sep. 25, 1998 (Sep. 25, 1998), Giczey G et al: "endochitinase [*Trichoderma hamatum*]", XP055973364, Database accession No. AAC60385 abstract.
Database Genbank [Online] NIH; Sep. 25, 1998 (Sep. 25, 1998), Giczey G et al: "Trichoderma hamatum endochitinase gene, complete eds", XP055973251, Database accession No. U88560 abstract.
Liu, H.J., et al., "Bacillus subtilis strain A2-9 16S ribosomal RNA gene, partial sequence", Accession No. JF496331, deposited Aug. 2011.
Li, C., et al., "Bacillus subtilis strain B2-1 16S ribosomal RNA gene, partial sequence", Accession No. JN256114, deposited Sep. 2011.
Jiang, L., "Bacillus subtilis strain jllsy 16S ribosomal RNA gene, partial sequence", Accession No. FJ793201, deposited Apr. 2009.
Choi, N.S., et al., "Bacillus licheniformis strain DJ-2 16S ribosomal RNA gene, partial sequence", Accession No. FJ435676, deposited Jan. 2009.
Peng, S., et al., "Bacillus subtilis strain CCM9 16S ribosomal RNA gene, partial sequence", Accession No. HQ536000, deposited Dec. 2010.
Jee, H., et al., "Bacillus subtilis strain R2-1 16S ribosomal RNA gene, partial sequence", Accession No. EU852929, deposited Jul. 2009.
Zhao, Y., et al., "Bacillus amyloliquefaciens strain BGP14 16S ribosomal RNA gene, partial sequence", Accession No. JQ734536, deposited May 2012.

(56) References Cited

OTHER PUBLICATIONS

Allard, G. et al., "Spingo: a rapid species-classifier for microbial amplicon sequences," BMC Bioinformatics, 2015, vol. 16, No. 324, 8 pages.

Anders, S. et al., "Differential expression analysis for sequence count data," Genome Biology, 2010, vol. 11, No. 11, pp. R106.

Ansari, M.A.; Brownbridge, M.; Shah, F.A.; Butt, T.M. Efficacy of entomopathogenic fungi against soil-dwelling life stages of western flower thrips, Frankliniella occidentalis, in plant-growing media. Entomol. Exp. Appl. 2008, 127, 80-87.

Asaff, A.; Cerda-Garcia-Rojas, C.; De la Torre, M. Isolation of dipicolinic acid as an insecticidal toxin from Paecilomyces fumosoroseus. Appl. Microbiol. Biotechnol. 2005, 68, 542-547.

BB-CBI, "*Beauveria bassiana* (white muscardine fungus)," Invasive Species Compendium, 2021, pp. 1-68.

Beris, E.I.; Papachristos, D.P.; Fytrou, A.; Antonatos, S.A.; Kontodimas, D.C. Pathogenicity of three entomopathogenic fungi on pupae and adults of the Mediterranean fruit fly, *Ceratitis capitata* (Diptera: Tephritidae). J. Pest Sci. 2013, 86, 275-284.

Chen, F. et al., "Assessing Performance of Orthology Detection Strategies Applied to Eukaryotic Genomes," PLoS ONE, Apr. 2007, No. 4, pp. e383.

Cole, J.R. et al., "Ribosomal Database Project: data and tools for high throughput rRNA analysis," Nucleic Acids Research, 2014, vol. 42, pp. D633-D642.

Deshpande, V. et al., "Fungal identification using a Bayesian classifier and the Warcup training set of internal transcribed spacer sequences," Mycologia, 2016, vol. 108, No. 1, pp. 1-5.

Djian, C. et al., Acetic acid: A selective nematicidal metabolite from culture filtrates of *Paecilomyces lilacinus* (Thom) Samson and Trichoderma longibrachiatum Rifai. Nematologica 1991, 37, 101-112.

Doster, M.A. et al., "Biocontrol of Aflatoxins in Figs," Proceedings of the Third International Symposium on Fig, 798, 2008, pp. 223-226.

Eberhardt, C. et al., "Proteomic Analysis of Kveim Reagent Identifies Targets of Cellular Immunity in Sarcoidosis," PLOS One, Jan. 23, 2017, vol. 12, No. 1, pp. 1-16.

Edgar, R.C., "UNOISE2: Improved Error-Correction for Illumina 16S and ITS Amplicon Sequncing," BioRxiv, 2016, No. 081257, 21 pages.

Ehteshamul-Haque, S. et al., "Biological control of root rot diseases of okra, sunflower, soybean and mungbean," Pakistan Journal of Botany, vol. 22, No. 2, Jun. 1990, pp. 121-124.

Enright, A.J. et al., "An efficient algorithm for large-scale detection of protein families," Nucleic Acids Research, 2002, vol. 30, No. 7, pp. 1575-1584.

Enright, A.J. et al., "Protein families and Tribes in genome sequence space," Nucleic Acids Research, 2003, vol. 31, No. 15, pp. 4632-4638.

Combined printouts of term definitions from world wide web, performed by mkz Oct. 19, 2022 (Year. 2022).

Sarangi, S., et al., "Agricultural Activity Recognition with Smart-shirt and Crop Protocol", IEEE global humanitarian technology conference, p. 298-305 (Year: 2015).

Peiffer, J., et al., "The Genetic Architecture of Maize Height", Genetics, vol. 196, p. 1337-1356 (Year: 2015).

Kazemian, M., et al., "Improved accuracy of supervised CRM discovery with interpolated Markov models and cross-specieis comparison", Nucleic Acids Research, 2011, vol. 39, No. 22, 9463-9472.

Yeh, J.H., "Protein Remote Homology Detection Based on Latent Topic Vector Model", International conference on Networking and information technology, p. 456-460, (Year: 2010).

Heydari, A., "A Review on Biological Control of Fungal Plant Pathogens Using Microbial Antagonists", Journal of Biological Sciences, vol. 10 (4) 273-290 (Year: 2010).

Sessitsch, A., et al., "Functional Characteristics of an Endophyte Community Colonizing Rice Roots as Revealed by Metagenomic Analysis", MPMP vol. 25, No. 1, 2012, pp. 28-36.

Muhammad, N., et al., "Endophytes in biotechnology and agriculture", E-Cost FA1103 Working Group Meeting in Trento/S. Michele, Italy Nov. 2012. (poster).

Hurek, T., et al., "*Azoarcus* sp. strain BH72 as a model for nitrogen-fixing grass endophytes", Journal of Biotechnology 106 (2003) 169-178.

Engelhard, M., et al., "Preferential occurrence of diazotrophic endophytes, *Azoarcus* spp., in wild rice species and and races of *Oryza sativa* in comparison with moder races", Environmental Microbiology (2000) 2(2), 131-141.

Sessitsch, A., et al., "Endophytic bacterial communities of field-grown potato plants and their plant-growth-promoting and antagonistic abilities", Can. J. Microbiol. 50: 239-249 (2004).

Sessitsch, A., et al., "Cultivation-independent population analysis of bacterial endophytes in three potato varieties based on eubacterial and Actinomycetes-specific PCR of 16S rRNA genes", FEMS Microbiology Ecology 39 (2002) 23-32.

Minamisawa K., et al., "Anaerobic Nitrogen-Fixing Consortia Consisting of Clostridia Isolated from Gramineous Plants", Applied and Environmental Microbiology, May 2004, p. 3096-3102, vol. 70, No. 5.

Seghers, D., et al., "Impact of Agricultural Practices on the *Zea mays* L. Endophytic Community", Applied and Environmental Microbiology, Mar. 2004, p. 1475-1482, vol. 70, No. 3.

Bulgari, D., et al., "Endophytic Bacterial Diversity in Grapevine (*Vitis vinifera* L.) Leaves Described by 16S rRNA Gene Sequence Analysis and Length Beterogeneity-PCR", The Journal of Microbiology, Aug. 2009, p. 393-401, vol. 47, No. 4.

Amann, R., et al., "Single-cell identification in microbial communities by improved fluorescence in situ hybridization techniques", Nature Reviews Microbiology, 6: 339-348 (2008).

Chelius, M.K., et al., "The Diversity of Archaea and Bacteria in Association with the Roots of *Zea mays* L.", Microb Ecol (2001) 41:252-263.

Edwards, U., et al., "Isolation and direct complete nucleotide determination of entire genes. Characterization of a gene coding for 16S ribosomal RNA", Nucleic Acids Research 17: 7843-7853 (1989).

Prischl, M., et al., "Genetically modified Bt maize lines containing cry3Bb1, cry1A105 or cry1Ab2 do not affect the structure and functioning of root-associated endophyte communities", Applied Soil Ecology 54 (2012) 39-48.

Naveed, M., et al., "The endophyte *Enterobacter* sp. FD17: a maize growth enhancer selected based on rigorous testing of plant beneficial traits and colonization characteristics", Biol Fertil Soils (2014) 50:249-262.

Rashid, M., et al., "Inorganic polyphosphate is needed for swimming, swarming, and twitching motilities of Pseudomonas aeruginosa", PNAS vol. 97, No. 9, Apr. 25, 2000, pp. 4885-4890.

Mehta, S., et al., "An Efficient Method for Qualitative Screening of Phosphate-Solubilizing Bacteria", Current Microbiology vol. 43 (2001), pp. 51-56.

Dunn, R., et al., "Home Life: Factors Structuring the Bacterial Diversity Found within and between Homes", PLoS One, vol. 8, Issue 5, May 2013.

Massol-Deya, A., et al., "Bacterial community fingerprinting of amplified 16S and 16-23S ribosomal DNA gene sequences and restriction endonuclease analysis (ARDRA)", Molecular Microbial Ecology Manual 3.3.2: 1-8, 1995.

Extended European Search Report for Application No. 22190659,7, dated Feb. 10, 2023, 8 pages.

U'Ren, Jana M., et al.; "Community Analysis Reveals Close Affinities Between Endophytic and Endolichenic Fungi in Mosses and Lichens", Microbial Ecology, vol. 60, No. 2,Jul. 13, 2010, pp. 340-353.

Shah, S., et al: "Colonization with non-mycorrhizal culturable endophytic fungi enhances orchid growth and indole acetic acid production", BMC Microbiology, vol. 22, No. 1, Jan. 1, 2022, pp. 1-13.

Faria, M.; Wraight, S.P. Biological control of Bemisia tabaci with fungi. Crop Prot. 2001, 20, 767-778.

(56) References Cited

OTHER PUBLICATIONS

Friedman, J. et al., "Regularization Path for Generalized Linear Models via Coordinate Descent," Journal of Statistical Software, 2010, vol. 33, No. 1, pp. 1-22.

Hoy, M.A.; Singh, R.; Rogers, M.E. Evaluations of a novel isolate of Isaria fumosorosea for control of the Asian citrus psyllid, *Diaphorina citri* (Hemiptera: Psyllidae). Fla. Entomol. 2010, 93, 24-32.

Kepenekci, I. et al., "Pathogenicity of the Entomopathogenic Fungus, Purpureocillium Lilacinum TR1 Against the Black Cherry Aphid, *Myzus Cerasi Fabricus* (Hemiptera: Aphididae)," Mun. Ent. Zool., vol. 10, No. 1, Jan. 2015, pp. 53-60.

Koljalg. U. et al., "Towards a unified paradigm for sequence-based identification of fungi," Molecular Ecology, 2013, vol. 22, pp. 5271-5277.

Kozich, J.J. et al., "Development of a Dual-Index Sequencing Strategy and Curation Pipeline for Analyzing Amplicon Sequence Data on the MiSeq Illumina Sequencing Platform," Applied and Environmental Microbiology, Sep. 2013, vol. 79, No. 17, pp. 5112-5120.

Li, W. et al., "Ultrafast clustering algorithms for metagenomic sequence analysis," Briefings in Bioinformatics, Nov. 1, 2012, vol. 13, No. 6., pp. 656-668.

McMurdie, P.J. et al., "Waste Not, Want Not: Why Rarefying Microbiome Data Is Inadmissible," PLOS Computational Biology, 2014, vol. 10, No. 4, pp. e1003531.

Mezeal, I.A.; Mizil, S.N.; Hussin, M.S. Researching biocontrol of Trichoderma viride, Paecilomyces lilacinus in contradiction of effectiveness of fungi insulated as of selected therapeutic herbals. Plant Arch. 2018, 18, 1631-1637.

NCBI, "Purpureocillium lilacinum," Taxonomy ID: 33203, 2021, three pages, [Online] [Retrieved on Feb. 27, 2021] Retrieved from the Internet <URL: https://www.ncbi.nlm.nih.gov/Taxonomy/Browser/wwwtax.cgi?id=33203>.

Needleman, S.B. et al., "A General Method Applicable to the Search for Similarities in the Amino Acid Sequence of Two Proteins," Journal of Molecular Biology, 1970, vol. 28, No. 3, pp. 443-453.

O'Callaghan, M., "Microbial inoculation of seed for improved crop performance: issues and opportunities," Applied Microbiology and Biotechnology, vol. 100, May 2016, pp. 5729-5746.

Pandey, R. K. et al., "Effect of different bioformulations of Paecilomyces lilacinus against root-knot nematode (*Meloidogyne incognita*) infecting tomato (*Solanum esculentum*)," Indian Journal of Agricultural Sciences, vol. 81, No. 3, Mar. 2011, pp. 261-267.

Panyasiri, C.; Attathom, T.; Poehling, H.M. Pathogenicity of entomopathogenic fungi-potential candidates to control Insect pests on tomato under protected cultivation in Thailand. J. Plant Dis. Prot. 2007, 114, 278-287.

Paul, N.C.; Deng, J.X.; Lee, J.H.; Yu, S.H. New records of endophytic Paecilomyces inflatus and Bionectria ochroleuca from chili pepper plants in Korea. Mycobiology 2013, 41, 18-24.

Perveen, Z.; Shahzad, S.A. Comparative study of the efficacy of *Paecilomyces* species against root-knot nematode Meloidogyne incognita. Pak. J. Nematol. 2013, 31, 125-131.

Piatkowski, J.; Krzyzewska, U.; Nawrot, U. Antifungal activity of enthomopathogenic species of the genus Paecilomyces. Mikol. Lek. 2003, 10, 93-99 (with abstract).

Quast, C. et al., "The SILVA ribosomal RNA gene database project: improved data processing and web-based tools," Nucleic Acids Research, 2013, vol. 41, pp. D590-D596.

Raafat, I. et al., "*Nezara viridula* (Hemiptera: Pentatomidae) Cuticle as a Barrier for Beauveria bassiana and *Paecilomyces* sp. Infection," African Entomology, vol. 23, Iss. 1, Mar. 2015, pp. 75-87.

Rajinikanth, R. et al., "Management of nematode induced disease complex in seedlings of cauliflower (*Brsassica oleraceae* var. *botrytis*) using bio-pesticides," Pest Management in Horticultural Ecosystems, vol. 19, No. 2, Dec. 2013, pp. 203-210.

Ratnalikar, K.K. et al., "Biological management of root-rot of cotton caused by Rhizoctonia bataticola," Indian Phytopathol. 44-45, Suppl., XV, 1993, pp. 1-2.

Rideout, J.R. et al., "Subsampled open-reference clustering creates consistent, comprehensive OTU definitions and scales to billions of sequences," PeerJ, 2014, 2:e545.

Roth, A.C.J. et al., "Algorithm of OMA for large-scale orthology inference," BMC Bioinformatics, 2008, vol. 9, pp. 518.

Shenoy, B.D. et al., "Impact of DNA sequence-data on the taxonomy of anamorphic fungi," Fungal Diversity, 2007, vol. 26, No. 10, pp. 1-54.

Shibuya, H. et al., "Transformation of Cinchona Alkaloids into 1-N-Oxide Derivatives by Endophytic *Xylaria* sp. Isolated from Chinchona pubescens," Chem Pharm Bull, 2003, vol. 41, No. 1, pp. 71-74.

Singh, S. et al., "Bio-control activity of Purpureocillium lilacinum strains in managing root-knot disease of tomato caused by Meloidogyne incognita," Biocontrol Science and Technology, vol. 23, No. 12, Sep. 2013, pp. 1469-1489.

Sivakumar, T.; Eswaran, A.; Balabaskar, P. Bioefficacy of antagonists against for the management of *Fusarium oxysporum* f. sp. *lycopersici* and Meloidogyne incognita disease complex of tomato under field condition. Plant Arch. 2008, 8, 373-377 (with copy of abstract).

Smith, T.F. et al., "Identification of Common Molecular Subsequences," Journal of Molecular Biology, 1981, vol. 147, pp. 195-197.

Spurgeon, D.W., "Efficacy of Beauveria bassiana Against *Lygus hesperus* (Hemiptera: Miridae) at Low Temperatures," Journal of Entomological Science, vol. 45, Iss. 3, Jul. 2010, pp. 211-219.

Sword, G. A. et al., "Endophytic fungi alter sucking bug responses to cotton reproductive structures," Insect Science, vol. 24, Mar. 22, 2017, pp. 1003-1014.

Yeo, H.; Pell, J.K.; Alderson, P.G.; Clark, S.J.; Pye, B.J. Laboratory evaluation of temperature effects on the germination and growth of entomopathogenic fungi and on their pathogenicity to two aphid species. Pest Manag. Sci. 2003, 59, 156-165.

Zhang, X-Y. et al., "Diversity and Antimicrobial Activity of Culturable Fungi Isolated from Six Species of the South China Sea Gorgonians, " Microbial Ecology, vol. 64, Apr. 2012, pp. 617-627.

Zhou, W. et al., "A fungal endophyte defensive symbiosis affects plant-nematode interactions in cotton, " Plant Soil, vol. 422, Dec. 21, 2016, pp. 251-266.

Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.

Gaussian process model definition from towarddatascience.com downloaded May 15, 2023 (Year: 2023).

Gaussian process model definition from wikipedia.com, downloaded May 15, 2023 (Year: 2023).

Ghahramani, Z. (2013) Bayesian non-parametrics and the probabilistic approach to modeling. Philosophical transactions of the royal society A, vol. 371, 20110553, 20 pages.

Donahue, J. et al. Adversarial feature learning. arXiv: 1605.09782V7, Apr. 3, 2017.

Buee, et al. ("The rhizosphere zoo: an overview of plant-associated communities of microorganisms, including phages, bacteria, archaea, and fungi, and of some of their structuring factors." (2009): 189-212). (Year: 2009).

Hanapi, et al. ("Biofertilizer: Ingredients for Sustainable Agriculture." Biotechnology Development in Agriculture, Industry and Health: Current Industrial Application and Future Trends 1 (2012): 359-385). (Year: 2012).

Singh ("Screening and characterization of plant growth promoting rhizobacteria (PGPR): An overview." Bulletin of Environmental and Scientific Research 4.1-2 (2015): 1-2). (Year: 2016).

Database accession No. JQ759107, European Nucleotide Archive [Online] EMBL's European Bioinformatics Institute; Mar. 7, 2012, U'ren J M et al: "*Sordariomycetes* sp.genotype 60 isolate AK0688 internal transcribed spacer."

Database accession No. MG917011, European Nucleotide Archive [Online] EMBL's European Bioinformatics Institute; Feb. 21, 2019, Lagarde A. et al: "*Coniochaeta* sp.isolate Gir_07 internal transcribed spacer 1, partial sequence."

(56) References Cited

OTHER PUBLICATIONS

Database accession Nos. MZ267873, MZ267979, MZ267926, MZ267820; European Nucleotide Archive [Online] EMBL's European Bioinformatics Institute; Sep. 11, 2021, Arnold AE: "Coniochaeta nivea isolate LG0013 various submissions.".

Database accession Nos. MZ267874, MZ267980, MZ267927, MZ267821; European Nucleotide Archive [Online] EMBL's European Bioinformatics Institute; Sep. 11, 2021, Arnold AE: "Coniochaeta nivea isolate LG0023."

Kokaew, J. et al; "Coniochaeta ligniaria an endophytic fungus from Baeckea frutescens and its antagonistic effects against plant pathogenic fungi", Thai Journal of Agricultural Science, vol. 44, Jun. 1, 2011, pp. 123-131.

Lagarde A. et al: "Antiproliferative and antibiofilm potentials of endolichenic fungi associated with the lichen Nephroma laevigatum", Journal of Applied Microbiology, vol. 126, No. 4, Jan. 30, 2019, pp. 1044-1058.

Nilsson et al; "Correspondence: Intraspecific ITS Variability in the Kingdom Fungi as Expressed in the International Sequence Databases and Its Implications for Molecular Species Identification", Evolutionary Bioinformatics, Jan. 1, 2008, pp. 193-201.

Trifonova, R. et al; "Interactions of plant-beneficial bacteria with the ascomycete Coniochaeta ligniaria", Journal of Applied Microbiology, vol. 106, No. 6, Jun. 1, 2009, pp. 1859-1866.

Wang, B., et al., "Fungal endophytes of native *Gossypium* species in Australia," Mycological Research, 2007, pp. 347-354, vol. 111, No. 3.

Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.

Wang, Q., el al., "Naive Bayesian Classifier for Rapid Assignment of rRNA Sequences into the New Bacterial Taxonomy," Appl. Environ Microbiol., 2007, pp. 5261-5257, vol. 73, No. 16.

Waqas, M., el al., "Endophytic Fungi Produce Gibberellins and Indoleacetic Acid and Promotes Host-Plant Growth during Stress," Molecules, 2012, pp. 10754-10773, vol. 17.

Weaver, P.F., et al., "Characterization of Rhodopseudomonas capsulata," Arch Microbiol., 1975, pp. 207-216, vol. 105.

Weindling, R., "Relation of dosage to control of cotton seedling diseases by seed treatment," Plant Disease Reporter, 1943, 27, pp. 68-70.

Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.

Whelehan, et al., "Microenupsulalion using vibrating technology," Journal of Microencapsulation 2011, vol. 28(8), pp. 669-688.

White, J. F., et al., "A Proposed Mechanism for Nitrogen Acquisition by Grass Seedlings Through Oxidation of Symbiotic Bacteria," Symbiosis, 2012, pp. 161-171, vol. 57.

Marquez, L. M., et al., "A Virus in a Fungus in a Planl: Three-Way Symbiosis Required for Thermal Tolerance," Science, 2007, pp. 513-515, vol. 315.

Mastretta, C., et al., "Endophytic Bacteria from Seeds of Nicotiana Tabacum Can Reduce Cadmium Phytotoxicity," Intl J Phytoremediation, 2009, pp. 251-267, vol. 11.

Mateos, P. F., et al., "Cell-Associated Pectinolytic and Cellulolytic Enzymes in Rhizobium leguminosarum biovartrifolii," Appl Environ Microbiol., 1992, pp. 816-1822, vol. 58, No. 6.

McDonald, D., et al., "An Improved Greengenes Taxonomy with Explicit Ranks for Ecological and Evolutionary Analyses of Bacteria and Archaea," ISME J., 2012, pp. 610-618, vol. 6.

McGuire, K.L., et al., "Digging the New York City Skyline: Soil Fungal Communities in Green Roofs and City Parks," PLoS One, 2013, vol. 8, No. 3, 13 Pages.

Medina, P., el al., "Rapid Identification of Gelatin and Casein Hydrolysis Using TCA," J Microbiol Melhods, 2007, pp. 391-393, vol. 69.

Mehnaz, S., el al., "Growth Promoting Effects of Corn (*Zea mays*) Bacterial Isolates Under Greenhouse and Field Conditions," Soil Biology and Biochemistry, 2010, pp. 1848-1856, vol. 42.

Mehnaz, S., et al., "Isolation and 16S rRNA sequence analysis of the beneficial bacteria from the rhizosphere of rice," Canada Journal of Microbiology, 2001, pp. 110-117, vol. 47, No. 2.

Mei, C., et al., "The Use of Beneficial Microbial Endophytes for Plant Biomass and Stress Tolerance Improvement," Recent Patents on Biotechnology, 2010, pp. 81-95, vol. 4.

Michel, B. E., et al., "The Osmotic Potential of Polyethylene Glycol 6000," Plant Physiol., 1973, pp. 914-916, vol. 51.

Misk, A., et al., "Biocontrol of chickpea root rot using endophytic actinobacteria", Biocontrol. vol. 56, No. 5, Mar. 12, 2011, pp. 811-822, XP036215297.

Miyoshi-Akiyama, T., et al., "Multilocus Sequence Typing (MLST) for Characterization of Enterobacter cloacae." PLoS ONE, 2013, vol. 8, No. 6, 10 Pages, e66358.

Moe, L. A., "Amino Acids in the Rhizosphere: From Plants to Microbes," American Journal of Botany, 2013, pp. 1692-1705, vol. 100, No. 9.

Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.

Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.

Mundt, J.O., et al., "Bacteria Within Ovules and Seeds," Appl Environ Microbiol., 1976, pp. 694-698, vol. 32, No. 5.

Murali, Gopal, et al., "Microbiome Selection Could Spur Next-Generation Plant Breeding Strategies," Frontiers in Microbiology, vol. 7, Dec. 7, 2016, XP055531064.

Naik, B. S., et al., "Study on the diversity of endophytic communities from rice (*Oryza sativa* L.) and their antagonistic activities in vitro," Microbiological Research, 2009, pp. 290-296, vol. 164.

Nassar, A., et al., "Promotion of plant growth by an auxin-producing isolate of the yeast Williopsis satumus endophytic in maize (*Zea mays* L.) roots", Biology and Fertility of Soils; Cooperatlng Journal of International Society of Soil Science, Springer, Berlin, DE, vol. 42, No. 2, Nov. 1, 2005, pp. 97-108.

Naveed, M., "Maize Endophytes—Diversity, Functionality and Application Potential," University of Natural Resources and Life Sciences, 2013, pp. 1-266 and 81-87; Tables 1-3; Figure 2.

NCBI GenBank: Accession No. JX880250.1, "Enterobacteriaceae bacterium Clero1 16S ribosomal RNA gene, partial equence," NIH, June 24, 2015, 2 Pages, can be retrieved at <URL:https://www.ncbi.nlm.nih.gov/nucleotidelJX880250.1?report=genbank&log$=nuclalign&blast_rank=80 &RID=KWUPBV08015>.

NCBI GenBank: Accession No. XP55670271, "*Enlerobacter* sp. MLBOS 16S ribosomal RNA gene, partial sequence—Nucleotide", Jun. 9, 2012, 1 Page, can be retreived at URL:https://www.ncbi.nlm.nih.gov/nuccore/J Q765415.1/.

NCBI GenBank: Accession No. XP55670274, "*Enterobacter* sp. CR 6-3 16S ribosomal RNA gene, partial sequence—Nucleotide", Mar. 27, 2013, 1 Page, can be retreived at URL:https://www.ncbi.nlm.nih.gov/nuccore/K C355340.

NCBI GenBank: Accession No. XP55670279, "Uncultured bacterium clone bb2s4 16S ribosomal RNA gene, partial seque—Nucleotide", May 6, 2005, 1 Page, can be retreived at URL:https://www.ncbi.nlm.nih.gov/nuccore/D Q068880.

NCBI GenBank: CP000653.1 "*Enterobacter* sp. 638, complete genome" ASM1532v1, Apr. 18, 2007, 2 Pages, Can be retrieved at <URL:https://www.ncbi.nlm.nih.gov/assembly/GCA 000016325.1 >.

NCBI GenBank: CP000653.1 "*Enterobacter* sp. 638, complete genome" Jan. 28, 2014, 5 Pages, Can be retrieved at<URL:https://www.ncbi.nlm.nih.gov/nucoore/CP000653.1>.

NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.

NCBI GenBank: EBI accession No. EM STD:JQ759988, "*Dothideomyceles* sp. genotype 226 isolate FL0175 internal tran-

(56) References Cited

OTHER PUBLICATIONS scribed spacer 1, partial sequence; 5.8S ribosomal RNA gene and internal transcribed spacer 2, complete sequence; and 28S ribosomal RNA gene, partial sequence," May 17, 2012, 2 Pages.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI, GenBankAccession No. KX641980.1, Jul. 29, 2017, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," 2 Pages, Can be retrieved at<URL:https://www.ncbi.nlm.nih.gov/nuccore/KX641980>.
NCBI, GenBankAccession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., el al., "Taxon-Specific Fungal Primers Reveal Unexpectedly High Diversity During Leaf Decomposition in a Stream," Mycological Progress, 2004, pp. 41-49, vol. 3, No. 1.
Nimnoi, P., et al., "Co-Inoculation of Soybean (*Glycin max*) wtth Actinomycetes and Bradyrhizobium Japonicum Enhances Plant Growth, Nitrogenase Activity and Plant Nutrition," Journal of Plant Nutrition, 2014, pp. 432-446, vol. 37.
Nishijima. K.A., et al., "Demonstrating Pathogenicity of Enterobacter cloacae on Macadamia and Identifying Associated Volatiles of Gray Kernel of Macadamia in Hawaii," Plant Disease, Oct. 2007. vol. 91, No. 10, pp. 1221-1228.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
O'Hanlon, K., et al., "Exploring the potential of symbiotic fungal endophytec in cereal disease suppression", Biological Control, vol. 63, No. 2, Sep. 5, 2012, pp. 69-78.
Ogbo, F., et al., "Some Characteristics of a Plant Growth Promoting; iEnterobacter/isp. Isolated from the Roots of Maize", Advances in Microbiology, Jan. 1, 2012, vol. 02, No. 03, pp. 368-374.
Okunishi, S., et al., "Bacterial Flora of Endophytes in the Maturing Seeds of Cultivated Rice (*Oryza saliva*)," Microbes and Environment, 2005, pp. 168-177, vol. 20, No. 3.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Orakçi GE et al, "Selection of antagonistic actinomycete isolates as biocontrol agents against root-rot fungi", Fresenius Environmental Bulletin, 2010, 19: 417-424 & GenBank Accession Number GQ475299, Oct. 5, 2009.
Orole, O. O., et al., "Bacterial and fungal endophytes associated with grains and roots of maize," Journal of Ecology and the Natural Environment, 2011, pp. 296-303, vol. 3, No. 9.
Pacovsky, R., "Carbohydrate, protein and amino acid status of Glycine-Glomus-Bradyrhizobium symbioses," Physiologia Pantarium; 75:346-354, 1989).
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.
Partida-Martinez, L.P., et al., "The Microbe-Free Plant: Fact or Artifact?" Front Plant Sci., 2011, vol. 2, No. 100, 16 Pages.
PCT International Preliminary Report on Patentability, PCT Application No. PCT/US2016/030292, dated Aug. 2, 2017, 23 Pages.
PCT International Search Report and Wlitten Opinion, PCT Application No. PCT/US2015/068206, dated Jun. 27, 2016, 20 Pages.
PCT International Search Report and Wlitten Opinion, PCT Application No. PCT/US2016/036504, dated Nov. 4, 2016, 18 Pages.
PCT International Search Report and Written Opinion for PCT/AU2018/050387, dated Jul. 12, 2018, 8 pages.
Clark, E. M., et al., "Improved Histochemical Techniques for the Detection of Acremonium coenophilum in Tall Fescue and Methods of in vitro Culture of the Fungus," J Microbiol Methods, 1983, pp. 149-155, vol. 1.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Clay, K., "Effects of fungal endophyles on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevine: Flowers, Berries, and Seeds: Identification of Cultivable Bacteria, Comparison with Other Plant Parts, and Visualization of Niches of Colonization," Microbial Ecology, 2011, pp. 188-197, vol. 62.
Compant, S., et al., "Endophytic colonization of *Vitis vinfera* L. by Burkholderia phytofirmans strain PsJN: from the rhizosphere to inflorescence tissues," FEMS Microbiol Ecol, 2008, pp. 84-93, vol. 63.
Conn, V. M., "Effect of Microbial Inoculants on the Indigenous Actinobacterial Endophyte Population in the Roots of Wheats as Determined by Tenninal Restriction Fragment Length Polymorphism," Applied and Environmental Microbiology, 2004, pp. 6407-6413, vol. 70, No. 11.
Coombs, J. T., et al., "Isolation and Identification of Actinobacteria from Surface-Sterilized Wheat Roots," Applied and Environmental Microbiolog,, 2003, pp. 5603-5608, vol. 69, No. 9.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycin max* (L) Merril) Against Challenge Inoculation with R. solani," Journal of Applied Science and Research, 2014, pp. 70-84, vol. 2, No. 5.
Danhorn, T., et al., "Biofilm Formation by Plant-Associated Bacteria," Annu Rev Microbiol. 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Environmental Microbiology, 2008, pp. 2669-2678, vol. 74, No. 9.
Database EMBL [Online] Oct. 1, 2001, 2 Pages, "Setosphaeria monoceras 28S ribosomal RNA gene, partial sequence," XP002777918, retrieved from EBI accession No. EM_STD:AY016368 Database accession; No. AY016368 sequence.
Database Geneseq Database accession No. BAP97938 "Pantoea dispersa strain KACC91642P 16S rDNA sequence, SEQ ID 1." Aug. 15, 2013, 1 Page.
DBGET, "Orthology: K14454," 2005, 2 pages, can be retrieved at <URL:http://www.genome.jp/dbget-bin/www.bget?ko:K14454>.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.

(56) References Cited

OTHER PUBLICATIONS

De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.

De Medeiros, L., et al., "Evaluation of Herbicidal Potential of Depsides from Cladosporium uredinicola an Endophytic Fungus found in Guava Fruit," J. Braz. Chem Soc., 2012, vol. 23, No. 8, p. 1551-1557.

De Melo Pereira, G. V., et al. "A Multlphasic Approach for the Identification of Endophytic Bacterial in Strawberry Fruit and their Potential for Plant Growth Promotion," Microb. Ecology, 2012, pp. 405-417, vol. 63, No. 2.

De Santi, M. et al., "A combined morphologic and molecular approach for characterizing fungal microflora from a traditional Italian cheese (*Fossa cheese*)," Inter. Dairy J., 2010, vol. 10, No. 7, pp. 465-471.

De Souza, J. J., et al., "Terpenoids from Endophytic Fungi," Molecules, 2011, pp. 10604-10618, vol. 16, No. 12.

Dennis, C., et al., "Antagonistic Properties of Species Groups of Trichodenna," Trans Brit Mycol Soc, 1971, pp. 25-39, vol. 57, No. 1.

Desiro, A., et al., "Detection of a novel intracellular microbiome hosted in arbuscular mycorrhizal fungi," ISME Journal, 2014, pp. 257-270, vol. 8.

Djordjevic, D., et al., "Microtiter Plate Assay for Assessment of Listeria monocylogenes Biofilm Formation," Annl Environ Microbiol, 2002, pp. 2950-2958, vol. 68, No. 6.

Don, R.H., et al., "Properties of Six Pesticide Degradation Plasmids Isolated From Alcaligenes Paradoxus and Alcaligenes eutrophus," J Bacteriol., 1981, pp. 681-686, vol. 145, No. 2.

Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012, 2 Pages.

Eberhard, A., et al., "Structural Identification of Autoinducer of Photobacterium fischeri Luciferase," Biochem., 1981, pp. 2444-2449, vol. 20.

Edgar, R. C., "Search and Clustering Orders of Magnitude Faster than Blast," Bioinformatics, 2010, pp. 2460-2461, vol. 26, No. 19.

Edgar, R. C., "Uparse: Highly Accurate OTU Sequences From Microbial Amplicon Reads," Nat. Methods, 2013, pp. 996-998, vol. 10, No. 10.

Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012, 27 Pages.

Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages, e66049.

Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.

El-Shanshoury, A. R., "Growth Promotion of Wheat Seedlings by Streptomyces atroolivaceus," Journal of Agronomy and Crop Science, 1989, pp. 109-114, vol. 163.

Emerson, D., et al., "Identifying and Characterizing Bacteria in an Era of Genomics and Proleomics." BioScience, 2008, pp. 925-936, vol. 58, No. 10.

Endre, G., et al., "A Receptor Kinase Gene Regulating Symbiotic Nodule Development," Nature, 2002, pp. 962-966, vol. 417.

European Patent Office, Communication Pursuant to Article 94(3) EPC for European Patent Application No. 13874703.5, dated Jan. 5, 2018, 4 Pages.

European Patent Office, Communication Pursuant to Article 94(3) EPC for European Patent Application No. 15810847.2, dated Nov. 17, 2017, 17 Pages.

European Patent Office, Communication Pursuant to Article 94(3) EPC for European Patent Application No. 14748326.7, dated Feb. 15, 2018, 7 Pages.

European Patent Office, Communication Pursuant to Article 94(3) EPC for European Patent Application No. 14777213.1, dated Jun. 18, 2018, 4 Pages.

European Patent Office, Examination Report for European Patent Application No. EP 14777213.1, dated Oct. 20, 2017, 12 Pages.

European Patent Office, Examination Report, European Patent Application No. 14748326.7, dated Jul. 19, 2017, 4 Pages.

European Patent Office, Extended European Search Report, European Patent Application No. EP 15809264.3, dated Mar. 12, 2018, 14 Pages.

European Patent Office, Extended European Search Report, European Patent Application No. EP 15812324.0, dated Feb. 21, 2018, 23 Pages.

European Paten Office, Extended European Search Report, European Patent Application No. EP 15876324.3, dated Jun. 12, 2018, 9 Pages.

European Paten Office, Supplementary European Search Report for European Patent Application No. 15810847.2, dated Feb. 28, 2018, 19 Pages.

European Paten Office, Supplementary European Search Report, European Patent Application No. EP 13874703.5, dated Jun. 21, 2016, 3 Pages.

"Sequence Alignment of JQ047949 with Instant SEQ ID No. 2," Search conducted on Jan. 2, 2019, 2 pages.

Abarenkov, K., et al., "PlutoF-A Web Based Workbench for Ecological and Taxonomic Research, with an Online Implementation for Fungal ITS Sequences," Evol Bioinform Online, 2010, pp. 189-196. vol. 6.

Abarenkov, K., et al., "The Unite Database for Molecular Identification of Fungi—Recent Updates and Future Perspectives," New Phvtol., 2010, pp. 281-285, vol. 186.

Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.

Abdellatif, L., et al., "Endophytic hyphal companmentalizalion is required for successful symbiotic Ascomycota association with root cells," Mycological Research, 2009, pp. 782-791, vol. 113.

Abdou, R., et al., "Botryorhodines A-D, antifungal and cytotoxic depsidones from Botryosphaeria rhodina, an endophyte of the medicinal plant Bidens pilosa," Phytochemistry, 2010, vol. 71, pp. 110-116.

Abou-Shanab, R.A., et al: "Characterization of Ni-resistant bacteria in the rhizosphere of the hyperaccumulalor Alyssum murale by 16S rRNA gene sequence analysis", World Journal of Microbiology and Biotechnology, vol. 26, No. 1, Aug. 15, 2009, pp. 101-108.

Adhikari, M., el al., "A New Record of Pseudeurotium bakeri from Crop Field Soil in Korea," The Korean Journal of Mycology, 2016, pp. 145-149, vol. 44.

Ahmad, F., et al., "Screening of Free-Living Rhizospheric Bacteria for Their Multiple Plant Growth Promotinq Activities," Microbiol Res., 2008, pp. 173-181, vol. 163.

Al-Askar AA, "Microbiological studies on the in vitro inhibitory effecl of Streptomyces collinus albescens against some phytopathogenic fungi", African Journal of Microbiology Research, 2012, 6: 3277-3283 & GenBank Accession No. AB184101, May 20, 2008.

Alvarez-Perez, S., et al., "Zooming-in on floral nectar: a first exploration of nectar-associated bacteria in wild plant communities," FEMS Microbiol. Ecol, 2012, vol. 80, No. 3, pp. 591-602.

Amann, R., et al., "The Identification of Microorganisms by Fluorescence in Situ Hybridisation," Curr Opin Biotechnol., 2001, pp. 231-236, vol. 12.

Amatuzzi, R.F., et al., "Potential of endophylic fungi as biocontrol agents of *Duponchelia fovealis* (Zeller) Lepidoptera:Crambidae," Brazilian Journal of Biology, Nov. 9, 2017, 7 Pages.

Amatuzzi, R.F., et al., "Universidade Federal Do Parana," Jan. 1, 2014, 52 Pages. (With English Abstract).

Antony-Badu, S., et al., "Multiple *Streptomyces* species with distinct secondary metabolomes have identical 16S rRNA gene sequences." Scientific Reports 7.1, Sep. 2017, No. 7, 11089, pp. 1-8.

Apel, K., et al., "Reactive Oxygen Species: Metabolism, Oxidative Stress, and Signal Transduction," Annu Rev Plant Biol., 2004, pp. 373-399, vol. 55.

(56) References Cited

OTHER PUBLICATIONS

Ardakani, M.R. et al., "Absorption of N, P, K thorugh triple inoculation of wheat (*Triticum aestivum* L.) by *Azospirillum brasilense, Streptomyces* sp., Glomus intraradicee and manure application," Physiol Mol Biol Plants, 2011, vol. 17, No. 2, pp. 181-192.

Arendt, K. R., et al., "Isolation of endohyphal bacteria from foliar Ascomycota and in vitro establishment of their symbiolic associations," Appl. Environ. Microbiol., 2016, pp. 2943-2949, vol. 82, No. 10.

Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.

Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.

Aveskamp, M., et al., "DNA phylogeny reveals polyphyly of Phoma section Peyronellaea and multiple taxonomic novelties," Mycologia, 2009, vol. 101, No. 3, pp. 363-382.

Azcon, R., et al., "Selective interactions between different species of mycorrhizal fungi and Rhizobium meliloti strains, and their effects on growth, N2-fixation (15N) and nutrition of *Medicago sativa* L.," New Phytol., 1991, vol. 117, pp. 399-404.

Bacon, C. W, et al., "Isolation, In Planta Detection, and Uses of Endophytic Bacteria for Plant Protection," Manual of nvironmenlal Microbiology, 2007, pp. 638-647.

Baker, K. F., et al., "Dynamics of Seed Transmission of Plant Pathogens," Annu Rev. Phytopathol., 1966, pp. 311-334, vol. 4.

Baltruschat, H., el al., "Salt tolerance of baney induced by the root endophyte Piriformospora indica is associated with a strong increase in antioxidants," New Phytologist., 2008, pp. 501-510, vol. 180.

Bandara, WM.M.S., et al., "Interactions among endophytic bacteria and fungi: effects and potentials" Journal of Biosciences, Dec. 2006, vol. 31, No. 5, pp. 645-650.

Barnett, S., et al., "Seleclion of microbes for control of Rhizoctonia root rot on wheat using a high throughput pathosyslem", Biological Control, Jul. 6, 2017, 113: 45-57.

Bashan, Yoav E., et al., "Alginate Beads as Synthetic Inoculant Carriers for Slow Release of Bacteria that Affect Plant Growth," Applied and Environmental Microbiology, pp. 1089-1098, May 1986.

Bashan, Yoav Ed, et al., "Inoculants of plant growth-promoting bacteria for use in agriculture," Biotechnology Advances, Elsevier Publishing, Balking, GB, vol. 16, No. 4, Jul. 1, 1998, pp. 729-770, XP004123985.

Bensch, K., et al., "Species and ecological diversity within the Cladosporium cladosporioides complex (Davidiellaceae, Capnodiales)," Studies in Mycology, 2010, pp. 1-94, vol. 67.

Bentley, S.D., et al, Complete genome sequence of the model actinomycete Streptomyces coelicolor A3(2), Nature. May 9, 2002;417(6885):141-7. (Year: 2002).

Bethlenfalvay, G., et al., "Mycorrhizal fungi effects on nutrient composition and yield of soybean seeds", Journal of Plant Nutrition, vol. 20, pp. 4-5, Apr. 1, 1997, pp. 581-591.

Bing, LA, et al., "Suppression of *Ostrinia nubilalis* (Hübner) (Lepidoptera: Pyralidae) by endophytic *Beauveria bassiana* (Balsamo) Vuillemin", Environmental Entomol, Entomological Society of America, College Park, MD, US, vol. 20, Jan. 1, 1991, pp. 1207-1211.

Block, C. C., et al., "Seed Transmission of Pantoea stewartii in Field and Sweet Corn," Plant Disease, 1998, pp. 775-780, vol. 82.

Bragantia, et al, "Identificaqao E Avaliaqao De Rizobacterias Isoladas De Raizes De Milho," Jan. 1, 2010, pp. 905-911, Retrieved from the Internet: URL:http://www.scielo.br/pdf/brag/v69n4/v69n4a17.pdf (With English Abstract).

Brinkmeyer, R., et al., "Uncuitured Bacterium Clone ARKMP-100 16S Ribosomal RNA Gene, Partial Sequence," NCBI GenBank Accession No. AF468334, Submitted Jan. 14, 2002.

Brodie, E.L., et al., "Uncultured Bacterium Clone BANW722 16S Ribosomal RNA Gene, Partial Sequence," NCBI GenBank Accession No. DQ264636, Submitted Oct. 25, 2005, 1 Page.

Bulgarelli, D., et al., "Structure and Functions of the Bacterial Microbiola of Plants," Annu Rev Plant Biol., 2013, pp. 807-838, vol. 64.

Büttner, D., et al., "Regulation and secretion of Xanthomonas virulence factors," FEMS Microbiology Reviews, 2010, pp. 107-133, vol. 34, No. 2.

Caporaso, J.G.. et al., "Ultra-High-Throughput Microbiol Community Analysis on the Illumina HiSeq and MiSeq Platforms," ISME J., 2012, pp. 1621-1624, vol. 6.

Castillo, D., et al., "Fungal Endophytes: Plant Protective Agents Against Herbivores," Power Point Presentation dated Aug. 4, 2013.

Castillo, D., et al., "Fungal Entomopathogenic Endophytec: Negative Effects on Cotton Aphid Reproduction in Greenhouse and Field Conditions," Power Point Presentation dated Mar. 23, 2013, 21 Pages.

Cavalier-Smith, T., "A Revised Six-Kingdom System of Life," Biol Rev Camb Philos Soc., 1998, pp. 203-266, vol. 73.

Cha, C., et al., "Production of Acyl-Homoserine Lactone Quorum-Sensing Signals by Gram-Negative Plant Associated Bacteria," Mol Plant Microbe Inleract.,1998, pp. 1119-1129, vol. 11, No. 11.

Chagas, F., et al., "A Mixed Culture of Endophytic Fungi Increases Production of Antifungal Polyketides," J. Chem Ecol., Oct. 2013, pp. 1335-1342, vol. 39.

Chaves, J., et al., "Identification and Phylogeny of Streptomyces Based on Gene Sequences", Research Journal of Microbiology, vol. 13, No. 1, Dec. 15, 2017, pp. 13-20, XP055675917.

Chenhua Li , et al., "Change in deep soil microbial communities due to long-term fertilization." Soil Biology and Biochemislry, vol. 75, Mar. 5, 2014, pp. 264-272, XP055530941.

Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 4(9):3214-3222.

Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.

European Patent Office, Supplementary European Search Report, European Patent Application No. 13874703.5, dated Oct. 21, 2016, 16 Pages.

European Patent Office, Supplementary European Search Report, European Patent Application No. 14860187.5, dated May 24, 2017, 9 Pages.

European Patent Office, Supplementary European Search Report, European Patent Application No. 14874589.6, dated Jul. 11, 2017, 9 Pages.

European Patent Office, Supplementary European Search Report, European Patent Application No. ep 15809264.3, dated Dec. 4, 2017, 16 Pages.

European Patent Office, Supplementary European Search Report, European Patent Application No. EP 15812324.0, dated Nov. 2, 2017, 19 Pages.

European Patent Office, Supplementary Partial European Search Report, European Patent Application No. 13874703.5, dated Jun. 21, 2016, 3 Pages.

Faria, D. C., et al., "Endophyllc Bacteria Isolated from Orchid and Their Potential to Promote Plant Growth," World Microbiol Biotechnol., 2013, pp. 217-221, vol. 29.

Fatima Z et al, "Antifungal activity of plant growth-promoting rhizobacteria isolates against Rhizoctonia solani in wheat", African Journal of Biotechnology, 2009, 8: 219-225.

Ferrando, L., et al., "Molecular and Culture-Dependent Analyses Revealed Similarities in the Endophytic Bacterial Community Composition of Leaves from Three Rice (*Oryza saliva*) Varieties," FEMS Microbiol Ecol., 2012, pp. 696-708, vol. 80.

Fiehn, O., et al., "Metabolite Profiling for Plant Functional Genomics," Nature Biotechnol., 2000, pp. 1157-1161. vol. 8.

Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.

Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.

(56) References Cited

OTHER PUBLICATIONS

Fisher, P. J., et al., "Fungal saprobes and pathogens as endophytes of rice (*Oryza sativa* L.)," New Phytol., 1992, pp. 137-143, vol. 120.
Fisher, P.R., et al., "Isolation and Characterization of the Pesticide-Degrading Plasmid pJP1 from Alcaligenes paradoxus," J Bacteriol., 1978, pp. 798-804, vol. 135, No. 3.
Fox, G., et al., "How close is close: 16S rRNA sequence identity may not be sufficient to guarantee species identity." International Journal of Systematic and Evolutionary Microbiology 42.1, 1992, pp. 166-170.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common,"ISME J., 2008, pp. 901-910, vol. 2.
Gabor, J., et al., "Mycorrhizal fungi effects on nutrient composition and yield of soybean seeds," Journal of Plant Nutrition, 20:4-5, 581-591, 1997.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitalion of Major Human Cutaneous Bacterial and Fungal Populations," J Clin Microbiol, 2010, pp. 3575-3581, vol. 48, No. 10.
Carazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007, 1 Page.
Gebhardt, J., et al., "Characterization of a single soybean cDNA encoding cytosollc and glyoxysomal isozymes of aspartate aminostransferase," Plant Molecular Biology, 1998, pp. 99-108, vol 37.
GenBank Accession No. KF951483, Jan. 5, 2014.
GenBank Accession No. KJ152029, May 6, 2015.
GenBank Accession No. KJ162248, Apr. 8, 2014.
GenBank Accession No. KY643705, Feb. 27, 2017.
GenBank: AF034210.1 "Glycine max aspartate aminotransferase glyoxysomal isozyme AAT1 precursor and aspartate aminotransferase cytosolic isozyme AAT2 (AAT) mRNA, complete eds," NCBI, May 26, 1998, 2 Pages, can be retrieved at <URL:https://www.ncbi.nlm.nih.gov/nucoore/AF034210>.
GenBank: JN210900.1, "*Enterobacter* sp. WS05 16S ribosomal RNA gene, partial sequence," NCBI, Sep. 24, 2012, 1 Page, can be retrieved at <URL:https://www.ncbi.nlm.nih.gov/nuccore/jn210900>.
GenBank: NP_001237541.1, "aspartate aminotransferase glyoxysomal isozyme AAT1 precursor [Glycine max]," NCBI, Oct. 29, 2016, 2 Pages, can be retrieved at <URL:https//ww.ncbi.nlm.nih.gov/protein/NP_001237541.1 >.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl Database, GenEmbl Record No. JN872548.1, 2 Pages, 2012.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
GenEmbl Database, GenEmbl Record No. KF673660, Sandberg, et al., "Fungal endophytec of aquatic macrophytes: diverse host-generalists characterized by tissue preferences and geographic structure," 2013, 35 Pages.

GenEmbl Database, GenEmbl Record No. KP991588, Huang, et al., "Pervasive effects of wildfire on foliar endophyte communities in montane forest trees," Mar. 2015, 35 Pages.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phyiogeny of Sarocladium (*Hypocreales*)," Persoonia, 2015, pp. 10-24, vol. 34.
Girard, G., et al., "A novel taxonomic marker that discriminates between morphologically complex actinomycetes", Open Biology, vol. 3, No. 10, Oct. 2013, p. 130073,XP055675916.
Gitaitis, R., et al., "The Epidemiology and Management of Seedborne Bacterial Diseases," Annu Rev Phytopathol., 2007, pp. 371-397, vol. 45.
Gopalakrishnan, S. et al., "Plant growth-promoting activities of *Streptomyces* spp. In sorghum and rice", SpringerPlus, 2/1/574, pp. 1-8, http://www.springerplus.com/content/2/1/574, 2013.
Goudjal, Y., et al., "Biocontrol of Rhizoctonia solani damping-off and promotion of tomato plant growth by endophytic actinomycetes isolated from native plants of Algerian Sahara", Microbiological Research, 2014, vol. 169, No. 1, pp. 59-65.
Govindarajan, M. et al., "Effects of the Inoculation of Burkholderia vietnamensis and Related Endophytic Diaztrophic Bacteria on Grain Yield of Rice", Microbiol Ecology, Apr. 4, 2007, 17 Pages.
Grondona, I., et al., "Tusal®, a commercial biocontrol formulation based on Trichoderma," Bulletin OILB/SROP, 2004, pp. 285-288, vol. 27, No. 8.
Groppe, K., et al., "Interaction between the endophytic fungus Epichloë bromicola and the grass Bromus erectus: effects of endophyte infection, fungal concentration and environment on grass growth and flowering," Mol Ecol., 8:1827-1835, 1999.
Gu, O., et al., "*Glyoomyces sambucus* sp. nov., an endophytic actinomycete islolaled from the stem of Sambucus adnata Wall," International Journal of Systematic and Evolutionary Microbiology, 2007, pp. 1995-1998, vol. 57.
Guo, X., et al., "Red Soils Harbor Diverse Culturable Actinomycetes That Are Promising Sources of Novel Secondary Metaboiites", Applied and Environmental Microbiology, Feb. 27, 2015, vol. 81, No. 9, pp. 3086-3103.
Guo, Y., et al. "A multi locus phylogeny of the Streptomyces griseus 16S rRNA gene clade: use of multilocus sequence analysis for streptomycete systematics", International Journal of Systematic and Evolutionary Microbiology, vol. 58, No. 1, 2008, pp. 149-159, XP055675936.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Visagie, C.M., et al., "Identification and nomenclature of the genus Penicillium," Studies in Mycology, Jun. 2014, pp. 343-371, vol. 78.
Vujanovic, V., et al., "19th International Conference on *Arabidopsis*. Research Proceedings—ICAR13," Jul. 23-27, 2008, 264 Pages, Montreal, QC, Canada.
Vujanovic, V., el al., "A comparative study of endophytic mycobiota in leaves of Acer saccharum in eastern North America," Mycological Progress, May 2002, pp. 147-154, vol. 1, Issue 2.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "Mycovitality—a new concept of plant biotechnology," Canadian Journal Plant Pathol. 2007, vol. 29, p. 451.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al., "Seed endosymbiosis: a vital relationship in providing prenatal care to plants," Can. J. Plant Sci., NRC Research Press, Feb. 6, 2017, pp. 972-981, vol. 97.

(56) References Cited

OTHER PUBLICATIONS

Vujanovic, V., et al., "Viability Testing of Orchid Seed and the Promotion of Colouration and Germination," Annals of Botany, Mar. 17, 2000, pp. 79-86, vol. 86.

Vujanovic, V., et al.,"Orchid seed viability testing by fungal bioassays and molecular phylogeny," Floriculture, ornamental and plant biotechnology, 2006, vol. 63, pp. 563-569.

Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.

Waller, F., et al., "The Endophytic Fungus Piriformospora indica Reprograms Barley to Salt-Stress Tolerance, Disease Resistance, and Higher Yield," PNAS, 2005, pp. 13386-13391, vol. 102, No. 38.

Wiegand, I., et al., "Agar and Broth Dilution Methods to Determine the Minimal Inhibitory Concentration (MIC) of AntiMicrobiol Substances," Nature Protocols, 2008, pp. 163-175, vol. 3, No. 2.

Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings" World J Microbiol Biotechnol., 2014, pp. 835-845, vol. 30.

Xu. Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.

Xue, Q.Y., et al., "Evaluation of the Strains of Acinetobacter and Enterobacter as potential Biocontrol Agents Against Ralstonia Will of Tomato," Biological Control, 2009, vol. 48, pp. 252-258.

Yandigeri, M. S., et al.. "Drought-tolerant endophytic actinobacteria promote growth of wheat (*Triticum aestivum*) under water stress conditions," Plant Growth Regulation, 2012, pp. 411-420, vol. 68.

Yashiro et al., "Effect of Streptomycin Treatment on Bacterial Community Structure in the Apple Phyllosphere," PLOS ONE, May 21, 2012, vol. 7, No. 5, 10 pages.

Yennamalli, R., et al., "Endoglucanases: insights into thermostability for biofuel applications", Biotech Biofuels, 2013, vol. 6, Issue 136, pp. 1-9.

Yezerski, A., et al., "The Effects of the Presence of Stored Product Pests on the Microfauna of a Flour Community," Journal of Applied Microbiology, 2005, pp. 507-515, vol. 98.

You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4, (with English Abstract).

Youssef, Y.A., et al., "Production of Plant Growth Substances by Rhizosphere Myoflora of Broad Bean and Cotton," Biologia Plantarum, 1975, pp. 175-181, vol. 17, No. 3.

Zhang, J., et al. "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50 No. 2, pp. 191-198, GenBank Accession No: JN210900.

Zhang, W., et al., Host range of Exserohilum monoceras, a potential bioherbicide for the control of *Echinochloa* species, Canadian Journal of Botany/ Journal Canadien De Botan, National Research Council, Ottawa, CA. vol. 75, Jan. 1, 1997, pp. 685-692.

Zhang, Y., et al., "BcGs1, a glycoprotein from Botrytis cinerea, elicits defence response and improves disease resistance in host plants. Biochemical and biophysical research communications," Biochemical and Biophysical Research Communications, 2015, vol. 457, No. 4, pp. 627-634.

Zhao, J.H., et al., "Bioactive secondary metabolites from *Nigrospora* sp. LLGLM003, an endophylic fungus of the medicinal plant *Moringa oleifera* Lam." World Journal of Microbiology and Biotechnology, Kluwer Academic Publishers, Feb. 12, 2012, pp. 2107-2112, vol. 28, No. 5.

Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.

Zhou, W., et al., "Effects of the Fungal Endophyte *Paecilomyces* sp. in Cotton on the Roo-Knot Nematode Meloidogyne incognita," poster dated Jan. 7, 2013.

Zhu et al., "*Helminthosporium velutinum and H. aquaticum* sp. nov. from aquatic habitats in Yunnan Province, China." Phytotaxa, 2016, vol. 253, No. 3, pp. 179-190.

Zimmerman, N.B., et al., "Fungal Endophyte Communities Reflect Environmental Stmcturing Across a Hawaiian Landscape," Proc Natl Acad Sci USA, 2012, pp. 13022-13027, vol. 109, No. 32.

Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.

\* cited by examiner

BACTERIAL INOCULANTS

CROSS REFERENCE TO RELATED APPLICATIONS

This application is the National Stage of International Application No. PCT/AU/2018/050387, filed Apr. 27, 2018, which claims priority to Australian Provisional Application No. 2017901523, filed Apr. 27, 2017, and to U.S. Provisional Application No. 62/568,763, filed Oct. 5, 2017, the disclosures of which are incorporated by reference in their entirety.

SEQUENCE LISTING

The instant application contains a Sequence Listing with 4686 sequences which has been submitted via EFS in conjunction with this specification and is hereby incorporated by reference in its entirety. Said ASCII copy is named IFU-6401WOUS Sequence_Listing.txt, and is 35,340,406 bytes in size.

FIELD

The present invention relates to bacterial inoculants, and methods for their use, to control a fungal root disease in a plant and promote plant growth in water limited conditions.

BACKGROUND

Root diseases are a major constraint in cropping systems worldwide. Root diseases are difficult to control with fungicides as they are below ground and management practices often provide only partial reductions in disease.

Two major genera of fungal root rot pathogens are *Rhizoctonia* and *Pythium* which infect multiple crop types in broad acre and horticulture crops. These pathogens infect roots of plants, reducing germination and establishment of emerging seedlings and causing loss of root hairs and breakdown of roots in established plants and thereby reducing the plants access to water and nutrients resulting in reduced growth and yield. In broad acre cereal cropping systems these pathogens are ubiquitous and the increase in minimal or no-till tillage practices has increased the impact of these diseases. Their broad host range means there are few non-host crops to use in rotations to reduce pathogen inoculum and there are no resistant cereal cultivars available.

In dryland cereal cropping systems, *Rhizoctonia* root rot, caused by *Rhizoctonia solani* anastomosis group AG8 is the main fungal root disease, especially in low rainfall zones, causing an estimated yield loss of Aus $77 mil per annum in Australia. *R. oryzae* is also an important root pathogen in cereals. *Pythium* damping off and root rot is caused by a number of *Pythium* species, with *P. irregulare* and *P. ultimum* being the main species infecting cereals with the prevalence and severity of disease increasing in higher rainfall zones causing an estimated yield loss of Aus $11 mil per annum in Australia.

The incidence and severity of *Rhizoctonia* and *Pythium* diseases on crop plants are known to be influenced by soil and plant associated microbes, with numerous reports of bacteria and fungi able to reduce disease under controlled conditions in pots. However, further improved microbial inoculants to control fungal root diseases in valuable crops, such as wheat or canola, are desirable.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

DESCRIPTION

Figure 1:
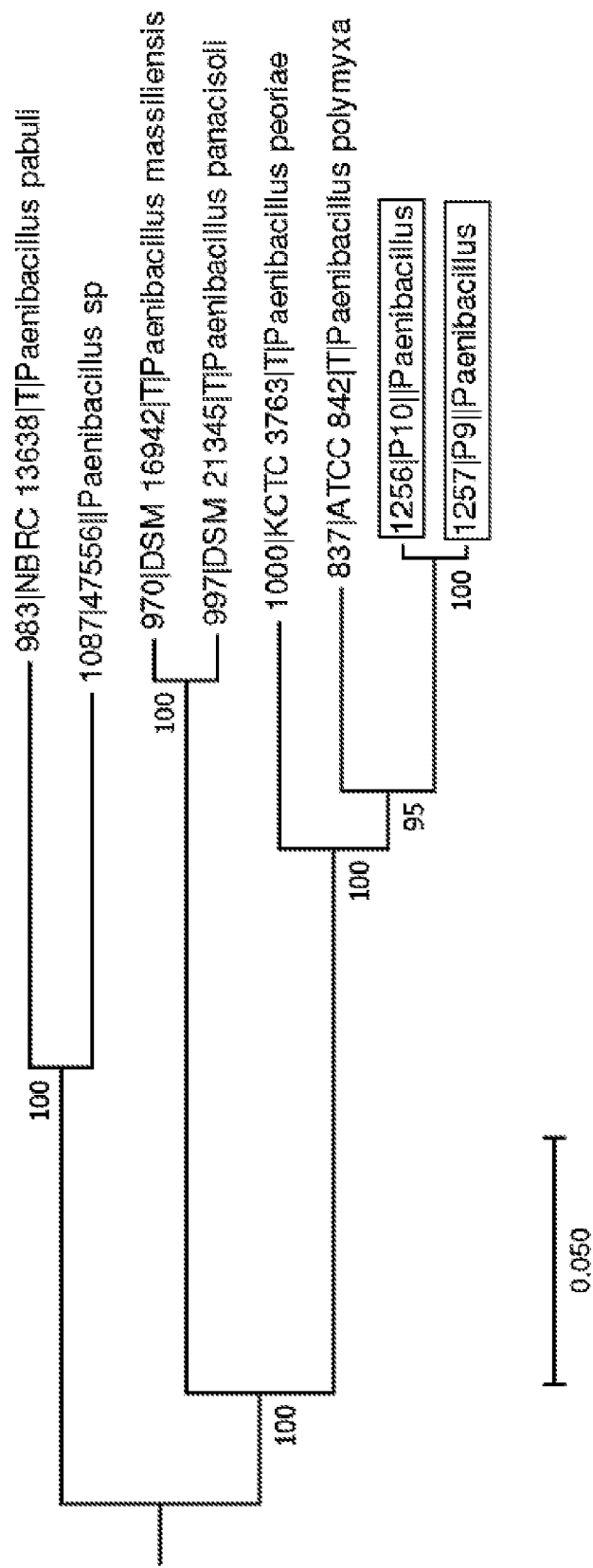
FIG. 1 depicts a phylogenetic tree visualizing the phylogenetic relationship between strain 9.4E (P9), strain 10.6D (P10), and other *Paenibacillus* strains.

Nucleotide and amino acid sequences are referred to herein by a sequence identifier number (SEQ ID NO:). A summary of the sequence identifiers is provided below:

| Sequence Identifier | Description |
| --- | --- |
| SEQ ID NO: 1 | 27f primer nucleotide sequence |
| SEQ ID NO: 2 | 1465r primer nucleotide sequence |
| SEQ ID NO: 3 | *Paenibacillus* sp. 10.6D 16S rRNA gene nucleotide sequence |
| SEQ ID NO: 4 | *Paenibacillus* sp. 9.4E 16S rRNA gene nucleotide sequence |
| SEQ ID NO: 5 | *Streptomyces* sp. HSA1273 16S rRNA gene nucleotide sequence |
| SEQ ID NO: 6 | *Streptomyces* sp. BD141 16S rRNA gene nucleotide sequence |
| SEQ ID NO: 7 | *Paenibacillus* sp. 9.4E atpD gene nucleotide sequence |
| SEQ ID NO: 8 | *Paenibacillus* sp. 9.4E recA gene nucleotide sequence |
| SEQ ID NO: 9 | *Paenibacillus* sp. 9.4E trpB gene nucleotide sequence |
| SEQ ID NO: 10 | *Paenibacillus* sp. 9.4E gyrB gene nucleotide sequence |
| SEQ ID NO: 11 | *Paenibacillus* sp. 10.6D recA gene nucleotide sequence |
| SEQ ID NO: 12 | *Paenibacillus* sp. 10.6D atpD gene nucleotide sequence |
| SEQ ID NO: 13 | *Paenibacillus* sp. 10.6D trp gene nucleotide sequence |
| SEQ ID NO: 14 | *Paenibacillus* sp. 10.6D gyrB gene nucleotide sequence |
| SEQ ID NO: 15,*Paenibacillus* sp. 10.6D full genome sequence 19-75 | |
| SEQ ID NO: 16,*Streptomyces* sp. H0A1273 full genome sequence 76-2592 | |
| SEQ ID NO: 17,*Paenibacillus* sp. 9.4E full genome sequence 2593-2707 | |
| SEQ ID NO: 18,*Streptomyces* sp. BD141 full genome sequence 2708-4686 | |

In this work over 2,000 microbial strains were screened in a multi-tiered screening system to identify strains which can reduce disease when applied to seeds under field cropping conditions. Strains were sequentially screened in a high-throughput plant-pathogen tube system, then pot bioassay systems, characterised, and selected strains assessed in field trials. Field trials were carried out in cereal growers' paddocks with naturally occurring pathogen inoculum.

In a first aspect, the present invention provides a bacterial inoculant for controlling a fungal root disease on a plant.

A "bacterial inoculant" as referred to herein should be understood as any isolated microorganism which may be inoculated onto a plant in order to control a fungal root disease.

An "isolated" bacterial microorganism should be understood to be any bacterial microorganism which has been removed from its native environment and grown or cultured in vitro. In some embodiments, an isolated bacterial microorganism may be substantially purified and thus grown or cultured substantially in the absence of other microorganisms. Alternatively, in some embodiments, the isolated microorganism may be co-cultured with one or more additional microorganisms.

As referred to herein, terms such as "inoculating", "inoculated", "inoculation" and the like should be understood to include any method or process wherein a plant (including without limitation a plant seed, leaf, root) is brought into contact with a bacterial inoculant by human ingenuity such that the bacterial inoculant exists on or in the plant in a manner not found in nature prior to the application of the bacterial inoculant. In some embodiments inoculation may comprise the bacterial inoculant being applied to a wheat seed or canola plant seed. In some embodiments inoculation may comprise the bacterial inoculant being applied to soil in which a wheat or canola plant is growing or in which a wheat or canola seed will be planted. In some embodiments, inoculation may comprise the bacterial inoculant being applied to root and/or shoot tissue of a wheat or canola plant. In some embodiments inoculation may be the mechanical or manual application, artificial inoculation or disposition of a bacterial inoculant onto or into a plant or plant growth medium. A plant growth medium is any composition or environment in which a plant may be grown. In some embodiments, the plant growth medium is soil.

As described later, in some embodiments, the bacterial inoculants contemplated by the present invention are from a specific genus or species, comprise a defining 16S rRNA gene nucleotide sequence, and/or comprise a defined bacterial strain.

As also set out above, the present invention contemplates control of a fungal disease of a plant. In some embodiments, the fungal disease is a root disease of a monocot or dicot plant. In some embodiments, the monocot is a cereal plant. In some embodiments the cereal plant is member of the plant family Poaceae or Gramineae, for example: wheat, rice, corn, barley, millet, sorghum, oat, rye, or related grain producing plant. In some embodiments, the dicot is a member of the plant family Fabaceae or Leguminosae, for example: soybeans, peas, beans, lentils, peanuts, alfalfa, clover, or related plants. In some embodiments, the dicot is a member of the plant family Brassicaceae or Cruciferae, for example: canola, rapeseed, cabbage, cauliflower, kale, radish, mustard, turnip, or related plants.

A "wheat plant", as referred to herein, should be understood to include plants of the genus *Triticum*. In some embodiments, the term "wheat" should be understood to include one or more of diploid wheat, tetraploid wheat and/or hexaploid wheat. In some embodiments, the wheat plant may be a cultivated species of wheat including, for example, *Triticum aestivum, Triticum durum, Triticum monococcum* or *Triticum spelta*. In some embodiments, the term "wheat" refers to wheat of the species *Triticum aestivum*.

A "canola plant", as referred to herein, should be understood to include plants of the genus *Brassica*, particularly *B. napus, B. rapa, B. campestris, B. oleracea, B. montana*, and hybrids thereof. In some embodiments, the term "canola" should be understood to include one or more of rape, rapeseed, oilseed rape, Argentine canola, and colza. In some embodiments, the canola plant may be a cultivated species of canola. In some embodiments, the canola plant may be a species canola of including, for example, *B. napus* subsp. *oleifera, B. napus* subsp. *napus, B. napus* subsp. *napus f. annua, B. napus* subsp. *napus f. napus, Brassica campestris* subsp. *napus*, or *Brassica rapa* subsp. *oleifera*. In some embodiments, the term "canola" refers to canola of the species *Brassica napus* L and subspecies thereof.

As also set out above, the present invention contemplates bacterial inoculants for the control of a fungal disease in a plant. In some embodiments, the fungal disease is a root disease of a monocot or dicot plant. In some embodiments, the present invention contemplates bacterial inoculants for the control of a fungal root disease in a wheat plant or a canola plant.

In some embodiments, "control" of a fungal root disease in a plant may be understood as enhancement of one or more growth parameters in an inoculated plant relative to an uninoculated plant of the same taxon in the presence of the fungal root disease. In some embodiments, the plant is a wheat plant or a canola plant.

In some embodiments, enhancement of a growth parameter will include an increase in the measured value of the growth parameter. For example, an increase in one or more of:

a length and/or mass of a shoot; a length and/or mass of a root; a number and/or mass of seed;

a concentration and/or amount of a nutrient; or a germination rate.

In some embodiments, an "increase" in a growth parameter may include, for example, a 1%, 5%, 10%, 20%, 30%, 40%, 50%, 60%, 70%, 80%, 90%, 100%, 2-fold, 5-fold, 10-fold, 20-fold, 50-fold, 100-fold increase in the growth parameter in an inoculated plant relative to a plant of the same taxon that has not been inoculated. In some embodiments, the plant is grown in the presence of a fungal root disease. In some embodiments, the plant is grown in water limited conditions. In some embodiments, the plant is a wheat plant or a canola plant.

In some embodiments, however, "enhancement" of the growth parameter may include a decrease in the measured value of the growth parameter. For example, a decrease in the concentration and/or amount of a pathogen, disease symptom and/or toxin in the plant, and/or a decrease in the time of germination of a wheat or canola plant seed, may be considered "enhancement" of such growth parameters.

In some embodiments, a "decrease" in a growth parameter may include, for example, a 1%, 5%, 10%, 20%, 30%, 40%, 50%, 60%, 70%, 80%, 90%, 95% or 100% decrease in the growth parameter in an inoculated plant relative to a plant of the same taxon that has not been inoculated. In some embodiments, the plant is grown in the presence of a fungal root disease. In some embodiments, the plant is grown in water limited conditions. In some embodiments, the plant is a wheat plant or a canola plant.

In some embodiments, enhancement of a growth parameter may comprise enhancement within a particular time period. For example, in some embodiments, enhancement of the growth parameter may comprise enhancement over a time period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90 or 100 days.

As set out above, the present invention contemplates a bacterial inoculant for controlling a fungal root disease on a wheat or canola plant. A "fungal root disease" as referred to herein should be understood as any disease of a plant which infects or damages the roots of the plant and which is caused by a fungus or fungal-like pathogen. A "fungal-like" pathogen should be understood to specifically include Oomycete pathogens such as pathogens of the genus *Pythium*. In some embodiments, the fungal root disease is a disease of a wheat or canola plant.

In some embodiments, the fungal root disease is caused by a pathogen of the genus *Rhizoctonia*. In some embodiments, the pathogen is of the species *Rhizoctonia solani*. In some embodiments, the pathogen is *Rhizoctonia solani* AG8. In some embodiments, the pathogen is of the species *Rhizoctonia oryzae*.

In some embodiments, the bacterial inoculant of the first aspect of the invention includes a microorganism of the genus *Paenibacillus* that is able to at least control a fungal root disease caused by a pathogen of the genus *Rhizoctonia*. In some embodiments, the microorganism of the genus *Paenibacillus* is able to at least control a pathogen of the genus *Rhizoctonia* on or in a wheat or canola plant.

In some embodiments bacterial inoculant of the genus *Paenibacillus* includes a microorganism having a 16S rRNA gene nucleotide sequence which is at least 98% identical to SEQ ID NO: 3. In some embodiments the microorganism comprises a 16S rRNA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 3.

In some embodiments bacterial inoculant of the genus *Paenibacillus* includes a microorganism having an atpD gene nucleotide sequence which is at least 98% identical to SEQ ID NO: 7. In some embodiments the microorganism comprises an atpD gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 7.

In some embodiments bacterial inoculant of the genus *Paenibacillus* includes a microorganism having a recA gene nucleotide sequence which is at least 98% identical to SEQ ID NO: 8. In some embodiments the microorganism comprises a recA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 8.

In some embodiments bacterial inoculant of the genus *Paenibacillus* includes a microorganism having a trpB gene nucleotide sequence which is at least 98% identical to SEQ ID NO: 9. In some embodiments the microorganism comprises a trpB gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 9.

In some embodiments bacterial inoculant of the genus *Paenibacillus* includes a microorganism having a gyrB gene nucleotide sequence which is at least 98% identical to SEQ ID NO: 10. In some embodiments the microorganism comprises a gyrB gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 10.

In some embodiments bacterial inoculant of the genus *Paenibacillus* includes a microorganism having a recA gene nucleotide sequence which is at least 98% identical to SEQ ID NO: 11. In some embodiments the microorganism comprises a recA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 11.

In some embodiments bacterial inoculant of the genus *Paenibacillus* includes a microorganism having an atpD gene nucleotide sequence which is at least 98% identical to SEQ ID NO: 12. In some embodiments the microorganism comprises an atpD gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 12.

In some embodiments bacterial inoculant of the genus *Paenibacillus* includes a microorganism having a trpB gene nucleotide sequence which is at least 98% identical to SEQ ID NO: 13. In some embodiments the microorganism comprises a trpB gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 13.

In some embodiments bacterial inoculant of the genus *Paenibacillus* includes a microorganism having a GyrB gene nucleotide sequence which is at least 98% identical to SEQ ID NO: 14. In some embodiments the microorganism comprises a gyrB gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 14.

When comparing nucleic acid sequences to calculate a percentage identity (in relation to any of the SEQ ID NOS herein, the compared nucleic acid sequences should be compared over a comparison window of, for example, at least 100 nucleotide residues, at least 300 nucleotide residues, at least 600 nucleotide residues, at least 1000 nucleotide residues, at least 1100 nucleotide residues, at least 1200 nucleotide residues, at least 1300 nucleotide residues or at least 1400 nucleotide residues. In some embodiments, the comparison window may comprise the region in each of the compared nucleotide sequences between and including the binding sites of the 27f primer (SEQ ID NO: 1) and the 1465r primer (SEQ ID NO: 2) on the compared nucleotide sequences. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms such as the BLAST family of programs as, for example, disclosed by Altschul et al. (Nucl. Acids Res. 25: 3389-3402, 1997). A detailed discussion of sequence analysis can be found in Unit 19.3 of Ausubel et al. (Current Protocols in Molecular Biology, John Wiley & Sons Inc., Chapter 15,1998).

A number of particularly useful actinobacterial microorganisms of the present invention have been deposited with the National Measurement Institute ('NMI'), 1/153 Bertie Street, Port Melbourne, Victoria, 3207, Australia, in accordance with the provisions of the Budapest Treaty on the International Recognition of the Deposit of Microorganisms for the Purposes of Patent Procedure.

Accordingly, in some embodiments, the bacterial inoculant includes microorganism *Paenibacillus* sp. 10.6D as deposited on 9 Mar. 2017 with the National Measurement Institute under NMI accession number V17/004922; or a mutant or derivative of said deposited microorganism that retains the ability to control a fungal root disease in a wheat or canola plant. In some embodiments, the mutant or derivative retains the ability to control a fungal root disease in a wheat or canola plant, where the root disease is caused by a pathogen of the genus *Rhizoctonia*.

A "mutant or derivative" of the subject deposited microorganisms referred to herein should be understood to encompass, for example, any spontaneous or induced mutant, conjugation progeny or genetically modified form of a deposited strains which retains the ability to enhance one or more growth parameters of a plant. In some embodiments, a mutant or derivative retains the ability to enhance one or more growth parameters of a wheat or canola plant in the presence of the fungal root disease or under water limited conditions. Mutagenisation techniques that may be used to generate derivatives or mutants include, for example, chemical mutagenesis (e.g., EMS mutagenesis), ionising radiation-induced mutagenesis (e.g., X-ray mutagenesis, y-ray mutagenesis and UV mutagenesis), genetic insertion mutagenesis methods (e.g., transposon mutagenesis) and the like.

In some embodiments, the bacterial inoculant of the first aspect of the invention includes a microorganism of the genus *Streptomyces* that is able to at least control a fungal root disease caused by a pathogen of the genus *Rhizoctonia*. In some embodiments, the microorganism of the genus *Streptomyces* is able to at least control a pathogen of the genus *Rhizoctonia* on or in a wheat or canola plant.

In some embodiments bacterial inoculant of the genus *Streptomyces* includes a microorganism having a 16S rRNA gene nucleotide sequence which is at least 98% identical to SEQ ID NO: 5. In some embodiments the microorganism comprises a 16S rRNA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 5.

In some embodiments, the bacterial inoculant includes microorganism *Streptomyces* sp. HCA1273 as deposited on 9 Mar. 2017 with the National Measurement Institute under NMI accession number V17/004924; or a mutant or derivative of said deposited microorganism that retains the ability to control a fungal root disease in a wheat or canola plant. In some embodiments, the mutant or derivative retains the ability to control a fungal root disease in a wheat or canola plant, where the root disease is caused by a pathogen of the genus *Rhizoctonia*.

In some embodiments, the fungal root disease is caused by a pathogen of the genus *Pythium*. In some embodiments, the pathogen is of the species *Pythium irregulare*. In some embodiments, the pathogen is of the species *Pythium ultimum*.

In some embodiments, the bacterial inoculant of the first aspect of the invention includes a microorganism of the genus *Paenibacillus* that is able to at least control a fungal root disease caused by a pathogen of the genus *Pythium*. In some embodiments, the microorganism of the genus *Paenibacillus* is able to at least control a pathogen of the genus *Pythium* in or on a wheat or canola plant.

In some embodiments bacterial inoculant of the genus *Paenibacillus* includes a microorganism having a 16S rRNA gene nucleotide sequence which is at least 98% identical to SEQ ID NO: 4. In some embodiments the microorganism comprises a 16S rRNA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 4.

In some embodiments, the bacterial inoculant includes microorganism *Paenibacillus* sp. 9.4E as deposited on 9 Mar. 2017 with the National Measurement Institute under NMI accession number V17/004921; or a mutant or derivative of said deposited microorganism that retains the ability to control a fungal root disease in a wheat or canola plant. In some embodiments, the mutant or derivative retains the ability to control a fungal root disease in a wheat or canola plant, where the root disease is caused by a pathogen of the genus *Pythium*.

In some embodiments, the bacterial inoculant of the first aspect of the invention includes a microorganism of the genus *Streptomyces* that is able to at least control a fungal root disease caused by a pathogen of the genus *Pythium* on a wheat or canola plant. In some embodiments, the microorganism of the genus *Streptomyces* is able to at least control a pathogen of the genus *Pythium* on a wheat or canola plant.

In some embodiments bacterial inoculant of the genus *Streptomyces* includes a microorganism having a 16S rRNA gene nucleotide sequence which is at least 98% identical to SEQ ID NO: 6. In some embodiments the microorganism comprises a 16S rRNA gene nucleotide sequence which is at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to SEQ ID NO: 6.

In some embodiments, bacterial inoculants and methods disclosed herein include a microorganism having a gene, e.g., a 16S rRNA gene, having a nucleotide sequence at least 97%, 98%, 99% or 100% identical to the same gene nucleotide sequence found in one of the genomic sequences found in Table 1. In some embodiments the microorganism comprises a gene having a nucleotide sequence of at least 97%, at least 97.1%, at least 97.2% at least 97.3%, at least 97.4%, at least 97.5%, at least 97.6%, at least 97.7%, at least 97.8%, at least 97.9%, at least 98%, at least 98.1%, at least 98.2% at least 98.3%, at least 98.4%, at least 98.5%, at least 98.6%, at least 98.7%, at least 98.8%, at least 98.9%, at least 99%, at least 99.1%, at least 99.2% at least 99.3%, at least 99.4%, at least 99.5%, at least 99.6%, at least 99.7%, at least 99.8% at least 99.9% or 100% sequence identity to the same gene nucleotide sequence found in one of the genomic sequences found in Table 1.

In some embodiments, the bacterial inoculant includes microorganism *Streptomyces* sp. BD141 as deposited on 9 Mar. 2017 with the National Measurement Institute under NMI accession number V17/004923; or a mutant or derivative of said deposited microorganism that retains the ability to control a fungal root disease in a wheat or canola plant. In some embodiments, the mutant or derivative retains the ability to control a fungal root disease in a wheat or canola plant, where the root disease is caused by a pathogen of the genus *Pythium*.

In a second aspect, the present invention provides an inoculant composition comprising one or more bacterial inoculants as hereinbefore described.

In some embodiments, the inoculant composition further comprises a carrier or additive. The carrier or additives used will depend on the nature of the inoculant composition. For example, the inoculant composition may be in the form of a liquid composition, a solid composition (such as a powder, pellet or granular composition) a seed dressing or the like. In some embodiments, the inoculant composition comprises a seed dressing.

A range of useful carriers or additives would be readily apparent to those of skill in the art and may include, for example: one or more gums (including xanthan gum), clay or peat based carriers, one or more nutrients including carbon or nitrogen sources, one or more antifungal or antibacterial agents, one or more seed coating agents, one or more wetting agents and the like.

The inoculant compositions of the present invention may be adapted to be applied to a plant, for example a wheat or canola plant, in any suitable way. For example, the inoculant composition could be adapted to be applied as a seed coating, applied as a solid or liquid composition to the foliage or roots of a plant, or applied as a solid or liquid composition to soil before, during or after sowing of a plant, for example a wheat or canola plant.

In a third aspect, the present invention provides a method for controlling a fungal root disease on a plant, the method comprising inoculating a plant with a bacterial inoculant or inoculant composition as hereinbefore described.

In some embodiments, the plant is a wheat plant or a canola plant.

In some embodiments, the root disease is caused by a pathogen of the genus *Rhizoctonia*.

In some embodiments, the root disease is caused by a pathogen of the genus *Pythium*.

In some embodiments, the bacterial inoculant or inoculant composition are inoculated onto a seed. In some embodiments, the bacterial inoculant or inoculant composition are inoculated onto a wheat seed or canola seed.

In a fourth aspect, the present invention provides a method for improving growth of a plant under water limited conditions, the method comprising inoculating a plant with a bacterial inoculant or inoculant composition as hereinbefore described.

In some embodiments, the method provides for improving growth of a monocot or dicot plant under water limited conditions. In some embodiments, the monocot is a cereal plant. In some embodiments the cereal plant is member of the plant family Poaceae or Gramineae, for example: wheat, rice, corn, barley, millet, sorghum, oat, rye, or related grain producing plant. In some embodiments, the dicot is a member of the plant family Fabaceae or Leguminosae, for example: soybeans, peas, beans, lentils, peanuts, alfalfa, clover, or related plants. In some embodiments, the dicot is a member of the plant family Brassicaceae or Cruciferae, for example: canola, rapeseed, cabbage, cauliflower, kale, radish, mustard, turnip, or related plants.

Water limited conditions, include but are not limited to, drought conditions and dryland (non-irrigated) environments. In some embodiments, water limited conditions are growth conditions where the amount of water available to the plants is less than the amount necessary to support optimal plant growth. In some embodiments, the water limited condition comprises less than 5%, 10%, 20%, 30%, 40%, 50%, 60%, 70%, 75%, 80%, 85%, 90%, 95%, 97%, less than 100% of the amount necessary to support optimal plant growth. In some embodiments, the amount of water necessary to support optimal plant growth is measured in average or above average yield. In some embodiments, the water limited conditions are the amount of water that result in a reduction in average yield of un-inoculated plants by at least 5%, at least 10%, between 5-15%, about 15%, at least 20%, about 20%, between 20-25%, or at least 25%. In some embodiments, the water limited conditions are a non-irrigated field. In some embodiments, the water limited condition comprises a 1%, 2%, 3%, 4%, 5%, 10%, 20%, 30%, 40%, 50% reduction in rainfall relative to the 1 year, 2, 3, 4, 5 year, 6, 7, 8, 9, 10 year historical average rainfall for the geography. In some embodiments, the water limited conditions are controlled by human endeavor in greenhouse or laboratory assays. A non-limiting example of a laboratory assay conducted in water limited conditions is growth of a plant in an aqueous solution comprising polyethylene glycol (PEG), for example 7.5% PEG 6000.

In a fifth aspect, the present invention provides a bacterial inoculant as described herein with respect to any of the examples.

In a sixth aspect, the present invention provides an inoculant composition as described herein with respect to any of the examples.

In a seventh aspect, the present invention provides a method for controlling a fungal root disease on a wheat or canola plant as described herein with respect to any of the examples.

In an eighth aspect, the present invention provides a method for a method for improving growth of a wheat or canola plant under water limited as described herein with respect to any of the examples.

The present invention is further described with reference to the following non-limiting examples:

EXAMPLE 1

Bacterial Inoculants for Control of Fungal Root Disease in Wheat or Canola

A number of microbial strains were screened in a series of in planta bioassays, characterised and assessed in field trials using naturally occurring pathogen inoculum. Four strains were identified as being of interest, as shown in Table 1.

TABLE 1

Strains identified as beneficial inoculants in grain cropping systems

| Strain Identifier | Alternative name | Full Genome Sequence (SEQ ID NO:) | Genus | Function—crop |
|---|---|---|---|---|
| 10.6D | P10 | SEQ ID NO: 15 | *Paenibacillus* | Rhizoctonia control—wheat or canola |
| HCA1273 | S12 | SEQ ID NO: 16 | *Streptomyces* | Rhizoctonia control—wheat or canola |
| 9.4E | P9 | SEQ ID NO: 17 | *Paenibacillus* | Pythium control—wheat |
| BD141 | S14 | SEQ ID NO: 18 | *Streptomyces* | Pythium control—wheat |

EXAMPLE 2

Identification

DNA of each strain was extracted. Two sections of 16S rRNA were amplified by PCR using primers 27f (agagtttgat cctggctcag, SEQ ID NO: 1) and 1492r (tacggytacc ttgttacgac tt, SEQ ID NO: 2). PCR products were sequenced by Sanger sequencing, two replicate extractions and forward and reverse directions of PCR fragments were sequenced. Sequences were identified using Ezbiocloud (www.ezbiocloud.net). Sequences were aligned with 20 closest matches using ClustalW in Mega7 and phylogeny inferred using Maximum Likelihood Tree and Nearest Neighbour Joining Trees. Results are shown in Tables 2 and 3.

TABLE 2

Identification of 10.6D, 9.4E, HCA1273, BD141

| Strain | Closest matches with type strains | Pairwise similarity % |
|---|---|---|
| 10.6D | *Paenibacillus peoriae* DSM8320$^T$ | 99.63 |
|  | *Paenibacillus kribbensis* AM49$^T$ | 98.90 |
| 9.4E | *Paenibacillus peoriae* DSM8320$^T$ | 98.99 |
|  | *Paenibacillus kribbensis* AM49$^T$ | 98.52 |
| HCA1273 | *Streptomyces prasinosporus* NRRLB12431$^T$ | 98.66 |
|  | *Streptomyces scopiformis* NBRC14215$^T$ | 98.36 |
| BD141 | *Streptomyces cyaneofuscatus* NRRLB2570$^T$ | 99.86 |
|  | *Streptomyces griseus* subsp. *griseus* KCTC9080 | 99.86 |

TABLE 3

16S rRNA sequences of 10.6D, 94.E, HCA1273, BD141, 5' to 3' orientation

| Strain | 16S rRNA sequence |
|---|---|
| 10.6D | GGATGGGCCTGCGGCGCATTAGCTAGTTGGTGGGGTAAAGGCCTACCAAGGCGA<br>CGATGCGTAGCCGACCTGAGAGGGTGATCGGCCACACTGGGACTGAGACACGGC<br>CCAGACTCCTACGGGAGGCAGCAGTAGGGAATCTTCCGCAATGGGCGAAAGCCT<br>GACGGAGCAACGCCGCGTGAGTGATGAAGGTTTTCGGATCGTAAAGCTCTGTTGC<br>CAGGGAAGAACGTCTTGTAGAGTAACTGCTACAAGAGTGACGGTACCTGAGAAG<br>AAAGCCCCGGCTAACTACGTGCCAGCAGCCGCGGTAATACGTAGGGGGCAAGCG<br>TTGTCCGGAATTATTGGGCGTAAAGCGCGCGCAGGCGGCTCTTTAAGTCTGGTGT<br>TTAATCCCGAGGCTCAACTTCGGGTCGCACTGGAAACTGGGGAGCTTGAGTGCAG<br>AAGAGGAGAGTGGAATTCCACGTGTAGCGGTGAAATGCGTAGAGATGTGGAGG<br>AACACCAGTGGCGAAGGCGACTCTCTGGGCTGTAACTGACGCTGAGGCGCGAAA<br>GCGTGGGGAGCAAACAGGATTAGATACCCTGGTAGTCCACGCCGTAAACGATGA<br>ATGCTAGGTGTTAGGGGTTTCGATACCCTTGGTGCCGAAGTTAACACATTAAGCAT<br>TCCGCCTGGGGAGTACGGTCGCAAGACTGAAACTCAAAGGAATTGACGGGGACC<br>CGCACAAGCAGTGGAGTATGTGGTTTAATTCGAAGCAACGCGAAGAACCTTACCA<br>GGTCTTGACATCCCTCTGACCGGTCTAGAGATAGACCTTTCCTTCGGGACAGAGG<br>AGACAGGTGGTGCATGGTTGTCGTCAGCTCGTGTCGTGAGATGTTGGGTTAAGTC<br>CCGCAACGAGCGCAACCCTTATGCTTAGTTGCCAGCAGGTCAAGCTGGGCACTCT<br>AAGCAGACTGCCGGTGACAAACCGGAGGAAGGTGGGGATGACGTCAAATCATCA<br>TGCCCCTTATGACCTGGGCTACACACGTACTACAATGGCCGGTACAACGGGAAGC<br>GAAATCGCGAGGTGGAGCCAATCCTAGAAAAGCCGGTCTCAGTTCGGATTGTAG<br>GCTGCAACTCGCCTACATGAAGTCGGAATTGCTAGTAATCGCGGATCAGCATGCC<br>GCGGTGAATACGTTCCCGGGTCTTGTACACACCGCCCGTCACACCACGAGAGTTT<br>ACAACACCCGAAGTCGGTGG (SEQ ID NO: 3) |
| 9.4E | GGATGGGCCTGCGGCGCATTAGCTAGTTGGTGGGGTAAAGGCCTACCAAGGCGA<br>CGATGCGTAGCCGACCTGAGAGGGTGATCGGCCACACTGGGACTGAGACACGGC<br>CCAGACTCCTACGGGAGGCAGCAGTAGGGAATCTTCCGCAATGGGCGAAAGCCT<br>GACGGAGCAACGCCGCGTGAGTGATGAAGGTTTTCGGATCGTAAAGCTCTGTTGC<br>CAGGGAAGAACGTCTTGTAGAGTAACTGCTACAAGAGTGACGGTACCTGAGAAG |

TABLE 3-continued 16S rRNA sequences of 10.6D, 94.E, HCA1273, BD141, 5' to 3' orientation

| Strain | 16S rRNA sequence |
|---|---|
| | AAAGCCCCGGCTAACTACGTGCCAGCAGCCGCGGTAATACGTAGGGGGCAAGCG<br>TTGTCCGGAATTATTGGGCGTAAAGCGCGCGCAGGCGGCTCTTTAAGTCTGGTGT<br>TTAATCCCGAGGCTCAACTTCGGGTCGCACTGGAAACTGGGGAGCTTGAGTGCAG<br>AAGAGGAGAGTGGAATTCCACGTGTAGCGGTGAAATGCGTAGAGATGTGGAGG<br>AACACCAGTGGCGAAGGCGACTCTCTGGGCTGTAACTGACGCTGAGGCGCGAAA<br>GCGTGGGGAGCAAACAGGATTAGATACCCTGGTAGTCCACGCCGTAAACGATGA<br>ATGCTAGGTGTTAGGGGTTTCGATACCCTTGGTGCCGAAGTTAACACATTAAGCAT<br>TCCGCCTGGGGAGTACGGTCGCAAGACTGAAACTCAAAGGAATTGACGGGGACC<br>CGCACAAGCAGTGGAGTATGTGGTTTAATTCGAAGCAACGCGAAGAACCTTACCA<br>GGTCTTGACATCCCTCTGACCGGTCTAGAGATAGACCTTTCCTTCGGGACAGAGG<br>AGACAGGTGGTGCATGGTTGTCGTCAGCTCGTGTCGTGAGATGTTGGGTTAAGTC<br>CCGCAACGAGCGCAACCCTTATGCTTAGTTGCCAGCAGGTCAAGCTGGGCACTCT<br>AAGCAGACTGCCGGTGACAAACCGGAGGAAGGTGGGGATGACGTCAAATCATCA<br>TGCCCCTTATGACCTGGGCTACACACGTACTACAATGGCCGGTACAACGGGAAGC<br>GAAATCGCGAGGTGGAGCCAATCCTAGAAAAGCCGGTCTCAGTTCGGATTGTAG<br>GCTGCAACTCGCCTACATGAAGTCGGAATTGCTAGTAATCGCGGATCAGCATGCC<br>GCGGTGAATACGTTCCCGGGTCTTGTACACACCGCCCGTCACACCACGAGAGTTT<br>ACAACACCCGAAGTCGGTGG (SEQ ID NO: 4) |
| HCA1273 | GATGAAGCCCTTCGGGGTGGATTAGTGGCGAACGGGTGAGTAACACGTGGGCAA<br>TCTGCCCTGCACTCTGGGACAAGCCCTGGGAAACGGGGTCTAATACCGGATATGAG<br>TCTCCACCGCATGGTGGGGGCTGTAAAGCTCCGGCGGTGCAGGATGAGCCCGCG<br>GCCTATCAGCTTGTTGGTGAGGTAACGGCTCACCAAGGCGACGACGGGTAGCCG<br>GCCTGAGAGGGCGACCGGCCACACTGGGACTGAGACACGGCCCAGACTCCTACG<br>GGAGGCAGCAGTGGGGAATATTGCACAATGGGCGCAAGCCTGATGCAGCGACGC<br>CGCGTGAGGGATGACGGCCTTCGGGTTGTAAACCTCTTTCAGCAGGGAAGAAGC<br>GAAAGTGACGGTACCTGCAGAAGAAGCGCCGGCTAACTACGTGCCAGCAGCCGC<br>GGTAATACGTAGGGCGCAAGCGTTGTCCGGAATTATTGGGCGTAAAGAGCTCGT<br>AGGCGGCTTGTCGCGTCGGTTGTGAAAGCCCGGGGCTTAACCCCGGGTCTGCAGT<br>CGATACGGGCAGGCTAGAGTTCGGTAGGGGAGATCGGAATTCCTGGTGTAGCGG<br>TGAAATGCGCAGATATCAGGAGGAACACCGGTGGCGAAGGCGGATCTCTGGGCC<br>GATACTGACGCTGAGGAGCGAAAGCGTGGGGAGCGAACAGGATTAGATACCCTG<br>GTAGTCCACGCCGTAAACGGTGGGCACTAGGTGTGGGCGACATTCCACGTCGTCC<br>GTGCCGCAGCTAACGCATTAAGTGCCCCGCCTGGGGAGTACGGCCGCAAGGCTA<br>AAACTCAAAGGAATTGACGGGGGCCCGCACAAGCGGCGGAGCATGTGGCTTAAT<br>TCGACGCAACGCGAAGAACCTTACCAAGGCTTGACATACACCGGAAAACCCTGGA<br>GACAGGGTCCCCCTTGTGGTCGGTGTACAGGTGGTGCATGGCTGTCGTCAGCTCG<br>TGTCGTGAGATGTTGGGTTAAGTCCCGCAACGAGCGCAACCCTTGTCCCGTGTTG<br>CCAGCAGGCCCTTGTGGTGCTGGGGACTCACGGGAGACCGCCGGGGTCAACTCG<br>GAGGAAGGTGGGGACGACGTCAAGTCATCATGCCCCTTATGTCTTGGGCTGCACA<br>CGTGCTACAATGGCCGGTACAATGAGCTGCGATACCGTGAGGTGGAGCGAATCTC<br>AAAAAGCCGGTCTCAGTTCGGATTGGGGTCTGCAACTCGACCCCATGAAGTCGGA<br>GTCGCTAGTAATCGCAGATCAGCATTGCTGCGGTGAATACGTTCCCGGGCCTTGT<br>ACACACCGCCCGTCACGTCACGAAAGTCGGTAACACCCGAAGCCGGTGGCCCAAC<br>CCC (SEQ ID NO: 5) |
| BD141 | AGTCGAACGATGAAGCCTTTCGGGGTGGATTAGTGGCGAACGGGTGAGTAACAC<br>GTGGGCAATCTGCCCTTCACTCTGGGACAAGCCCTGGGAAACGGGGTCTAATACCG<br>GATAACACTCTGTCCCGCATGGGACGGGGTTAAAAGCTCCGGCGGTGAAGGATG<br>AGCCCGCGGCCTATCAGCTTGTTGGTGGGGTAATGGCCTACCAAGGCGACGACG<br>GGTAGCCGGCCTGAGAGGGCGACCGGCCACACTGGGACTGAGACACGGCCCAG<br>ACTCCTACGGGAGGCAGCAGTGGGGAATATTGCACAATGGGCGAAAGCCTGATG<br>CAGCGACGCCGCGTGAGGGATGACGGCCTTCGGGTTGTAAACCTCTTTCAGCAGG<br>GAAGAAGCGAAAGTGACGGTACCTGCAGAAGAAGCGCCGGCTAACTACGTGCCA<br>GCAGCCGCGGTAATACGTAGGGCGCAAGCGTTGTCCGGAATTATTGGGCGTAAA<br>GAGCTCGTAGGCGGCTTGTCACGTCGGATGTGAAAGCCCGGGGCTTAACCCCGG<br>GTCTGCATTCGATACGGGCTAGCTAGAGTGTGGTAGGGGAGATCGGAATTCCTG<br>GTGTAGCGGTGAAATGCGCAGATATCAGGAGGAACACCGGTGGCGAAGGCGGA<br>TCTCTGGGCCATTACTGACGCTGAGGAGCGAAAGCGTGGGGAGCGAACAGGATT<br>AGATACCCTGGTAGTCCACGCCGTAAACGTTGGGAACTAGGTGTTGGCGACATTC<br>CACGTCGTCGGTGCCGCAGCTAACGCATTAAGTTCCCCGCCTGGGGAGTACGGCC<br>GCAAGGCTAAAACTCAAAGGAATTGACGGGGGCCCGCACAAGCAGCGGAGCATG<br>TGGCTTAATTCGACGCAACGCGAAGAACCTTACCAAGGCTTGACATATACCGGAA<br>AGCATCAGAGATGGTGCCCCCCTTGTGGTCGGTATACAGGTGGTGCATGGCTGTC<br>GTCAGCTCGTGTCGTGAGATGTTGGGTTAAGTCCCGCAACGAGCGCAACCCTTGT<br>TCTGTGTTGCCAGCATGCCCTTCGGGGTGATGGGGACTCACAGGAGACTGCCGGG<br>GTCAACTCGGAGGAAGGTGGGGACGACGTCAAGTCATCATGCCCCTTATGTCTTG<br>GGCTGCACACGTGCTACAATGGCCGGTACAATGAGCTGCGATGCCGCGAGGCGG<br>AGCGAATCTCAAAAAGCCGGTCTCAGTTCGGATTGGGGTCTGCAACTCGACCCCA<br>TGAAGTCGGAGTTGCTAGTAATCGCAGATCAGCATTGCTGCGGTGAATACGTTCC<br>CGGGCCTTGTACACACCGCCCGTCACGTCACGAAAGTCGGTAACACCCGAAGCCG<br>GTGGCCCAACCCCTTGTGGGAGGGAG (SEQ ID NO: 6) |

Additional gene sequences for strain 9.4E are depicted in Table 22, below.

TABLE 22 additional gene sequences, strain 9.4E

| Gene | Strain 9.4E Sequence |
|---|---|
| atpD | ATACGGGAGCTTGATGCGAGTGGATCAACCGCCGGGTAAATACCCATTTCGGAAA<br>TTTTACGTTCCAGATTCGTTGTAGCATCCAAATGGGCAAACGTCGTAGCAGGAGCC<br>GGGTCAGTGTAGTCATCCGCAGGCACATAGATCGCCTGAATGGAAGTAACAGAAC<br>CTTTTTTAGTAGAAGTAATCCGTTCTTGCAATTGACCCATCTCAGTAGCCAGCGTA<br>GGCTGGTAACCTACTGCTGAAGGCATACGTCCCAACAGAGCCGAAACCTCAGAAC<br>CCGCTTGAGTAAAGCGGAAATGTTATCAATAAAGAGCAACACGTCACGGCCTTC<br>TTGGTCACGGAAGTATTCCGCCATCGTCAGACCTGTGAGAGCTACACGCAAACGT<br>GCACCTGGAGGCTCGTTCATTTGTCCAAACACCATCGCTGTTTTGTTGATAACGCC<br>GGAATCTCTCATTTCATGATACAAGTCATTTCCTTCACGTGTGCGTTCACCTACACC<br>CGCAAATACAGAAATACCACCATGCTCCTGAGCGATATTGTTAATCAATTCTTGAA<br>TGGTTACGGTTTTACCTACACCAGCACCACCAAACAATCCGACTTTACCACCTTTGG<br>CATAAGGAGCTAGCAAGTCGATAACTTTAATACCTGTTTCGAGCATCTC<br>(SEQ ID NO: 7) |
| recA | CCCTGACCAAGGCGCTCACCTTCGTAGGAATACCAGGCTCCGCTCTTGTCGACAAT<br>GTCATGCTCCGTACCGATATCGATCAAGCTACCTTCTTTGGAAATACCCTCACCGTA<br>CATAATATCCACCTCAGCCTGACGGAAAGGAGGGGCAACTTTGTTCTTCACGACTT<br>TAATACGTGTGCGGTTACCCACAATGTCGTTACCCATTTTCAAACTTTCAATACGAC<br>GAACATCCAAACGTACCGTAGAGTAAAACTTCAAGGCACGTCCACCTGGTGTTGT<br>TTCAGGGTTACCGAACATAACACCTACTTTTTCACGTAGCTGGTTAATAAAAATAG<br>CAATGGTTTTCGACTTGTTAATGGCTCCAGAAAGCTTACGCAATGCCTGGGACATC<br>AAACGTGCTTGAAGACCAACGTGGGAATCTCCCATTTCGCCTTCAATCTCTGCCTT<br>GGGCACAAGTGCCGCTACGGAGTCAACAACTACAATGTCTACTGCTCCACTACGT<br>ACAAGGGCTTCGGCAATCTCAAGCGCCTGCTCTCCTGTATCTGGTTGCGATAGTAA<br>CAACTCATCAATATTGACACCCAGCTTGCTTGCATACGACGGATCAAGCGCATGCT<br>CGGCGTCGATAAAGGCGGCTTGTCCGCCTGTTTTTTGCACCTCTGCGATAGCGTGA<br>AGAGCTACTGTCGTTTTACCGGATGATTCCGGTCCGTATATTTCAATAACCCGGCC<br>(SEQ ID NO: 8) |
| trpB | GTCATTGCTGAAACAGGCGCAGGACAGCATGGTGTCGCGACAGCGACTGTGGCT<br>GCGTTGCTCGGATTGGAATGCAAGGTGTTTATGGGCGAAGAGGATACTGTGCGC<br>CAGCAGCTGAACGTCTTTCGGATGCAGCTTTTGGGTGCAGAGGTCATTCCGGTGA<br>CATCAGGTACACGTACACTTAAGGATGCCGGGAATGAAGCTTTGCGTTACTGGGT<br>CAGCCATGTCCATGATACGTTCTATATTTTGGGTTCAGCTGTCGGCCCGCACCCGT<br>ATCCGATGATGGTGCGGGACTTCCAACGTGTGATTGGTGATGAAACACGTCGCCA<br>GATCCTAGAGAAGGAAGGCAGACTTCCGGATGTCATCGTGGCAGCGATCGGTGG<br>CGGAAGCAATGCCATCGGCATGTTTTATCCTTTTATTGAGGATCAGGGTGTCGCAT<br>TGATTGGCGTGGAGGCCGCTGGAAAAGGTGTCGAAACGGAATTCCATGCAGCTA<br>CGATGACCAAGGGAACACAAGGGGTCTTCCAAGGCTCTATGAGTTATCTGCTTCA<br>GGATGAGTATGGACAAGTGCAACCTGCGCATTCCATCTCGGCTGGATTAGATTAT<br>CCAGGTGTTGGACCGGAGCATTCATACCTGAAAGA (SEQ ID NO: 9) |
| gyrB | AGCTTTGTCTTGGTCTGACCCTCAAACTGTGGTTCTGGAATTTTGACGGAGATAAT<br>CGCCGTCAATCCTTCACGCACATCGTCACCGGTCAAGTTGGCGTTGTTGTCCTTAA<br>TCAAGCCATTTTTACGTGCATAATCGTTAATAATCCGGGTTAATGCACTCTTGAAAC<br>CTGATTCGTGAGTTCCGCCCTCATGGGTGTTGATGTTGTTGGCAAAAGAATAAATA<br>TTCTCGGTATAGCTGTCGTTATATTGCAATGCCACTTCGACTTGAATCATATCACGC<br>GAGCCTTCGACATAAATCGGCTGTTCATGCAGCGCTTCTCTTTTTTGATTCAAAAAT<br>TGCACATATTCACTGATTCCGCCCTCGTAGTGAAATGTATCGCTGGCGCCCGTCCG<br>TTCATCAGTCAAGCTGATTGCAATACCTTTGTTCAGGAAAGCCAACTCACGAATCC<br>GTGTCTGGAGCGTATCATAGTCATATACGGTCGTTTCTGTAAAGATTTGATCGTCA<br>GGATAAAAAGTCGTTTGGGTACCCGTCTCGTCTGTGTCACCGATGACTCTGACATC<br>ATACTGCGGAGCACCACGATGATATTCCTGCTCATACAGATGTCCGTCCCGTTTAA<br>CATGCACGATCATTTTGCTGGAGAGGGCATTTACTACGGATACACCAACCCCGTGC<br>AGACCACCGGATACCTTGTACCCTCCGCCTCCAAATTTACCACCTGCGTGAAGCAC<br>GGTCATAACGACTTCCAGCGCAGATTTTTTCATTTTGGCGTGTTCACTTACTGGAAT<br>ACCGCGACCGTTATCTGTAACGGTAATGCTATTGTCTTCGTGAACGACAACTTGAA<br>TGCTGTCACAGTAACCCGCCAGCGCTTCGTCAATGCTGTTGTCCACAACTTCCCAG<br>ACCAAATGATGGAGACCTTTGGCGCTCGTGGAGCCAATATACATCCCGGGACGTT<br>TCCGAACCGCTTCCAGGCCCTCAAGGACCTGAATCTCGCCCGCATCATAAGACGGT<br>TGATTCATAGACATGCCTTTCACCTACTTCTATAGATTCTATGGTTAAGCATTGGCA<br>ACAAACTGGTTTGCCCGCTTTTTGAGTGTTGTTGAGGAGATGGGGGAATAATACA<br>CCGTATTCTGAGTCACTACGATGGACTTGGCTTCCTCTTCGCCAATCATCTCGACAT<br>GCTTCTGCTGTTGGGCGTGGTTCACGTATTGCTTGGAGATTTTAGAGGATTTTTCA<br>ATCGAGATATCGAAAATAGCCACAAGCTCTGAAGAGCGGATGATTTTTTCTCCACC<br>CAGATGAAT (SEQ ID NO: 10) |

Additional gene sequences for strain 10.6D are depicted in Table 23, below.

TABLE 23 additional gene sequences, strain 10.6D

| Gene | Strain 10.6D sequence |
|---|---|
| recA | GCATTCTCCCGTCCCTGACCAAGGCGCTCACCTTCGTAGGAATACCAGGCTCCGCT CTTGTCGACAATGTCATGCTCCGTACCGATATCGATCAAGCTACCTTCTTTGGAAAT ACCCTCACCGTACATAATATCCACCTCAGCCTGACGGAAAGGAGGGGCAACTTTG TTCTTCACGACTTTAATACGTGTGCGGTTACCCACAATGTCGTTACCCATTTTCAAA CTTTCAATACGACGAACATCCAAACGTACCGTAGAGTAAAACTTCAAGGCACGTCC ACCTGGTGTTGTTTCAGGGTTACCGAACATAACACCTACTTTTTCACGTAGCTGGTT AATAAAAATAGCAATGGTTTTCGACTTATTAATGGCTCCAGAAAGCTTACGCAATG CCTGAGACATCAAACGTGCTTGAAGACCAACGTGGGAATCTCCCATTTCGCCTTCA ATCTCTGCMGGGCACAAGTGCCGCTACGGAGTCAACAACTACAATGTCTACTGC TCCACTACGTACAAGGGCTTCGGCAATCTCAAGCGCCTGCTCTCCTGTATCTGGTT GCGATAGTAACAACTCATCAATATTGACACCCAGCTTGCTTGCATACGACGGATCA AGCGCATGCTCGGCGTCGATAAAGGCGGCTTGTCCGCCTGTTTTTTGCACCTCTGC GATAGCGTGAAGAGCTACTGTCGTTTTACCGGATGATTCCGGTCCGTATATTTCAA TAACCCGGCC (SEQ ID NO: 11) |
| atpD | ATACGGGAGCTTGATGCGAGTGGATCAACCGCCGGGTAAATACCCATTTCGGAAA TTTTACGTTCCAGATTCGTTGTAGCATCCAAATGGGCAAACGTCGTAGCAGGAGCC GGGTCAGTGTAGTCATCCGCAGGCACATAGATCGCCTGAATGGAAGTAACAGAAC CTTTTTTAGTAGAAGTAATCCGTTCTTGCAATTGACCCATCTCAGTAGCCAGCGTA GGCTGGTAACCTACTGCTGAAGGCATACGTCCCAACAGGGCTGAAACCTCAGAAC CCGCTTGAGTAAAGCGGAAAATGTTATCAATAAAGAGCAACACGTCACGGCCTTC TTGGTCACGGAAGTATTCCGCCATCGTCAGACCTGTGAGAGCTACACGCAAACGT GCACCCGGAGGCTCGTTCATTTGTCCGAACACCATCGCTGTTTTGTTGATAACGCC GGAATCTCTCATTTCATGATACAAGTCATTTCCTTCACGTGTGCGTTCACCTACACC CGCAAATACAGAAATACCACCATGCTCCTGAGCGATATTGTTAATCAATTCTTGAA TGGTTACGTTTTACCTACACCAGCACCACCAAACAATCCGACTTTACCACCTTTGG CATAAGGAGCTAGCAAGTCGATAACTTTAATACCTGTTTCGAGCATCTCTGCTTGA GTTGTCAGCTCATCGAAAGAAGGAGCTTGACGGTGAATCGG (SEQ ID NO: 12) |
| trpB | GTCATTGCTGAAACAGGCGCAGGACAGCATGGTGTCGCGACAGCGACTGTGGCT GCGTTGCTCGGATTGGAATGCAAGGTGTTTATGGGCGAAGAGGATACTGTGCGC CAGCAGCTGAACGTCTTTCGGATGCAGCTTTTGGGTGCAGAGGTCATTCCGGTGA CATCAGGTACACGTACACTTAAGGATGCAGGGAATGAAGCTTTGCGTTACTGGGT CAGCCATGTCCATGATACGTTCTATATTTTGGGTTCAGCTGTCGGCCCACATCCGT ATCCGATGATGGTGCGGGACTTCCAACGCGTGATTGGTGATGAAACACGTCGCCA GATCCTAGAGAAGGAAGGCAGACTTCCGGATGTCATCGTGGCAGCGATCGGTGG CGGAAGCAATGCCATCGGAATGTTTTATCCTTTTATTGAGGATCAGGGTGTCGCAT TGATTGGCGTGGAGGCCGCTGGAAAAGGTGTCGAAACGGAATTCCATGCAGCTA CGATGACCAAGGGAACACAAGGGGTCTTCCAAGGCTCTATGAGTTATCTGCTTCA GGATGAGTACGGACAAGTGCAACCTGCGCATTCCATCTCGGCTGGATTAGATTAT CCAGGTGTTGGACCGGAGCATTCATACCTGAAAGA (SEQ ID NO: 13) |
| GyrB | AAGTTGGCGTTGTTGTCCTTAATCAAGCCATTTTTACGTGCATAATCGTTAATAATC CGGGTTAATGCACTCTTGAAACCTGATTCGTGAGTTCCGCCCTCATGGGTGTTGAT GTTGTTGGCAAAAGAATAAATATTCTCGGTATAGCTGTCGTTATATTGCAATGCCA CTTCGACTTGAATCATATCACGCGAGCCTTCGACATAAATCGGCTGTTCATGCAGC GCTTCTCTTTTTTGATTCAAAAATTGCACATATTCACTGATTCCGCCCTCGTAGTGA AATGTATCGCTGGCGCCCGTCCGTTCATCAGTCAAGCTGATTGCAATACCTTTGTT CAGGAAAGCCAACTCACGAATCCGTGTCTGGAGCGTATCATAGTCATATACGGTC GTTTCTGTAAAGATTTGATCGTCAGGATAAAAAGTCGTTTGGGTACCCGTCTCGTC TGTGTCACCGATGACTCTGACATCATACTGCGGAGCACCACGATGATATTCCTGCT CATACAGATGTCCGTCCCGTTTAACATGCACGATCATTTTGCTGGAGAGGGCATTT ACTACGGATACACCAACCCCGTGCAGACCACCGGATACCTTGTACCCTCCGCCTCC AAATTTACCACCTGCGTGAAGCACGGTCATAACGACTTCCAGCGCAGATTTTTCA TTTTGGCGTGTTCACTTACTGGAATACCGCGACCGTTATCTGTAACGGTAATGCTA TTGTCTTCGTGAACGACAACTTGAATGCTGTCACAGTAACCCGCCAGCGCTTCGTC AATGCTGTTGTCCACAACTTCCCAGACCAAATGATGGAGACCTTTGGCGCTCGTGG AGCCAATATACATCCCGGGACGTTTCCGAACCGCTTCCAGGCCCTCAAGGACCTG AATCTCGCCCGCATCATAAGACGGTTGATTCATAGACATGCCTTTCACCTACTTCTA TAGATTCTATGGTTAAGCATTGGCAACAAACTGGTTTGCCCGCTTTTTGAGTGTTG TTGAGGAGATGGGGAATAATACACCGTATTCTGAGTCACTACGATGACTTGGC TTCCTCTTCGCCAATCATCTCGACATGCTTCTGCTGTTGGGCGTGGTTCACGTATTG CTTGGAGATTTTAGAGGATTTTCAATCGAGATATCGAAAATAGCCACAAGCTCTG AAGAGCGGATGATTTTTTCTCCACCCAGATG (SEQ ID NO: 14) |

Phylogenetic trees were generated as described above, using 16S, atpD, gyrB, recA, and trpB genes.

FIG. 1 depicts a phylogenetic tree visualizing the phylogenetic relationship between strain 9.4E, strain 10.6D, and other *Paenibacillus* strains.

Figure 2:
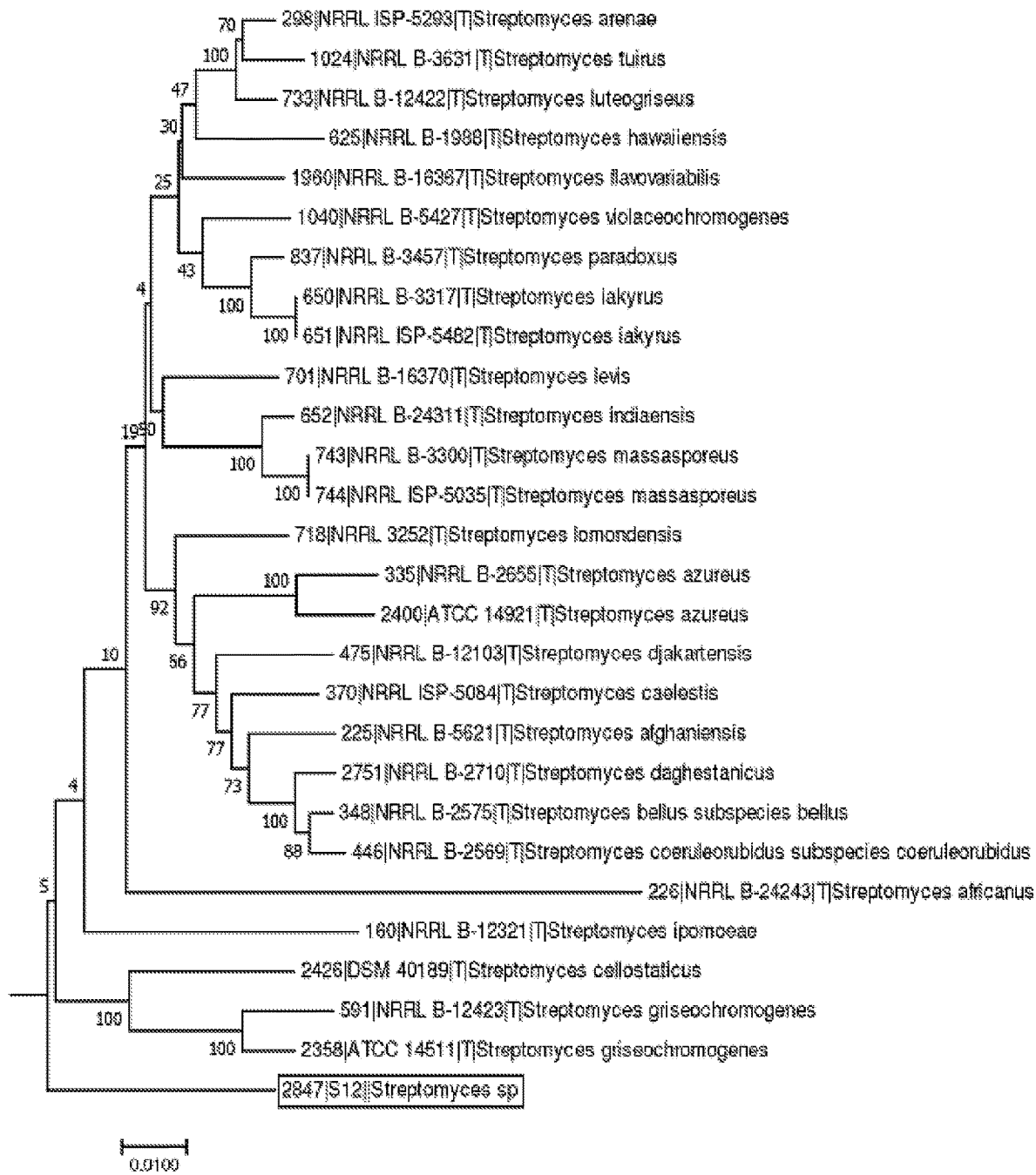
FIG. 2 depicts a phylogenetic tree visualizing the phylogenetic relationship between strain HCA1273 (S12), and other *Streptomyces* strains.

FIG. 2 depicts a phylogenetic tree visualizing the phylogenetic relationship between strain HCA1273, and other *Streptomyces* strains.

Figure 3:
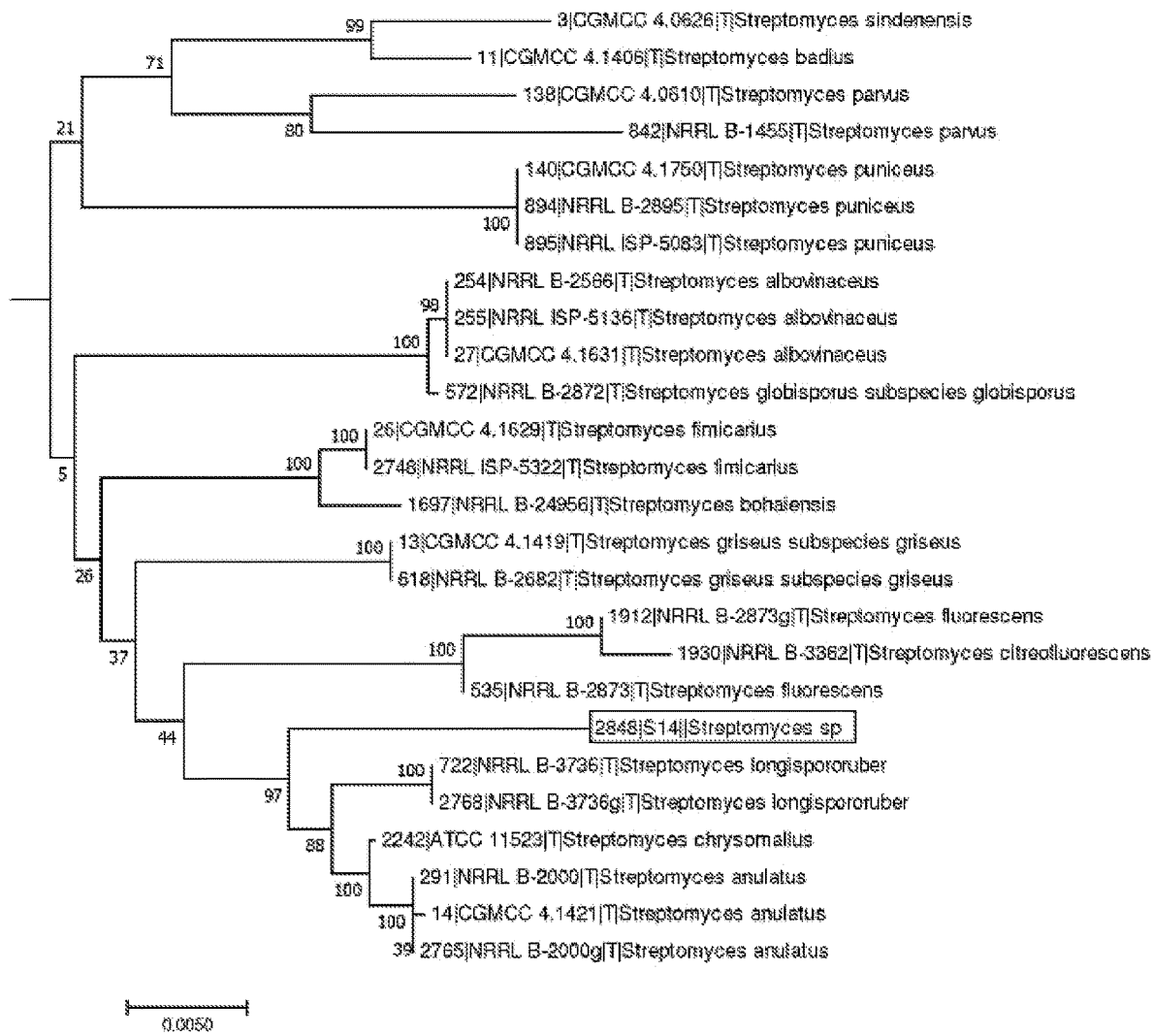
FIG. 3 depicts a phylogenetic tree visualizing the phylogenetic relationship between strain BD141 (S14), and other *Streptomyces* strains.

FIG. 3 depicts a phylogenetic tree visualizing the phylogenetic relationship between strain BD141, and other *Streptomyces* strains.

A comparison of the 16S, atpD, gyrB, recA, and trpB genes between P9 and P10 strains confirm that the isolates are distinct isolates but are closely related. For example, while sequences for 16S and gyrB are completely similar, recA sequences have 2 SNPs between P9 and P10, trpB sequences have 6 SNPs between P9 and P10, and atpD sequences have 4 SNPs between P9 and P10.

EXAMPLE 3

Screening for *Rhizoctonia* Control

All bioassays were conducted in a controlled envi9ronment room at 15° C., 12 hr day/night cycle. Wheat cv. Yitpi was used for all assays. For each assay there were three control treatments, (1) no-pathogen control (2) pathogen only control and (3) positive control of current best biocontrol strain, either *Trichoderma* strain TB or *Streptomyces* strain EN16. Bioassays were conducted in soils collected from fields with continuing *Rhizoctonia* problems. Soils were from Netherton SA (grey siliceous sand) or Waikerie SA (Red calcareous sand).

Primary Tube *Rhizoctonia* Bioassay

This assay consisted of 50 ml tube with 60 g Netherton soil at 8% moisture content with two *Rhizoctonia solani* infested millet seeds added and incubated 2 weeks at 15° C. Two pregerminated wheat seeds were planted and microbial inoculum added as suspension (150 ul) directly onto the seeds and incubated for 2 wks. Plants were assessed by shoot height and number of roots reaching the bottom of the tube. Two replicates were used per treatment. Results are shown in Table 4.

TABLE 4

Primary Rhizoctonia assay results of 10.6D and HCA1273, n = 2.

| Strain | Treatment | Mean shoot height (cm) | Mean number of roots to bottom of tube |
|---|---|---|---|
| 10.6D | Control | 12.75 | 9 |
|  | Disease control | 7.5 | 0 |
|  | 10.6D | 9.5 | 0.5 |
| HCA1273 | Control | 8.75 | 4 |
|  | Disease control | 6.75 | 0 |
|  | HCA1273 | 8.75 | 0.5 |

Secondary *Rhizoctonia* Pot Bioassay

To confirm efficacy, strains were assessed in a pot bioassay containing 300 g Waikerie soil at 8% moisture. Six *Rhizoctonia solani* infested millet seeds were added to the soil and incubated 2 weeks at 15° C. For seed inoculation, microbes were harvested from agar plates, diluted to absorbance of 0.5 at 550 nm in 3 ml dilute sticker solution (0.005% Na Alginate, 0.03% xantham gum) and 1.5 g wheat seed added and soaked for 1 hr. The microbial suspension was drained and 7 seeds planted and later thinned to 5 after germination. Inoculum concentration was determined by dilution plate counts. Plants were grown for 4 wks. Plants were assessed for root disease as Percentage of Roots Infected (% RI) and on a Root Disease Score (RDS) on a 0-5 scale (0=no disease, 5=max disease). The length of seminal and nodal roots were measured and dry weights of roots and shoots obtained after drying at 60° C. for 4 days. There were 4 replicates in a randomised complete block design. Data was analysed as ANOVA, RCBD. Results are shown in Tables 5 and 6.

TABLE 5

Results of secondary assay for strain 10.6D. Inoculum suspension 10.6D, 2.0 × 10⁶ cfu/ml.

| Treatment | Shoot DW mg/pot | Root DW mg/pot | % RI | Total Root Length (cm) | Length seminal roots (cm) | Length nodal roots (cm) | Root Disease Score (0-5) |
|---|---|---|---|---|---|---|---|
| No pathogen control | 381* | 364* | 18* | 59* | 45* | 13.5 | 0.8* |
| Pathogen only control | 316 | 211 | 82 | 35 | 28 | 7.1 | 3.1 |
| TB | 311 | 270 | 73 | 40 | 29 | 11.8 | 2.1* |
| 10.6D | 313 | 301* | 72 | 43 | 30 | 13.1 | 2.4* |
| Fprob | 0.006 | 0.020 | <0.001 | 0.003 | <0.001 | 0.351 | <0.001 |
| LSD(0.05) | 39.8 | 87.6 | 12.6 | 9.9 | 5.6 | ns | 0.70 |

*= significantly different from pathogen only control at P = 0.05

TABLE 6

Results of secondary assay for strain HCA1273. Inoculum suspension $6.0 \times 10^8$ cfu/ml. Treatment

| | Shoot DW mg/pot | Root DW mg/pot | % RI | Total Root Length (cm) | Length seminal roots (cm) | Length nodal roots (cm) | Root Disease Score (0-5) |
|---|---|---|---|---|---|---|---|
| No pathogen control | 165 | 155* | 64* | 41* | 39* | 2.2 | 0.2* |
| Pathogen only control | 169 | 107 | 86 | 24 | 23 | 1.7 | 2.6 |
| EN16 | 166 | 117 | 83 | 28 | 25 | 2.4 | 2.2 |
| HCA 1273 | 161 | 136 | 80 | 30 | 28 | 3.0 | 1.5* |
| Fprob | 0.846 | 0.022 | 0.001 | 0.004 | 0.002 | 0.163 | 0.003 |
| LSD(0.05) | ns | 30.8 | 9.3 | 8.1 | 7.0 | ns | 0.98 |

*= significantly different from pathogen only control at P = 0.05

Tertiary *Rhizoctonia* Pot Bioassay

A tertiary assay was conducted on selected strains based on results of the secondary assay. The tertiary pot bioassay was conducted the same as for the secondary *Rhizoctonia* pot assay except that microbes were inoculated at 3 rates to indicate the most appropriate inoculation level. Seed cfu levels were measured on seeds at the highest inoculation rate by extracting cells from 5 seeds in 1 ml phosphate buffered saline (PBS) after shaking for 30 minutes, serially diluting the suspension and plating onto agar. Seed cfu levels at the lower rates were estimated from the highest rate. Results are shown in Tables 7 and 8.

TABLE 7

Results of tertiary assay for strain 10.6D.

| Treatment | Inoculum (cfu/seed) | Shoot DW mg/pot | Root DW mg/pot | % RI | Total Root Length (cm) | Length seminal roots (cm) | Length nodal roots (cm) | Root Disease Score (0-5) |
|---|---|---|---|---|---|---|---|---|
| No pathogen control | | 330* | 268* | 11* | 61* | 45* | 15.8 | 0.6* |
| Pathogen only control | | 135 | 63 | 100 | 11 | 6 | 4.8 | 4.2 |
| TB | $2.0 \times 10^4$ | 191* | 80 | 100 | 13 | 9 | 3.7 | 4.1 |
| 10.6D | $3.3 \times 10^4$ | 210* | 100 | 93 | 22* | 16* | 6.1 | 3.1* |
| 10.6D | $6.7 \times 10^4$ | 146 | 72 | 93 | 14 | 9 | 5.2 | 4.6 |
| 10.6D | $1.3 \times 10^5$ | 157 | 93 | 90 | 22* | 14* | 8.2 | 3.4* |
| Fprob | | 0.006 | 0.020 | <0.001 | 0.003 | <0.001 | 0.351 | <0.001 |
| LSD(0.05) | | 39.8 | 87.6 | 12.6 | 9.9 | 5.6 | ns | 0.70 |

*= significantly different from pathogen only control at P = 0.05

TABLE 8

Results of tertiary assay for strain HCA1273.

| Treatment | Inoculum (cfu/seed) | Shoot DW mg/pot | Root DW mg/pot | % RI | Total Root Length (cm) | Length seminal roots (cm) | Length nodal roots (cm) | Root Disease Score (0-5) |
|---|---|---|---|---|---|---|---|---|
| No pathogen control | | 258.2 | 155.5 | 69 | 35.1 | 16 | 1.7 | 0.5 |
| Pathogen only control | | 173.5 | 82.5 | 89 | 17.7 | 30.15 | 5 | 3.2 |
| EN16 | $1.5 \times 10^6$ | 205.2 | 108.2 | 85 | 19 | 17.75 | 1.25 | 2.3 |
| HCA1273 | $5.9 \times 10^4$ | 198.2 | 114.2 | 78.5 | 28.8 | 23.9 | 4.9 | 1.85 |
| HCA1273 | $3.0 \times 10^5$ | 192 | 99 | 84 | 23.4 | 21.88 | 1.5 | 2.58 |
| HCA1273 | $3.0 \times 10^6$ | 185 | 106.2 | 82 | 21.3 | 19.75 | 1.55 | 2.35 |
| Fprob | | 0.144 | 0.453 | 0.387 | 0.660 | 0.564 | 0.750 | 0.200 |
| LSD(0.05) | | ns | ns | ns | ns | ns | ns | ns |

*= significantly different from pathogen only control at P = 0.05

*Rhizoctonia* Field Trials: Microplots

All *Rhizoctonia* field trials were carried out in fields used for commercial cereal production in South Australia with a continuing *Rhizoctonia* problem, with natural levels of *Rhizoctonia solani* AG8 DNA>100 pg/g soil (as measured by SARDI Root Disease Testing Service).

Selected strains were first assessed in the field in 1 m long single row microplots in 2012 and 2013. Wheat cv. Grenade seeds were coated with microbes as a concentrated suspension in a sticker solution (0.3% xanthan gum, 0.05% Na alginate). Seeds were hand planted at 4 cm spacing using a seeding template. Microplot trials were a split plot design, with each treated row paired with an untreated row in a randomised complete block design, 6 replicates. *Rhizoctonia* root rot is a patchy disease, so a split-plot design with paired treated and untreated rows was used to measure disease in the same disease space. Plants (10) were harvested at 8 wks and assessed for root disease score (0-5 scale) caused by *Rhizoctonia* on seminal and nodal roots and for dry weights of roots and shoots. Each strain was assessed at 2 sites. In 2013, Chemical seed treatments (Vibrance, Syngenta; Ever-Gol Prime, Bayer) and *Streptomyces* strain EN16 were included for comparison. Results are shown in Tables 9 and 10.

TABLE 9

Combined results for 2012 microplot trials at Karoonda (SA, Mallee) and Port Julia (SA, Yorke Peninsula) at 8 wks, n = 12. Seed inoculation, 10.6D 4.3 × 10$^5$ cfu/seed.

| | | |
|---|---|---|
| Shoot DW (mg/plant) | Treated | 272 |
| | Un-treated | 244 |
| | % change from untreated[1] | 11 |
| Root DW (mg/plant) | Treated | 55 |
| | Un-treated | 52 |
| | % change from untreated | 6 |
| Nodal Root Disease Score (0-5) | Treated | 1.5** |
| | Un-treated | 2 |
| | % change from untreated | −23 |
| Seminal Root Disease Score (0-5) | Treated | 0.9* |
| | Un-treated | 1.2 |
| | % change from untreated | −23 |

*significantly different from un-treated control at P = 0.05
**significantly different from un-treated control at P = 0.01
[1]percent change of treated rows from untreated rows

TABLE 10

Combined results for 2013 microplot trials at Wynarka (SA, Mallee) and Lamaroo (SA, Mallee) at 8 wks, n = 12. Seed inoculation, HCA1273 2.4 × 10$^5$ cfu/seed; EN16 2.4 × 10$^4$ cfu/seed.

| | | HCA1273 | EN16 | EverGol Prime | Vibrance |
|---|---|---|---|---|---|
| Shoot DW (mg/plant) | Treated | 880* | 876 | 829 | 854 |
| | Un-treated | 725 | 793 | 793 | 747 |
| | % change from untreated[1] | 21 | 10 | 5 | 14 |
| Root DW (mg/plant) | Treated | 120* | 123 | 126 | 124* |
| | Un-treated | 101 | 105 | 114 | 105 |
| | % change from untreated | 18 | 17 | 11 | 18 |
| Nodal Root Disease Score (0-5) | Treated | 2.7* | 2.3* | 2.1 | 2.2 |
| | Un-treated | 3.1 | 2.8 | 2.3 | 2.4 |
| | % change from untreated | −23 | −18 | −8 | −6 |
| Nodal Root Disease Score (0-5) | Treated | 1.4* | 1.2* | 1.3 | 1.3 |
| | Un-treated | 1.9 | 1.8 | 1.4 | 1.3 |
| | % change from untreated | −27 | −34 | −8 | 0 |

*significantly different from un-treated control at P= 0.05
[1]percent change of treated rows from untreated rows

*Rhizoctonia* Field Trials: 20 m 3+3 Row Plots

Strains selected from microplot trials and characterisation were assessed as seed coatings in larger field trials in 2013 and 2014 with 20 m plots, six replicates. Three rows of each plot were treated and three rows untreated in a split-plot randomised complete block design to allow comparison in the same disease space due to the patchy nature of *Rhizoctonia* root rot. Wheat cv. Grenade seeds were coated with microbes as a concentrated suspension in a sticker solution (0.3% xanthan gum, 0.05% Na alginate). Seeds were planted with a plot scale seeder and herbicide and fertilisers applied as per local best practice. Plants (21) from each split-plot were assessed at 8 wks (2013) or 11 wks (2014) and assessed for root disease score (0-5 scale) caused by *Rhizoctonia* on seminal and nodal roots and for dry weights of roots and shoots. Seeds were harvested at the end of season with a plot scale header. In 2014, *Streptomyces* strain EN16 and an in-furrow chemical treatment, Uniform (Syngenta) were included as controls. Results are shown in Table 11.

TABLE 11

Results for 2013 and 2014 3 + 3 row 20 m plots field trials at Wynarka (SA, Mallee) and Lameroo (SA, Mallee) in 2013 and at Lameroo (SA, Mallee) in 2014 at 8 wks and yield, n = 6. Percent change (% change) = [(Microbe treated/untreated) × 100] − 100

| | | 2013 Lameroo | 2013 Wynarka | 2014 Lameroo | | | |
|---|---|---|---|---|---|---|---|
| | | 10.6D (9.6 × 10$^4$) | 10.6D (1.1 × 10$^5$) | 10.6D 4.8 × 10$^4$ | HCA1273 4.2 × 10$^4$ | EN16 4.5 × 10$^5$ | Uniform |
| Shoot DW (mg/plant) | Treated | 455 | 242 | 719 | 847 | 765 | 730 |
| | Un-Treated | 431 | 213 | 751 | 746 | 652 | 747 |
| | % change from untreated[1] | 6 | 13 | −4 | 14 | 17 | −2 |
| Root DW (mg/plant) | Treated | 52 | 39 | 94 | 105 | 100 | 104 |
| | Un-Treated | 51 | 35 | 102 | 97 | 92 | 96 |
| | % change from untreated | 2 | 12 | −8 | 8 | 9 | 9 |
| Nodal Root Disease Score (0-5) | Treated | 2.1 | 2.4 | 2.1* | 2.5* | 1.9* | 1.7* |
| | Un-Treated | 1.8 | 2.7 | 2.6 | 3.2 | 2.4 | 2.2 |
| | % change from untreated | 14 | −9 | −20 | −23 | −21 | −21 |

TABLE 11-continued

Results for 2013 and 2014 3 + 3 row 20 m plots field trials at Wynarka (SA, Mallee) and Lameroo (SA, Mallee) in 2013 and at Lameroo (SA, Mallee) in 2014 at 8 wks and yield, n = 6. Percent change (% change) = [(Microbe treated/untreated) × 100] − 100

|  |  | 2013 Lameroo | 2013 Wynarka | 2014 Lameroo | | | |
|---|---|---|---|---|---|---|---|
|  |  | 10.6D ($9.6 \times 10^4$) | 10.6D ($1.1 \times 10^5$) | 10.6D $4.8 \times 10^4$ | HCA1273 $4.2 \times 10^4$ | EN16 $4.5 \times 10^5$ | Uniform |
| Seminal Root Disease Score (0-5) | Treated | 1.0* | 1.2 | 2.1* | 1.9* | 2 | 1.4* |
|  | Un-Treated | 1.4 | 1.3 | 2.5 | 2.8 | 2.4 | 2.2 |
|  | % change from untreated | −27 | −12 | −17 | −32 | −15 | −35 |
| Yield (t/ha) | Treated | 2.86 | 2.23 | 2.68* | 2.6 | 2.63 | 2.56* |
|  | Un-Treated | 2.75 | 2.14 | 2.57 | 2.52 | 2.56 | 2.49 |
|  | % change from untreated | 4.1 | 3.8 | 4.2 | 2.8 | 2.5 | 3 |

*significantly different from un-treated control at P = 0.05
[1]percent change of treated rows from untreated rows

EXAMPLE 4

Screening for *Pythium* Control on Wheat

Primary *Pythium* Tube Bioassay

The primary *Pythium* tube assay was set up as for the *Rhizoctonia* tube assay with 60 g washed sand at 11% moisture with 3 g/L Miracle Gro soluble fertiliser. *Pythium irregulare* strain 89 was added as one 11 mm agar plug, with no pre-incubation prior to seeding with two pre-germinated wheat cv. Yitpi seeds. For seed inoculation, microbes were harvested from agar plates, diluted to absorbance of 0.8 at 550 nm in a dilute sticker solution (0.005% Na alginate, 0.03% xanthan gum) and 150 ul added directly to seeds. Plants were assessed by shoot height and number of roots reaching the bottom of the tube. Two replicates per treatment. Results are shown in Table 12.

TABLE 12

Primary Pythium assay results of 9.4E, and BD141, n = 2

| Assay-strain | Treatment | Mean shoot height (cm) | Mean number of roots to bottom of tube |
|---|---|---|---|
| 9.4E | Control | 20.5 | 6 |
|  | Disease control | 13.5 | 1 |
|  | 9.4E | 17.5 | 3 |
| BD141 | Control | 8.0 | 6 |
|  | Disease control | 5.3 | 0.5 |
|  | BD141 | 7.75 | 2 |

Secondary *Pythium* Pot Bioassay

Washed sand (200 g/pot) at 11% moisture with 1.5 g/L Miracle Grow fertiliser was used. Pathogen was added as 3x8 mm agar plugs of *Pythium irregulare* strain 89. Wheat cv. Yitpi seeds (2.2) were inoculated with a microbial suspension diluted to absorbance of 0.8 at 550 nm in 3 ml dilute sticker solution (0.005% Na Alginate, 0.03% xanthan gum) and soaked for 1 hr prior to planting. Microbial suspension was drained and 7 seeds sown and thinned to 5 after 14 days. Plants were grown for 4 weeks and assessed for root disease on a 0-5 scale and for dry weight of shoots and roots. Results are shown in Tables 13 and 14.

TABLE 13

Results of secondary assay for strain 9.4E.

| Treatment | Inoculum (cfu/seed) | No. plants emerged (7 d) | Shoot DW mg/plant | Root DW mg/plant | Root Disease Score (0-5) |
|---|---|---|---|---|---|
| No pathogen control |  | 5.8* | 35* | 26* | 0.4* |
| Pathogen only control |  | 3.8 | 27 | 21 | 2.7 |
| EN27 | $3.5 \times 10^5$ | 3.5 | 25 | 19 | 2.0 |
| 9.4E | $1.7 \times 10^5$ | 3.3 | 24 | 10 | 1.4* |
| Fprob |  | 0.004 | 0.002 | 0.003 | <0.001 |
| LSD (0.05) |  | 2.01 | 4.9 | 3.9 | 0.95 |

*significantly different from pathogen only control at P = 0.05

TABLE 14

Results of secondary assay for strain BD141.

| Treatment | Inoculum (cfu/seed) | No. plants emerged (6 d) | Shoot DW mg/plant | Root DW mg/plant | Root Disease Score (0-5) |
|---|---|---|---|---|---|
| No pathogen control |  | 6.8* | 35 | 26 | 0.2* |
| Pathogen only control |  | 2.3 | 32 | 17 | 2.3 |
| EN27 | $3.5 \times 10^6$ | 3.5 | 29 | 19 | 1.8 |
| BD141 | $5.3 \times 10^5$ | 4.0* | 35 | 22 | 1.3* |
| Fprob |  | 0.020 | 0.581 | 0.795 | 0.006 |
| LSD(0.05) |  | 1.43 | ns | 12.6 | 0.74 |

*significantly different from pathogen only control at P = 0.05

Tertiary *Pythium* Tub Bioassay

An emergence assay in 100 ml tubs with 140 g Waikerie sand at 13% moisture was used to assess pre and post emergence damping off control. Twenty wheat cv. Yitpi seeds were planted, and covered with 1 g *Pythium irregulare* strain 89 sand-polenta inoculum. Plants were grown for 14 d at 15° C., 12 hr day/night cycle, 4 replicates in randomised complete block design. EN27 was included as a positive control. The number of plants emerged was counted at 7, 11, and 14 days after planting. A chemical control (Dividend, difanconazole and metalaxyl) for *Pythium* was included in the assay with 9.4E assay. Results are shown in Tables 15 and 16.

TABLE 15

Results of secondary assay for strain 9.4E.

| Treatment | Inoculum (cfu/seed) | No. plants Emerged (7 d) | No. plants Emerged (11 d) |
|---|---|---|---|
| No pathogen control | | 12.8* | 18.8* |
| Pathogen only control | | 2.5 | 7.3 |
| Dividend | | 8.0* | 14.5* |
| EN27 | $2.3 \times 10^6$ | 4.8 | 10.5* |
| 9.4E | $8.9 \times 10^4$ | 4.5 | 8.0 |
| 9.4E | $1.8 \times 10^5$ | 4.0 | 7.0 |
| 9.4E | $3.5 \times 10^5$ | 7.5* | 12.3* |
| Fprob | | <0.001 | <0.001 |
| LED(0.05) | | 3.1 | 3.1 |

*significantly different from pathogen only control at P = 0.05

TABLE 16

Results of secondary assay for strain BD141.

| Treatment | Inoculum (cfu/seed) | No. plants Emerged (7 d) | No. plants Emerged (11 d) | No. plants Emerged (14 d) |
|---|---|---|---|---|
| No pathogen control | | 6.5 | 18.3* | 18.3* |
| Pathogen only control | | 0.5 | 8.5 | 10.0 |
| EN27 | $7.1 \times 10^5$ | 3.0 | 13.3* | 14.5* |
| BD141 | $1.9 \times 10^5$ | 3.0 | 12.8* | 13.5* |
| BD141 | $3.8 \times 10^5$ | 2.3 | 11.8* | 12.3 |
| BD141 | $7.7 \times 10^5$ | 2.5 | 13.0* | 14.5* |
| Fprob | | 0.096 | <0.001 | <0.001 |
| LSD(0.05) | | ns | 3.2 | 3.0 |

*significantly different from pathogen only control at P = 0.05

*Pythium* Field Trials

All *Pythium* field trials were carried out in fields used for commercial cereal production in South Australia with a continuing *Pythium* problem, with natural levels of *Pythium* group F DNA>100 pg/g soil (as measured by SARDI Root Disease Testing Service).

Seed coated microbes were assessed at two *Pythium* infested sited in 2015 and 2016 (Table 17). Plant establishment was increased in both years with microbial inoculation compared to controls, but this was only significantly different at the Conmurra sites. Significant yield responses of 4.6 to 6.3% increase were evident in 2015 at Turretfield with non-significant increases at Conmurra. Yield responses in 2016 were probably masked by nearly double the rainfall compared to 2015. Significant reductions in root disease were evident at Turretfield in 2015 and Conmurra in 2016.

TABLE 17

Results from control of Pythium root rot on wheat field trials. Data is the mean plants/m at 3-4 wks, shoot dry weight (DW) mg per plant and seminal root disease score (DS, 0-5) at eight weeks and final grain yield, six replicates. Control treatment contains no fungicide or microbial inoculation. Microbes were applied as seed coatings. % increase in yield is relative to untreated Control.

| Site Year Treatment | Establishment plants/m | Shoot DW mg/plant | Seminal root DS (0-5) | Yield t/ha | % increase in yield |
|---|---|---|---|---|---|
| Turretfield 2015 | | | | | |
| Control | 36 | 892 | 3.1 | 2.51 | 0 |
| Apron | 38 | 872 | 2.7 | 2.49 | −1.00 |
| *Paenibacillus* 9.4E | 37 | 960 | 2.4* | 2.63* | 4.63 |
| *Streptomyces* BD141 | 39 | 870 | 2.8 | 2.67* | 6.27 |
| *Streptomyces* EN27 | 37 | 953 | 2.6* | 2.51 | 0.06 |
| Conmurra 2015 | | | | | |
| Control | 24 | 655 | 2.6 | 4.13 | 0 |
| Apron | 27 | 628 | 2.6 | 4.24 | 2.48 |
| *Paenibacillus* 9.4E | 30* | 603 | 2.6 | 4.31 | 4.39 |
| *Streptomyces* BD141 | 29* | 579 | 2.6 | 4.01 | −2.95 |
| *Streptomyces* EN27 | 28* | 638 | 2.7 | 3.97 | −3.89 |
| Turretfield 2016 | | | | | |
| Control | 37 | 2161 | 2.9 | 4.93 | |
| Apron | 40 | 2476 | 2.8 | 5.08 | 3.0 |
| *Paenibacillus* 9.4E | 39 | 2081 | 2.7 | 4.94 | 0.1 |
| *Streptomyces* BD141 | 37 | 2359 | 2.6 | 5.17 | 4.9 |
| *Paenibacillus* 10.6D | 39 | 2181 | 2.9 | 4.86 | −1.4 |
| *Streptomyces* HCA1273 | 39 | 2200 | 2.6 | 4.75 | −3.7 |
| *Streptomyces* EN27 | 40 | 2220 | 2.7 | 4.77 | −3.3 |

TABLE 17-continued

Results from control of Pythium root rot on wheat field trials.
Data is the mean plants/m at 3-4 wks, shoot dry weight (DW) mg
per plant and seminal root disease score (DS, 0-5) at eight weeks and
final grain yield, six replicates. Control treatment contains no fungicide
or microbial inoculation. Microbes were applied as seed coatings.
% increase in yield is relative to untreated Control.

| Site Year Treatment | Establishment plants/m | Shoot DW mg/plant | Seminal root DS (0-5) | Yield t/ha | % increase in yield |
|---|---|---|---|---|---|
| Conmurra 2016 | | | | | |
| Control | 22 | 688 | 1.8 | 4.16 | 0 |
| Apron | 29* | 582 | 1.5 | 4.17 | 0.4 |
| *Paenibacillus* 9.4E | 32* | 641 | 1.3* | 4.07 | −2.1 |
| *Streptomyces* BD141 | 30* | 616 | 1.5* | 4.12 | -0.9 |
| *Paenibacillus* 10.6D | 30* | 641 | 1.4* | 4.04 | −2.8 |
| *Streptomyces* HCA1273 | 31* | 647 | 1.3* | 4.20 | 1.1 |
| *Streptomyces* EN27 | 22* | 688 | 1.8 | 4.16 | 0 |

*Treatment significantly different from untreated control at P = 0.05 by Fisher's LSD

EXAMPLE 5

Microbial Inoculum Survival on Wheat Seeds

Microbial survival on seeds was assessed on 20 g seed lots (wheat cv. Yitpi) after inoculation and at 1, 2 and 7 days. Concentrated microbial suspensions were made in a sticker solution (0.3% xanthan gum, 0.05% Na alginate) at various concentrations depending on results of tertiary assays and 626 ul added to each 20 g seed lot and mixed until even coverage of seeds. To assess seed colony forming units (cfu), 5 seeds were placed in 1.5 ml tubes, 1 ml phosphate buffered saline added, vortexed 15 sec and shaken for 15 min on orbital shaker at maximum speed. The suspension was sampled, serially diluted, plated onto agar media and cfu/seed calculated. There were two replicates for strains 10.6D and HCA1273, three replicates for 9.4E and BD141 at each time point. Percent survival was calculated based on initial population at t=0. Results are shown in Table 18.

TABLE 18

Log10 cfu/seed and percent survival on seeds at t = 0, 1, 2, and 7 days after
inoculation. Values mean of two (10.6D, HCA1273) or three (9.4E, BD141) replicates.

| Strain | t = 0 Log10 (cfu/seed) | t = 1d Log10 (cfu/seed) | t = 2d Log10 (cfu/seed) | t = 7d Log10 (cfu/seed) | % survival t = 1d | % survival t = 2d | % survival t = 7d |
|---|---|---|---|---|---|---|---|
| 10.6D | 4.50 | 4.56 | 4.30 | 4.32 | 116 | 63 | 65 |
| HCA1273 | 3.54 | 3.64 | 3.42 | 3.71 | 124 | 75 | 148 |
| 9.4E | 5.46 | 5.66 | 5.61 | 5.70 | 161 | 142 | 173 |
| BD141 | 5.75 | 5.80 | 5.90 | 5.91 | 112 | 141 | 145 |

EXAMPLE 6

In Vitro Inhibition of Fungal Pathogens

Strains identified for *Rhizoctonia* control were assessed for in vitro inhibition of four fungal pathogens, R. solani AG8 strain W19, *Pythium irregulare* strain 89 isolated from lucerne roots, *Gaeumannomyces graminis* var. *tritici* (Ggt) strain C3 isolated from wheat roots and *Fusarium pseudograminearum* strain B4a isolated from wheat crowns. Fungi were grown on PDA/4 for between 2 and 7 d depending on strain prior to use. Test fungal pathogens were added to the centre of 9 cm agar plates as 8 mm agar and test strains added as 2×20 μl spots ($10^7$ cfu/ml) on opposite sides of the plate 30 mm from the centre. Inhibition zones were recorded at 2 d for *P. irregulare*, 4 d for *R. solani* and 7 d for Ggt and *F. pseudograminearum*. There were three replicate plates for each pathogen-test strain combination in a randomised complete block design. Results are shown in Table 19.

TABLE 19

In vitro inhibition of root pathogens *Rhizoctonia solani* AG8, *Fusarium pseudograminearum*, *Pythium irregulare* and *Gaeumannomyces graminis tritici* (Ggt) by strains isolated for *Rhizoctonia* control. Response of fungal pathogen to test strains are given as: —— no sign of inhibition; + hyphal avoidance but no clear zone of inhibition; ++ inhibition zone 1-2 mm; +++ inhibition zone > 3 mm.

| Strain | Rhizoctonia solani | Fusarium pseudo-graminearum | Pythium irregulare | Ggt |
|---|---|---|---|---|
| 10.6D | +++ | +++ | +++ | ++ |
| 9.4E | +++ | +++ | +++ | ++ |
| 8D141 | + | — | — | ++ |
| HCA1273 | +++ | +++ | — | +++ |

EXAMPLE 7

Seed Dressing Compatibility

Compatibility of strains with a subset of common seed dressings was assessed by adding the seed dressings at 8 times the recommended application rate per seed to a 5 mm antibiotic disk and applying the disk to a lawn of bacteria ($10^5$ cfu/plate) on an agar plate. Zones of inhibition were measured after 3 days. Results are shown in Table 20. Where a zone of inhibition of greater than 4 mm was observed, this was indicative of an inhibitory effect on the growth of the inoculant.

TABLE 20

Inhibition of strains identified for *Rhizoctonia* control by common seed dressings. Data shows size of inhibition zones in mm surrounding the seed dressing soaked disk in the bacterial lawn, n = 3.

| Seed dressing (manufacturer) | 10.6D | HCA 1273 | EN16 | EN27 |
|---|---|---|---|---|
| Vitaflo C (Chemtura) | 0 | 0 | 0 | 0 |
| Rancona dimension (Chemtura) | 2-8 | 2 | 7 | 12 |
| Proleaf T (Chemtura) | 0 | 0 | 0 | 0 |
| Rancona C (Chemtura) | 0-4 | 2 | 7 | 10 |
| Raxil T (Bayer) | 0-5 | 1 | 8 | >10 |
| Lamardor FS400 (Bayer) | 1-4 | 4 | 6 | 12 |
| Jockey Stayer (Bayer) | 0-5 | 0 | 5 | 10 |
| Vibrance (Syngenta) | 0 | 0 | 3 | 4 |
| Dividend M (Syngenta) | 0 | 1 | 5 | 5 |

EXAMPLE 8

Enhanced Canola Germination and Growth Under Water Limited Conditions

Seed coated microbes were assessed in field trials in a low rainfall zones in Parilla (Murray Mallee) in Australia. *Paenibacillus* 9.4E and *Streptomyces* BD141 had increased establishment growth (plants per meter), and significantly increased the number of secondary roots per plant (Table 21).

TABLE 21

Results from field trials assessing microbial inoculants for increasing establishment, growth and yield of canola in the low rainfall zone. Data is the mean plants/m at 6 wks (Parilla), shoot dry weight (DW) g per plant and number of secondary roots at 13 wks and final grain yield, six replicates. Control treatment contains no fungicide or microbial inoculation. Microbes were applied as seed coatings.

| Site Year Treatment | Establishment Plants/m | Shoot DW g/plant | Secondary roots per plant |
|---|---|---|---|
| Control | 8 | 4.12 | 10.8 |
| *Paenibacillus* 9.4E | 10* | 3.80 | 11.9 |
| *Streptomyces* BD141 | 11* | 5.06 | 14.6* |

*Treatment significantly different from untreated control at P = 0.05 by Fisher's LSD

EXAMPLE 9

Canola Growth Under *Pythium* Root Rot Stress

Strains were assessed as seed coatings on canola at three sites with *Pythium* infested soil. There was no impact on grain yield at the two Spalding sites in 2015 or 2016, however *Streptomyces* BD141 and *Paenibacillus* 9.4E significantly increased the percentage of roots with root hairs at the 2016 Spalding site (Table 22). *Paenibacillus* 9.4E significantly increased grain yield at Turretfield in 2016 by 11.4%.

TABLE 22

Results from control of Pythium root rot on canola field trials. Data presented is the mean plants/m at 3-4 wks, shoot dry weight (DW) mg per plant, root disease score (DS, 0-10), % of root system with root hairs at eight weeks and final grain yield, six replicates. Control treatment contains no fungicide or microbial inoculation. Microbes were applied as seed coatings. % increase in yield is relative to untreated Control.

| Site Year Treatment | Establishment plants/m | Shoot DW mg/plant | Root DS (0-10) | % Root hairs | Yield t/ha | % increase in yield |
|---|---|---|---|---|---|---|
| Spalding 2015 | | | | | | |
| Control | 14 | 1184 | 2.2 | 64 | 2.00 | 0.0 |
| Apron | 15 | 1310 | 2.1 | 66 | 1.94 | −2.8 |
| Paenibacillus 9.4E | 15 | 1344 | 2.3 | 64 | 1.96 | −1.8 |
| Streptomyces BD141 | 15 | 1177 | 2.1 | 66 | 2.01 | 0.5 |
| StreptomycesEN27 | 15 | 1158 | 2.1 | 68 | 1.97 | −1.5 |
| Spalding 2016 | | | | | | |
| Control | 14 | 878 | 0.4 | 80 | 2.91 | 0 |
| Apron | 15 | 899 | 0.3 | 82 | 2.90 | −0.5 |
| Paenibacillus 9.4E | 15 | 890 | 0.2 | 86* | 2.83 | −3.0 |
| Streptomyces BD141 | 13 | 905 | 0.3 | 86* | 2.86 | −1.9 |
| Streptomyces EN27 | 15 | 1061 | 0.2 | 87 | 2.85 | −2.2 |
| Turretfield 2016 | | | | | | |
| Control | 15 | 1210 | <0.1 | 41 | 2.37 | 0.0 |
| Apron | 16 | 1368 | <0.1 | 45 | 2.47 | 4.2 |
| Paenibacillus 9.4E | 17 | 1162 | <0.1 | 44 | 2.65* | 11.4 |
| Streptomyces BD141 | 18 | 1236 | <0.1 | 40 | 2.48 | 4.4 |
| Streptomyces EN27 | 18* | 1275 | <0.1 | 38 | 2.68* | 12.8 |

*Treatment significantly different from untreated control at P = 0.05 by Fisher's LSD Those skilled in the art will appreciate that the invention described herein is susceptible to variations and modifications other than those specifically described. It is to be understood that the invention includes all such variations and modifications. The invention also includes all of the steps, features, compositions and compounds referred to, or indicated in this specification, individually or collectively, and any and all combinations of any two or more of the steps or features.

Also, it must be noted that, as used herein, the singular forms "a", "an" and "the" include plural aspects unless the context already dictates otherwise. Thus, for example, reference to "a microorganism" includes a single microorganism as well as two or more microorganisms; "a wheat plant" includes a single wheat plant as well as two or more wheat plants; and so forth.

Reference to any prior art in this specification is not, and should not be taken as, an acknowledgment or any form of suggestion that this prior art forms part of the common general knowledge in any country.

Throughout this specification, unless the context requires otherwise, the word "comprise", or variations such as "comprises" or "comprising", will be understood to imply the inclusion of a stated element or integer or group of elements or integers but not the exclusion of any other element or integer or group of elements or integers.

Reference is made to standard textbooks of molecular biology that contain methods for carrying out basic techniques encompassed by the present invention, including DNA restriction and ligation for the generation of the various genetic constructs described herein. See, for example, Maniatis et al, Molecular Cloning: A Laboratory Manual (Cold Spring Harbor Laboratory Press, New York, 1982) and Sambrook et al. (2000, supra).

Additional Sheet for Biological Material

Identification of Deposits:

1) The Name and Address of depositary institution for the deposits are:

National Measurement Institute

1/153 Bertie Street

Port Melbourne

Victoria, Australia, 3207

| Date of deposits | Accession Numbers | Identification Reference |
|---|---|---|
| 9 Mar. 2017 | V17/004921 | Paenibacillus sp. 9.4e |
| 9 Mar. 2017 | V17/004922 | Paenibacillus sp. 10.6D |
| 9 Mar. 2017 | V17/004923 | Streptomyces sp. BD141 |
| 9 Mar. 2017 | V17/004924 | Streptomyces sp. HCA1273 |

2) Depositor:

All above mentioned depositions were made by:

Professor Chris Franco

Flinders University

Room 4.19

Level 4 Health Sciences Building

Registry Road, Bedford Park, SA

Australia

SEQUENCE LISTING (4686 sequences)

SEQ ID NO: 1 - DNA, 20 bp, Unknown
  27f primer
agagtttgatcctggctcag

SEQ ID NO: 2 - DNA, 22 bp, Unknown
  1465r primer
tacggytaccttgttacgactt

SEQ ID NO: 3 - DNA, 1219 bp, Unknown
  Kingdom: Bacteria, Phylum: Firmicutes, Class: Bacilli, Order: Bacillales, Family: Paenibacillaceae, Genus: Paenibacillus
ggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgg

SEQ ID NO: 4 - DNA, 1219 bp, Unknown; identical to SEQ ID NO: 3
  Kingdom: Bacteria, Phylum: Firmicutes, Class: Bacilli, Order: Bacillales, Family: Paenibacillaceae, Genus: Paenibacillus

SEQ ID NO: 5 - DNA, 1364 bp, Unknown
  Kingdom: Bacteria, Phylum: Actinobacteria, Class: Actinobacteria, Order: Streptomycetales, Family: Streptomycetaceae, Genus: Streptomyces
gatgaagcccttcggggtggattagtggcgaacgggtgagtaacacgtgggcaatctgccctgcactctgggacaagccctggaaacggggtctaataccggatatgagtctccaccgcatggtgggggctgtaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccc

SEQ ID NO: 6 - DNA, 1386 bp, Unknown
  Kingdom: Bacteria, Phylum: Actinobacteria, Class: Actinobacteria, Order: Streptomycetales, Family: Streptomycetaceae, Genus: Streptomyces
agtcgaacgatgaagcctttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggag

SEQ ID NO: 7 - DNA, 662 bp, Unknown
  Kingdom: Bacteria, Phylum: Firmicutes, Class: Bacilli, Order: Bacillales, Family: Paenibacillaceae, Genus: Paenibacillus
atacgggagcttgatgcgagtggatcaaccgccgggtaaatacccatttcggaaattttacgttccagattcgttgtagcatccaaatgggcaaacgtcgtagcaggagccgggtcagtgtagtcatccgcaggcacatagatcgcctgaatggaagtaacagaaccttttttagtagaagtaatccgttcttgcaattgacccatctcagtagccagcgtaggctggtaacctactgctgaaggcatacgtcccaacagagccgaaacctcagaacccgcttgagtaaagcggaaaatgttatcaataaagagcaacacgtcacggccttcttggtcacggaagtattccgccatcgtcagacctgtgagagctacacgcaaacgtgcacctggaggctcgttcatttgtccaaacaccatcgctgttttgttgataacgccggaatctctcatttcatgatacaagtcatttccttcacgtgtgcgttcacctacacccgcaaatacagaaataccaccatgctcctgagcgatattgttaatcaattcttgaatggttacggttttacctacaccagcaccaccaaacaatccgactttaccacctttggcataaggagctagcaagtcgataactttaatacctgtttcgagcatctc

SEQ ID NO: 8 - DNA, 728 bp, Unknown
  Kingdom: Bacteria, Phylum: Firmicutes, Class: Bacilli, Order: Bacillales, Family: Paenibacillaceae, Genus: Paenibacillus
ccctgaccaaggcgctcaccttcgtaggaataccaggctccgctcttgtcgacaatgtcatgctccgtaccgatatcgatcaagctaccttctttggaaataccctcaccgtacataatatccacctcagcctgacggaaaggaggggcaactttgttcttcacgactttaatacgtgtgcggttacccacaatgtcgttacccattttcaaactttcaatacgacgaacatccaaacgtaccgtagagtaaaacttcaaggcacgtccacctggtgttgtttcagggttaccgaacataacacctactttttcacgtagctggttaataaaaatagcaatggttttcgacttgttaatggctccagaaagcttacgcaatgcctgggacatcaaacgtgcttgaagaccaacgtgggaatctcccatttcgccttcaatctctgccttgggcacaagtgccgctacggagtcaacaactacaatgtctactgctccactacgtacaagggcttcggcaatctcaagcgcctgctctcctgtatctggttgcgatagtaacaactcatcaatattgacacccagcttgcttgcatacgacggatcaagcgcatgctcggcgtcgataaaggcggcttgtccgcctgttttttgcacctctgcgatagcgtgaagagctactgtcgttttaccggatgattccggtccgtatatttcaataacccggcc

SEQ ID NO: 9 - DNA, 638 bp, Unknown
  Kingdom: Bacteria, Phylum: Firmicutes, Class: Bacilli, Order: Bacillales, Family: Paenibacillaceae, Genus: Paenibacillus
gtcattgctgaaacaggcgcaggacagcatggtgtcgcgacagcgactgtggctgcgttgctcggattggaatgcaaggtgtttatgggcgaagaggatactgtgcgccagcagctgaacgtctttcggatgcagcttttgggtgcagaggtcattccggtgacatcaggtacacgtacacttaaggatgccgggaatgaagctttgcgttactgggtcagccatgtccatgatacgttctatattttgggttcagctgtcggcccgcacccgtatccgatgatggtgcgggacttccaacgtgtgattggtgatgaaacacgtcgccagatcctagagaaggaaggcagacttccggatgtcatcgtggcagcgatcggtggcggaagcaatgccatcggcatgttttatccttttattgaggatcagggtgtcgcattgattggcgtggaggccgctggaaaaggtgtcgaaacggaattccatgcagctacgatgaccaagggaacacaaggggtcttccaaggctctatgagttatctgcttcaggatgagtatggacaagtgcaacctgcgcattccatctcggctggattagattatccaggtgttggaccggagcattcatacctgaaaga

SEQ ID NO: 10 - DNA, 1301 bp, Unknown
  Kingdom: Bacteria, Phylum: Firmicutes, Class: Bacilli, Order: Bacillales, Family: Paenibacillaceae, Genus: Paenibacillus
agctttgtcttggtctgaccctcaaactgtggttctggaattttgacggagataatcgccgtcaatccttcacgcacatcgtcaccggtcaagttggcgttgttgtccttaatcaagccatttttacgtgcataatcgttaataatccgggttaatgcactcttgaaacctgattcgtgagttccgccctcatgggtgttgatgttgttggcaaaagaataaatattctcggtatagctgtcgttatattgcaatgccacttcgacttgaatcatatcacgcgagccttcgacataaatcggctgttcatgcagcgcttctcttttttgattcaaaaattgcacatattcactgattccgccctcgtagtgaaatgtatcgctggcgcccgtccgttcatcagtcaagctgattgcaatacctttgttcaggaaagccaactcacgaatccgtgtctggagcgtatcatagtcatatacggtcgtttctgtaaagatttgatcgtcaggataaaaagtcgtttgggtacccgtctcgtctgtgtcaccgatgactctgacatcatactgcggagcaccacgatgatattcctgctcatacagatgtccgtcccgtttaacatgcacgatcattttgctggagagggcatttactacggatacaccaaccccgtgcagaccaccggataccttgtaccctccgcctccaaatttaccacctgcgtgaagcacggtcataacgacttccagcgcagattttttcattttggcgtgttcacttactggaataccgcgaccgttatctgtaacggtaatgctattgtcttcgtgaacgacaacttgaatgctgtcacagtaacccgccagcgcttcgtcaatgctgttgtccacaacttcccagaccaaatgatggagacctttggcgctcgtggagccaatatacatcccgggacgtttccgaaccgcttccaggccctcaaggacctgaatctcgcccgcatcataagacggttgattcatagacatgcctttcacctacttctatagattctatggttaagcattggcaacaaactggtttgcccgctttttgagtgttgttgaggagatgggggaataatacaccgtattctgagtcactacgatggacttggcttcctcttcgccaatcatctcgacatgcttctgctgttgggcgtggttcacgtattgcttggagattttagaggatttttcaatcgagatatcgaaaatagccacaagctctgaagagcggatgattttttctccacccagatgaat

SEQ ID NO: 11 - DNA, 740 bp, Unknown
  Kingdom: Bacteria, Phylum: Firmicutes, Class: Bacilli, Order: Bacillales, Family: Paenibacillaceae, Genus: Paenibacillus
gcattctcccgtccctgaccaaggcgctcaccttcgtaggaataccaggctccgctcttgtcgacaatgtcatgctccgtaccgatatcgatcaagctaccttctttggaaataccctcaccgtacataatatccacctcagcctgacggaaaggaggggcaactttgttcttcacgactttaatacgtgtgcggttacccacaatgtcgttacccattttcaaactttcaatacgacgaacatccaaacgtaccgtagagtaaaacttcaaggcacgtccacctggtgttgtttcagggttaccgaacataacacctactttttcacgtagctggttaataaaaatagcaatggttttcgacttattaatggctccagaaagcttacgcaatgcctgagacatcaaacgtgcttgaagaccaacgtgggaatctcccatttcgccttcaatctctgccttgggcacaagtgccgctacggagtcaacaactacaatgtctactgctccactacgtacaagggcttcggcaatctcaagcgcctgctctcctgtatctggttgcgatagtaacaactcatcaatattgacacccagcttgcttgcatacgacggatcaagcgcatgctcggcgtcgataaaggcggcttgtccgcctgttttttgcacctctgcgatagcgtgaagagctactgtcgttttaccggatgattccggtccgtatatttcaataacccggcc

SEQ ID NO: 12 - DNA, 710 bp, Unknown
  Kingdom: Bacteria, Phylum: Firmicutes, Class: Bacilli, Order: Bacillales, Family: Paenibacillaceae, Genus: Paenibacillus
atacgggagcttgatgcgagtggatcaaccgccgggtaaatacccatttcggaaattttacgttccagattcgttgtagcatccaaatgggcaaacgtcgtagcaggagccgggtcagtgtagtcatccgcaggcacatagatcgcctgaatggaagtaacagaaccttttttagtagaagtaatccgttcttgcaattgacccatctcagtagccagcgtaggctggtaacctactgctgaaggcatacgtcccaacagggctgaaacctcagaacccgcttgagtaaagcggaaaatgttatcaataaagagcaacacgtcacggccttcttggtcacggaagtattccgccatcgtcagacctgtgagagctacacgcaaacgtgcacccggaggctcgttcatttgtccgaacaccatcgctgttttgttgataacgccggaatctctcatttcatgatacaagtcatttccttcacgtgtgcgttcacctacacccgcaaatacagaaataccaccatgctcctgagcgatattgttaatcaattcttgaatggttacggttttacctacaccagcaccaccaaacaatccgactttaccacctttggcataaggagctagcaagtcgataactttaatacctgtttcgagcatctctgcttgagttgtcagctcatcgaaagaaggagcttgacggtgaatcgg

SEQ ID NO: 13 - DNA, 638 bp, Unknown
  Kingdom: Bacteria, Phylum: Firmicutes, Class: Bacilli, Order: Bacillales, Family: Paenibacillaceae, Genus: Paenibacillus
gtcattgctgaaacaggcgcaggacagcatggtgtcgcgacagcgactgtggctgcgttgctcggattggaatgcaaggtgtttatgggcgaagaggatactgtgcgccagcagctgaacgtctttcggatgcagcttttgggtgcagaggtcattccggtgacatcaggtacacgtacacttaaggatgcagggaatgaagctttgcgttactgggtcagccatgtccatgatacgttctatattttgggttcagctgtcggcccacatccgtatccgatgatggtgcgggacttccaacgcgtgattggtgatgaaacacgtcgccagatcctagagaaggaaggcagacttccggatgtcatcgtggcagcgatcggtggcggaagcaatgccatcggaatgttttatccttttattgaggatcagggtgtcgcattgattggcgtggaggccgctggaaaaggtgtcgaaacggaattccatgcagctacgatgaccaagggaacacaaggggtcttccaaggctctatgagttatctgcttcaggatgagtacggacaagtgcaacctgcgcattccatctcggctggattagattatccaggtgttggaccggagcattcatacctgaaaga

SEQ ID NO: 14 - DNA, 1208 bp, Unknown
  Kingdom: Bacteria, Phylum: Firmicutes, Class: Bacilli, Order: Bacillales, Family: Paenibacillaceae, Genus: Paenibacillus
aagttggcgttgttgtccttaatcaagccatttttacgtgcataatcgttaataatccgggttaatgcactcttgaaacctgattcgtgagttccgccctcatgggtgttgatgttgttggcaaaagaataaatattctcggtatagctgtcgttatattgcaatgccacttcgacttgaatcatatcacgcgagccttcgacataaatcggctgttcatgcagcgcttctcttttttgattcaaaaattgcacatattcactgattccgccctcgtagtgaaatgtatcgctggcgcccgtccgttcatcagtcaagctgattgcaatacctttgttcaggaaagccaactcacgaatccgtgtctggagcgtatcatagtcatatacggtcgtttctgtaaagatttgatcgtcaggataaaaagtcgtttgggtacccgtctcgtctgtgtcaccgatgactctgacatcatactgcggagcaccacgatgatattcctgctcatacagatgtccgtcccgtttaacatgcacgatcattttgctggagagggcatttactacggatacaccaaccccgtgcagaccaccggataccttgtaccctccgcctccaaatttaccacctgcgtgaagcacggtcataacgacttccagcgcagattttttcattttggcgtgttcacttactggaataccgcgaccgttatctgtaacggtaatgctattgtcttcgtgaacgacaacttgaatgctgtcacagtaacccgccagcgcttcgtcaatgctgttgtccacaacttcccagaccaaatgatggagacctttggcgctcgtggagccaatatacatcccgggacgtttccgaaccgcttccaggccctcaaggacctgaatctcgcccgcatcataagacggttgattcatagacatgcctttcacctacttctatagattctatggttaagcattggcaacaaactggtttgcccgctttttgagtgttgttgaggagatgggggaataatacaccgtattctgagtcactacgatggacttggcttcctcttcgccaatcatctcgacatgcttctgctgttgggcgtggttcacgtattgcttggagattttagaggatttttcaatcgagatatcgaaaatagccacaagctctgaagagcggatgattttttctccacccagatg

SEQ ID NO: 15 - DNA, 221517 bp, Unknown
  Kingdom: Bacteria, Phylum: Firmicutes, Class: Bacilli, Order: Bacillales, Family: Paenibacillaceae, Genus: Paenibacillus
gcacaatttcatcaaagatatcttgaaagatcgtggtgtctttaaagcgagtgcgacgattccagctaatcgtcgtatggtctggaactttatccgttaagcccagccccaggaaccagcgataagccaggttcgtctgaatttcacgctcgagttgccgttctgagcgaatgccatagaaataaccgagaaagatcattttaaacaacacggtaggatcaatggcaggacgcccgttgtccgcacaatacagcgggcttaccttctcatgaataaaggagaagtctatatatgtatccactttacgaagcagatgatcttgcggtaccagttcttccagagaaaccaattcaaaagattgttgtttgtctcgatgaggtcgcagcatatcaacaccgtccgttctacaatagttacctatattatacaacattaacgcggtgtcgtcttaaataaaatgaacataaaaaaagctgtcgagactttctcgacagcctgaacacgtcatatatgacgtgttttttgatctttacaagattaggtgggagtattcttttgaatgaattccataacataaacaatatggtcatatggtttcgccaaactgatggcgggaaactctaaaaaagcataatttctgaatatcctaaaaaaggttaagactcttttatgtttgtccacttcctttttacaactcttgcatacaatggattgtagaatggcattaagagggagtgacaaaaaaatgagtctttattttcgaaacagcaccaattctaccgtacaagtagccattttctatcacgcgagtaggtgtgggtttgtctttgtgggacaaactggtatattgtctacctggtaccgtttggcgcctggtcaaacgagggaagttgttactggcaacgtaggggatagaacaatttattactacgctgagagcatatcaagaaatcttgtatggtcaggtagtttccccatacatgttcctaattatagtttcaatggatgttggatctggaatattaatgggaatatatgcaataattgcagaagagttggttttaaaacacttaacatccaacgcggtttcgtgaactttacagtcaaccttattacaaataatgctcaaagaaaaacgaagctaaaaaatgttcgtatggtattgcccacaaaaagggtaaaaagaaaatctaaattgaatgaccgcaagaaactacctagaagccaataatttcctaatggatgggaatcctttgtgatttcgtattcaattcagttcgcgcttttatataagaaacttgaaattaagttaatagtggatatatatatattattttaattttcgatagggtattgaacttacgtaaaacaatagtgcaataggaactgccttgttaactaaaggtgactcctttatttttgctaaaaaatccttttaatttgtaatctcccgtatcacattcctcgccaagcgtactttctctggactcgacttttggagtatttttatgatttcttgtatatcagtttcatgttttgtaaccttaatatcctcatttacataagcaaaaagctgaatcaaattaacatccagtgcattagcaattttagctatatttattaaggatacgtttttttctccacgctcaatctgccctatgtatgaaaaatggaatccgcctttttccccaagcgactcctgagataatcctttttcttttcgcaaagcacgtattctggcacctactaatttaagaacttctttattttccatcctctacacctcactattctaaaagtgtagacaagatatccaaatgaaaacattgaataatgaatataataaataataataatatctataagtattattttagagtataataagactaatctttaaattctctggaggaatagatatgaaagaagctccttctacctgtattccaagtcccactcaaccgtcccgaccctcacaacacctacataaatcaataacggattttcacactctatcccaataccacatgaaactagcccaaatcctgtacaagcacaatcaagtccaatgctgcataatcctatgtgactgggcgttaacctccatgttaaaagctctatatatgaaagaaaacaacagccttttccctcccggattcctgtctatgactgacctgctgcacttattacataccgaaaccaacccgggattggatgttgttgtatttataggcaccactcaatttctttcatcccagttagaaaccccgctccttcaagaaatgaagtacaaggatgtgagcaggttactgcgaagaacggacgacattctctgccagttgtcatccagagtcattagcgatccatccgagacgtatcagtccattttctgagtagcccttccatggcaaataaacttgccgattcgccctgtcgttatccgcttttcttcatacgataagagtaagctttaacgcaaggagggattcagacatgggtgaagtaggttacggtggagcatggacatccacaggagcgattttggtattgttcattttgttggtaattattactaagtcttttctgatctaacagcaggttagcatttcttaaatccacaaatcggccttctttcacgacatcgtgagggagggctttatatgcagaatgggtgttagtccagcatgttgtctggctctgcaagcattgctatactttacatacagggagattttccctcaaatatatggcaatacggatagcgtaagacgtggaaaaaccgaaattcgccgaccaaaatcaggaggatcgcatgatgaatacggcaagcagtccatttcaatttacaacagacacggcgactctttgtttatttgatacgcaagctcttaagcaccgtttggacgatgatccggattggtggtccatcgaagaggacgagctgggcgagttgaacaaaggaaatgtagcttttttgaatctgggagcggacgggacctatgaggttgtgatgacagatcatatcgacaagcctactgtgcggctgtttttgaaggttccctcaggcaacctatttattggagcaggggaggaagccacaagtggtggactggagcctgaatgcgtatggggagggacgttcctttctgtacaaccgggattttatgaatgcttggcgagcagagaagacaatcgtatttatctttctttaaaaaaaggaagcgaaggcagcaatagctttacaggtctgattcgattgtaggttgcaggcaacccgtaacggcccatacaagccgcctgaacaggtggaagcaggaacaaccgaaaccaggaaaatggataaaaggctatccccacggcttacacatccgtgaagacagccctttatctgtctatcgatactttacaataatggcattgctgatttggcggccgggtgtggtgaggtaggagccgttgtaatacagcccgctggaagcaccgccatccagattcatggcctgataagcgccagcctgcttcatcatttgggcgagctgcggtatagtcgctccacttgtggttaggaggattagcttatgatcccgactcattccgagtgcgctacgggcgccgccgcctgttaatattttagggtccttgaagccttcggctttgacatttagggaaacctgaccgttcgtgaccagacgaggcccggcttgaagggcaccttcgacgctaccttggcttaagcgttgttcaaaggcagaacccgacattaactcagataaatggttggcatcgtaggtgaagaccgtccgttggtcgccagagctttttttcaacatctttccgtgactgaccaggtagccgtaaggcgttttgtaagagcttttggtataggcatcaaagaatgtaccattgatggctacaaccgcttggttacgtttggcgagactacttaagtcttccactttaccaatggaatcgtctgccagtgccacgtccaggcttaccttgggatggagcatagagatggtgaccaccttagcggaaaatgtacgagacccgaccttgaagcttttatgagctgtcgtaatgggtgtagtgtttccgggtaacttgccagtatgtaccggaagcgtgacggacgttgcaccttgcttaatgcgtacagctgaggtttccttttgccatgagacttgcaggtttagatattgactgatgaactgcaaggggacataggtcgaaccgttatcggtaaaaggagcattttgcaaatggaccgtttgatcattcactttggcagtagatttcccggcaaatagggtgatccgagtattgccttgcgcaatttctatttttttgtccactgccgttaaattgaatgtgatcccttcatagctgttcagaagacgaagcgggatgaaggagtggttactctggtccacatagaccagcataggtgctggggcagcagcgtagatcggggataccagtaatagcaaggacaggataacaagtgcggtgattcttttcatgaatagatcaatctccttatgtagtcttgacactttacgaggtgcttgtaattatatcgggttttataagttgtaaatgtatgttatgcgaattttgagtgtttagctgatataggaagcgggaggttggagatgagcaggtatgagacaagacttgaggattaccgtcgcagagagcgcccgtcttatcgtgtatttgaaggattacaggaattggtgcgtagcgtggggcaactgcataataactggttatatgtgaatgtggatcaatgggatcaagaccctgttcacacaccgatttattattgggatgagcattggctagaggaatgtgcagaggagggtacagtcgtaaccaacgaacaagacgagtatattcccaagtgggtgccggatcgtcaggttcaaacctggtttgagttggcgaccttcgaaagtattgtggaagtccttaaggctgctggacagccagtgacgcttcagatggtgattatagcggtaaaatactatgacaaacgagatgcctttctggactatgaagaggtgaaggcagtgacagacctgtggtctgtgctgacaaaggcgagaaaccacctaacagaatgaacaaagcctgtagaacaaacagggcatacatacactggatgggggaagcaaatgagttggttgaatcatgaaatggcagcaaagtggcgacaggaaggaaaaaggtatgccgcagatgtgaatgaatttgtcagagtcggcatggaaagtgaatggcagcaggagcaatcagagccaaaccaggacgaacgccccaagatggccaaagatatttttcgtatgattcaggaggcgaatcaggctggtgaaatggagcagttacgtcgagagattccagccgcgtcttggccgcttacaccagcgttcgaggaggctttgcaagccgttaggccgatagcttttgtgaatggaggcaatgaagtcattctacatgcggacaatcctccggaacgtgggacgatctatgtgacgggaaaagatagaatcttgcaaatccccggactgcatcgagtaggctgttcgccggacgggacttattttgcgttggtggatggacaggggattcggattgttcgtcaaccggatttaaatctgcaaggagaagagacagcacattttcagtggaaggatatacaaggccgcttaaaagcatccattcctgatctggagtgcttgggagatgaggagcatcctgaagatatattagatgaagtgattccgtttggcgatggacagcgacttctgctggtttgcggttacggcgtttatttgctggctgatgatcaggtggatttgatccatcccaaggcgtctgaacgaagaaaactagagttggaagacacgattgtggatatggcccatggagctgtgtcgagggatggacgttggattgcttacggtagccagatgagtgagcatatgcttatggatctgtctgataagacggtgcatacattggagccaagttctagttatccgcattatgctctatttgccaaagatgatctggacgtctggtacaatgcctgtcatttctacaacggtgccaccatttaagtgtcgattgctgaggtggagcagggtcttgctcagaataaggaagaatggccgatgatgaatgaagaaatgcgagtatacgcttcaacagcgctgacacaaggatctattttgggtgatgcctacggttatctccgtctggttgacagggagggccgtgaactttggcactattttgtcggcagtacgatatccgggctggcagttacaactgatgaaagtatgttggcggttggaacgtatggcggtatgcttcatttgattgatttgcagagcggcacgaaggaggaatatagcattggcacggctccaattcacgagacagcgcgttgggtgatctggcggaactatgagcccttgcgctggtaatactaatattccgcaaatggtgataaaagcaagttctgataagctgaacttaaaaagtgtagcagcacatgattacaatgctattttcagatagagggcatttggcattaacccatgatgcaaaatgtgaatagagaggaaagaggtgtgaagacatggacaagaaagcggatattcgtacattcatgaaggaactatttgctcagatggatgaagccttttttatggatgtggaagaaaatgtaccgatggaaatgcgtgatgggaatgttgacgaggaggggtggatcaagtggaagcctctcctctcacagattactgaacaggaagttcgggagatggaggaaaaataccattttgagctgccgcccctgttgaggagttttatcatgtcctaccattatgtatctttacaattcgataatgagtccatcccgggagtatactggagcgattgtacgtttgttgagttcccacgtctgcctgtaggtcaaggcttaaaggcattttatgatttgcttgatcaatggtcacctcttctgtcagcaggctacattccttttgcaatagcagaggacgaccagggtcccgtttgtttaaatgcaggcagcagacataaggacggcgattatcctattgtttggttctttcatgaagacctacagcatttgaatgaggatgagcttcggatcaggagtaatctgcttccccatgtacaggggctgtttccatcttctgtcgaaatgtttaacgtgatgtttaagcacattagacactagcgatttcctgaaatgtaattttaatgtttagccgaccgagatattgacataaaaaatgaggaatgatataaaaaaggtaggctagcactcgaatgatgggagtgctaacaaagttgaatcgtttgcatagctcatatcggctggccttacataggttcatatttgaaaggagatatccgaatggagaaaaaacagtttcaggctgagtccaagcgtctgctcgaaatgatgattaactcgatttacacgcaaaaggaaattttcctaagagagctgatctccaatgcaagtgatgcgattgacaaaatttattacaaagcattgacggatgaacaactggtctttgacaaagaaaattattatatcaaagtaactgccgataaggataacagaacgctaaccctgcgtgataccgggattggtatgaccaaggaagagctagaaaataacctgggtgttattgctaaaagtggttcactggcattcaaaaatgaaaatgaatccaaggatggtcatgacatcatcggtcaattcggcgttggcttctattcagctttcatggtagccgatgtggttacagtgactaccaaggctttgggaagcgatactgcatataaatgggaatccacaggtgcagacgggtataccattgaggcagctgagaaggacgaggtcggaacagagatagttctgaaaatcaaggcaaacaccgaagatgagtcctacgatgaatatttggacgagtaccgtttaaaagcactgattaaaaaatactccgactttatccgctatccgattaaaatggatattacaggcaagcgtctgaaagagggaagcgacaacgagttcgaggattacgaagaagaacagcgtattaacagcatggttcctatctggagaaaaaacaaaagcgagctgaccgacgaggattatcaaaatttctacgcggaaaaacgctatggctacgacaagccgctccagcatatccacgtcagtgcggatggcgcggtagtgtaccaagctattctgtttattcctgaaaatattccgtttgatttctactccaaggaatatgaaaaagggctggagttgtatgctaacggtgtgctgattatggaaaaatctcctgacctgctgccggattattttagctttgtcaaaggtatggtcgactccgaaagcctgtcgctcaacatttccagagaaatgctgcagcatgaccgtcagctgaagctgattgctaaaaatatcgaaagcaaaatcaaaggccaattgctgaccttgctcaaaaatgaccgggagaaatatgatcaattctacaaatcatttggcagacaattaaaatttggtgtctacaacgattacggcagacataaagaaactctccaggatctgctcatgttctactcttctacagagaaaaagcaggttactttggacgaatacgtatcgcgtatgccagaggatcagaagtatatttattacgcttccggggagtccaatgagcgtattgaaaaactgccgcaaaccgaaatggtggctgacaaaggctacgaaattctgtatttcaccgatgatattgatgagttcgctattaaaatgctcttaagctacaaagaaaaagaatttaaatctgtatcgagcggcgatctgggcattgagcctgacgaaaacgagaaagaatcagaagcagaacaaaacgacaacaaagagctgttcgagtacatgaagggcttgctggaaggcaaggtatccagtgttaaagcctccaagcgcttgaagacacatccggtatgtctgtccgcagacggtgaagtgacgattgagatggaaaaaatcttgaacgccatgcctaataacgccgatgtcaaagcgaataaagtgctggaaatcaacgtaaaccatgcggtgttcaactctttgaaagaagcttttgacaaggataaggagaaggtaaacctctatacggcattactgtataatcaggctttgctgatcgaaggcttgccactgcaagatccggttgaattcacgaacgatatttgcaaaatcatggtttaacaagctttattactgtatagagccgttcccatactgggggcggctttatttatcataaactcttcttaaatctccataataggtcatatagcgcttacagaagaagggatgggcccacacaatgccgatcatactcaatacaaaggagggcaattatatgagtctggatagagatagaaaggaactccaaaatttggatcgaagtgagcttatagagttagtggaaaaaatcaccagaggtgagggaacagaagaggaaatcgacagcatgctgaccatagtgaagcaaaatacgccccatccggggatcagtaatttgatctactgggatgaccgtgacttgagtgcagcagagatcgtagatgaggcattacgctatcagcccattattttaccaccccatgaatcttcttcataggatgcggaggggtggtcttttgtttagaaataagatagtattaactctttaggactatgagcattagattcaaaaaaacttccgttaaatacgtgctgacttccctggagtgtatggggtaatgtttgttttttgcacactttacggagtttttatgcctaattttggaatttgtaaagtttttgtgacatgttcctgtgaattttgacacagcaaattgtcgtttttcttgattatttggtgggatgtctttataatcattttgtttgcaagaatgattagcgattagcgtatggaataaggaggttatttattttgggaaaagcattgattattggcgccggtggcgtggccagcgttgtggtgcataaatgttgccaaaacccagatgtatttgaagaaatttgtatcgcaagcagaactgttgagaaatgcgatgcgcttaaaaagaagctgggtggaggtcgtacgaagatccaaacggctcagcttgatgctgacaacaccgacatggtcattgacttgattcgaagctttcaaccggatgtagttatcaatgtggctctcccttatcaggatttgacgataatggatgcttgccttgagacaggtgttcattacgttgatacggcgaactatgaaccgccggatacgccgaagtttgaatacagctggcaatgggcctacaaagaaagattcgaaaaagcaggaattacagctctgctgggcagcggttttgatccaggcgtaactggagtatttacggcttatgctcaaaagcactactttgatgaaattcatacgattgatattgtggatgcgaatgcaggggatcacggatatccttttgcaactaattttaatccggaaatcaatattcgtgaaattacggcgaaaggccgttactttgaaaacggagaatggattgaaactgagccactttctgagaaaaaggtatacgaccttcctgaaattggaccgaaaaatatatatcttttgtaccatgaagaactggaatctcttgcagtgaatattaaaggcgtgaaaaaaatccgcttctggatgacgttctcggacaattatctgaatcatttgaatgtacttcaaaacgtaggcatgacttcgatcgagcctattgattacgaaggacaacaaatcattccactgcaattcctaaaagctattttgccagacccagcttctctgggaccaagaacaaaaggcaaaacaaacattggttgcatcatccaaggtgtgaaagatggaaaaccaaaaacatattatgtttacaatgtttgtgatcatgaggaatgttatgcagaggttggctcccaagccatttcttacacaactggtgttcctgccatgatcggcgcaatgcttatcatcaaaggtatctggaaaaaaccaggcgtttacaacgttgaggaatttgatccagatccatttatggaagcactaaataaacacggattgccatggcaagagaactttacgccaacgttgcttgattgaggtctgcgatgaatattgatattacaggacttccatcaccttgttatcttgttgacgaaagacttcttgtcaaaaaccttgaggttttaaattccgttcaagagcggacaggctgcagtattttgctcgctcttaagggattttcgatgttttcgacctttcctctggttggcaaatacttaaaaggcgtaacctccagttcgttgttcgaagcacgacttggtcgcgaaaaaatggacaaagaggttcatgtatacgcacctgcttatgttgacagtgaatttgatgagctattggagtatgttgaccatattgttttcaactcctttgatcaactgaaacgctacaaaagcagagtgcaaggcgtaacttccaaaaaaattgacattggcattcgggttaatccggaatattcggaaatcgaaacgccgctgtatgatccttgctacaacaactccagaatgggtgtgaccctggctaactttagacctgaggatctggatggcgtggacggtattcattttcatacgatgtgtgaacagaattcagatacgctagagcgcaccattaaagtcgtggatgagaaattcgggccatacattaagaacatgaaatggctcaatttcggcggcggtcaccatattaccagagaagactatgatctggacacgctggtacgctgtattcaatattttcaggataaatatggtgtgcaggtttatctggagccaggcgaagctattgctttgaatactggatatctggttgctacagtcctagatacgatgaaaaacggaatggatattgccattctggatacttcggctgaatgtcatatgcctgacgtgctggctatgccatatcgcccgaacatcattgatgcaggccagcctggcgagtatgcttacacctacagacttggtggacttacgtgcttggctggagatgtgattggtgactattcctttaaagagccattgaagccgggagacaagcttgtattctgcgacatggcccattacacgatggtcaaaaaccatatgttcaacggagtcaacctgccagccatcgccagctacaacgacgaagaaggcattaaggtaatccgtcagttctcctacgaggactttagctcgcgtttgtcgtaagacatagagagtgtgaagtaactgagtacaccgaattgaatgactgatattacaaaagcctcgccccttgagataggagcgaggctttttggtgtagttagggattttttagtttttatatgtgcctgttgcatgtatccaatacgacaacgggtattaaataatgattcactacttgaaaagttacataaatttaattagtctaccttacagcttcagaagagactttatagtcaaatatatgtcctccaggttgaagtcctggaaaaacctcgacggctaggtagtattctttacctttttcaagttctacatctaaagaatattgaccatctcttgaacgtttcattttactaccagtattatcgtaaacagtcatttgcaaccaggaatctgaatatctgtctccctgaattgtaaaatgagctttttgtgattcaaaagccttgattttatatacatcgtaggcttcccagactccaggcactccctctgcaccaagtcttccgataacagcatcacctataaaatagtagttagcctgttcaaaactatcatttggttcctgctcatgatattcaagtacagaggcaggagttaagtcttttgttgtatttgcttcttcggctaaagcgacactggcagaagtacttagcataagtgtcaggcctaatgaagctaacaatgtctttttcatgaaataaaacacctctctttttaggggttatattcttaaatgaatatatgagtaattttttctgaattatttatatatatcattcaatagaaaaggatatacacaaaataagtagaaggtacaaacgagccataagacgaagaagatatgaacgtaaaatcgtcagttcttctacgacgatatagctatatttgccgtaagataataggggttcaaagatgtaaaaacgtggacccagtaaaaaggatcgcgttttttgttatgcttcaactttactaattgatttgtttaatcgtggaagtaactctatagtcgaacaattgaccaacctcaggattggctacctctactaacaagtagtaatcttgtccggctttaagatttaaacctaaacggtattgacgatcttctgcacttcttttgatgcttccattgctgtcagccacactaagcatcatccatgaattaggatatatttccccttgaatgttaaattcataaaatccagactgaggagctgtaaacttataataatcagcaaagtcataacctatattgccttcagaaatgaattttccaaagttcccatagatatcgatgccacctcctactgttattccagtggcttgatcaaaccagttattaggctctacgtcggtataccatgaattagaaggctggatagattccttttgtaatgcgggtgctgcttcttgagcagatgcaacggcggtggatgtgcttaatagaagtgcaagacctagtgtagaaaaaactgcctttttcatttaataatctcttcccttcttatattttgggatttaaacgaatatatatagccagtctcatccattattatatattgaatcccaataaaatggaataaaaatggaactataaacaaaaatatatatttttttgtcacaattatgcgtttttacaaatttattcactaaacttcaattaagagttagccaacttactgtatactataaaatcccgtcttaatatgctgtcgtgaaaaggggcatcctattttaggagtaacacaagctatgttatactccataattggaggtgaaaaatatatgttcgatccgacggtttttgataatttaaaagtggccatggaaaatacagtatacgatctggataatctagattcacgtattgacattacgcagcgaatcgacagattggaaatgtctgtgatgtcacgtgaatttgctgtccaattcagactgagagaacacccgagtgtgacagcagagattcaactgaaggcagatttaaacaacttggctgcggaaattttggaaatcaaagatcaaattccgggatgtgtcttgttgctgagtttttacatggaaattcgtgaaattgagtcacaatgcagccggattgaaaatatactgaccgaaatttggaagcccgatcttcgaccggtacaaacgcttagtcagatttacggagagaagacatctacataccaaaataggattgaactccgattttccagacaaattaacgaagatcagatggaagacattccagagctgttggaacacatattgctgacgcttatggaattaaacatggtctgaacattcctctttctcttaaggaatacagcctacgatttgggggatttaggggtaaaggagctagggatataagatgaatgaacacgatttttctgaaatatatgcgatcatggaggcttcttttccagaatcagagtgcaggtcgtttgagtctcaaaaggctttattgaagcatccgagctatcgcatcatgactgaaaagaacgaacaagggcaaacaattgcttttttggcgggatgggagtttacagattttcggtttgtagagcatattgccgtagattcggctatacgaggtggtgggttaggtaaagagcttatgagcaagtttatttcacagcccgataaacaagtagtactggaggttgagccaccagtggatgagtggactcggagaagaattggtttttatgaacgtttgggatttcatctgaaccattttgactatgtacagcctcctttaagagaaggacaggctgatctgcggcttcaaataatgagctatccaggtgcgctggctgaacaggattttgctccgtttaaagaaatcttatataccgaggtctatgggttaaataaaaagattgtatagctaatggtgcttcattatcgttcatgttttgtccataccattacaaattctttctcgtcagtttcggcatcaacagattccgcttgaatggtaaatccatttttagtatagaagttaaatgctttcgtgttcgactggtatacctttaattgaatctcattatgttgcttcttcacccaatctagtagtaactggccatagccttttctttgagaatcaacacgtataaacagagctgctaagtatccatccaacatggaaacgaagccgccaatgctatgatcatcttgtatgataacgtagttttgagcgagaggaaggtacctgttttccatctcggtaacttgtgatgcccaatactgcggagcaataaaatgatgggcttctatggaagcatctagccagatggctgccaactcgttgagctcttccacatttgcgggtctaatcgacatcgtatctcctctttcacagtgcagtatgtaatcttatagatgatgctgaaataaaaaagaccgtccgaggacggtctttctacccgtggcgcttatttaaagctttgatccgtatcccgcgcctccgtcaactctgtaaattagagaataacggaccgggtaagggatacgctcaacatgtgattattgatgttgacgcacctcctttcctgatggacccattttaccatatctggtttgtgatatccagtgattttataatatttacggaaatgattcatagaaaatataatataaaaatagcttgattttatgttctatggaagatataatctaaattaccgtgattgaaaaacatcggtgtgaatacataatatgcggtcgtggcggaattggcagacgcgcacggttcaggtccgtgtgggctaaccccccgtggaggttcgagtcctctcgaccgcatcatagcctaacatttacaggttcttggattggctggatgccaccaagagcctgtttttatatggttaagatgcgcgtaccattataactattttatttatactgaaatatatatttaatatagtcttttgcactctgatcaatgtcttcgtcgcttgcttgaaacgaggctccgaagacagcgaaatagggtaatgttatggcgccaacatgcactgcgcttgccttaaaaggtgctataacttcatctacagtaaaagaaacggaaccagtaggtaagtaattttcttttttatcgccaatggacatggctatccctagcttctttccttttaacttatcaccctttgaaccataagcccatccatgggtaaaaacatcatcgaaccacttttttaataaaggagggtaactataccaatacaaagggaattgaaatatgacattatcgtatgcttcaagtagctgttgttctttcaaaacatcaatgctccagtttggatactttttataaatctcatgaattgtaatttcattggtatattgaagtaattctcgtttccatctgttatttactctagaatcttcgatattgggatgagctaaaatcacaagagttttcatcataaatcacctttcttacgtaacatatttgtgcctttgtagatgctctattattattctgtatgcttcaaaaaaagtaaatacacacaataaagtaagatagttacttgaaagtatgcattggacttaaagtgaagatatgcgattatagaattaattagataaactttgttatttttagcgttaaagaggtggtactatgaaacaatataatttaggcatagaagcaacacttgagatcatcggaggtaaatggaaatcattaatcatatgtttattaatgtctggtagaaaaaggacaagtgaagtacagcgtagtatttcaggcatttctcaaaaggttcttatacagcaacttcgcgaacttgaaaaggatggtatcataggtagacatgtgtataatcaaatgcctccaaaagtggagtattatataacggaatatggaattacagcaaatgaaattattgacttaatgtgttcttggggaagggctaatatccaaataagacaacagcaaggagaagatgtgatgttgttagaaaatgattcaaaatgaatagtggagtaaaaaagcgttgcagactatgatgtttacggtagttttcttcggctgtcttcaagtgttatgttatgtgttgagccgcaagctgatttgctatatagttatgactggacaaccattccatccatattaaatgaatgctaaagtagggggacccttgcaatgattattaaaccgaaaatccgtggtttcatatgtacgactgcacatcctgcaggatgcgcggctcatgttaaccgtcagatcaactacatcaaagacagcacatcaatacaaggagctaaaaaggtacttgtgatcggagcatctactggatacgggctggcttctcgtattgctgcgagcttcggtctgggagcggacaccataggggtatcctatgaacgtcctgcatcagaggggcgcacggcttcagcaggctggtataatacggtagcctttgaaagagcggccagagcagctggctacatagcagaaagcattaatggagatgctttttctcatgaaattaagcaggaggcgttgaagctggtaaaggaaaagctgggcaaggtagacctgattgtatatagtgtcgcttcaccgcgacggacacatcccgatacgggtgagacctttaattccgttctcaagcctatcggacagtctttttctaataaaacagtgaatacgaatacaggtgtcgtatcagaaattacgctagaaccggctacgcaggaggaaattgagaacaccatcacggtaatgggtggcgaagattggtccttgtggctaaaagcgttggaagaagctgatctgctggctgaaggggtaaccacactggcttactcgtatattggtcccgaaattacggaggctatctatcgtaaaggaaccattggccaagctaaaaatgatttggaagctacagcacatactttaacaaagcaactggagcgttatcatggaaaagcttacgtttctgtgaataaagctttggttacacaatccagttcggctattccagtcgtacctttgtatatttctttgctgtttaaggtcatgaaggaaaagggactgcacgagggatgtattgagcaggcacaacgtctgttcgagacgctatacagtgggtccactgtggaaacggatgaagaaggacgcattcggctggataactgggaaatgagagacgatgtgcagcaggctgtcaaagcagcttggtccgaaatcactacagaaaacgtatctgaattgggtgatctcgaacaataccgtctggatttcctccaattatttggattcgggtttgatgaaattgattatgaattagacgttaatccagaggttgatacactttcataagtgatatttgtaaaacaaaaacgggtactctcaagcgatacaattgcttaagagacccgttttttatgtatattggcaaaaaaacaagttgcactcgtttcaccggcagtatttatcgagaattagacgtggaaagtgacttacggtgcagcaagcgaaaaacggcaatggtaatgacaatccccacaacgccaaagactgcaacagaagtcagagctcgataagcttgccagccgaacaaaaaagcaataccactgccaaacgttgtacctgccagtaacccaagtgcgcaggcaatatccgttccaaatttcataaacatgttcctttcgaatgtataaattaaaaagcaacttgtactttttcgctggacttggacatacacttgtgcgtacaattaaatagtaatcgttttcaaacggaatctattaatcattatggatcattcttgtgcaaattattccttttttaggaggtagatgaaatgaatatgaatgagcagatcaagctttggaacgaagaggcgcaggctagtaacgctgatcatcctcaccgaaaggttgaattgtttattgaggtacgggatggagcactggactctgttgttccttatctgaaccaacaggattatcgtcatgtaactctggtagaagatgagcatacttcagtggcggctggaaaaaaagtagctgagctgattcgtgaggcaggtttgacagttgatgtagtccgcttacctccgaatgctctaggggatgtcattgctgatgaaacctacattatgaaagtgctgctgggtgtggtggataagagtcaggccgtacttgctgtaggctctggcacgattcatgatctggttcgcttcgtatgttataaaatgaatcgtccgttcttgtcagtaccgacggctgcttcggtggatggttttacctccgcaggcgcaccactaattgtggacggcagcaagcagacattccaagcagttccgccagaggcgatctttgctgatttgtccgtgctggcaaatgcgccacagacgatgactgcggctggttttggcgatatgctcggtaagttcacctcactagcggactggcatgtttccaaagatttgggaaacgagccgtattcacctgtggctaatcgcattaccgaggaggctttgcgtggctgtatagaacatgtcgatgagattgcggcaggtagcaaggctggggtcgaggtattgatgaatgcgctgattgcatccggtatttcgatgctgatgatagatcattctcgtccagcgtcagggggagagcaccatatttcccaccgaattgaaatggattttatcgcagagggacgcaagcaagttttgcatggtgccaaagtaggcgtagcatccgcattgctgtctgacctgtacagggatttagcagccagtcaggatgtagaggcatttaaggtgtatcgggaattgcctacgtcggagcagatgcgtgcatggctggctcaggtcggaggcccatctaccattgctgagctgggggttacggaggaacagctcgctcgtgcattgcgcacggctcataccttgcgtgatcgctatactggacttaagtatatgaatgaaactcaattgcttcgttcgtaatgtgcaacctctacataaattgtcctttagatattcggccagttatgtgtggcaaggaagggataagtgaatgggtttacacctccggcagaatacgacgatatcctgttcctgtaacatttgtatgtacaaatgaacggtatgctataatcatggaatatgaacaggtacacgatattgcaagtacggaggaaattatggcgcccaaatatatacaagttaaacaggaaattttgtcctggattcattcatccaaactggaaccacaaagccagcttccatctgagcatgaaatgtctgaacaatttgccgttagtcggcaaacggtgcgtcaggcgctgggtgagctggtgcaggaaggctggctgtttcggatgcagggcaagggaacctttgtcgcgacacgggacagcaagcagcccgaagatccaaagacgattggagtcattacaacctatatatcggattatattttcccatccattgtacagggaatcgaatccaaattgagtcgtcagggctataagatgctgctgtcaagcacaggtaatgaccctgagcaggagagtcagtgcctggagatgctgttgagtcaaccgctgagcggaattattatcgaaccgaccaaaagtggagagcgtaaccccaatctgaactattatttaaccgtggaaaatcgccaaatcccttatttgatgatcaatgcgcgttatgaggaaatggatgcgccatgtctacgagtagatgatgaaaagggtggttttttggcggccgagcatctgattaagctgggacaccgacgcttggccggatttttcaaaaccgatgatatgcaggggattcttcgtatgaagggatttgtggccgctcaccgcaaatatggtgtgacactacacccgaacgcagtaacgacttaccggacagaagaaaaaaatgaggttccgctacaacgtgcgtcgaggctattggcgatggaggcgggagagcgtcctactggatgggtgacctacaatgatgagctggctgttcgactcctggatattgtacgttcggtgggcctgaacattcccaatgatctatcgttggttgggtttgatgattcatttttggcgacagcaacggaaatcaagctaacgacaattcggcatccaaaggaagaattggggttacgtgctgccgataccatgctgtcgatgattgaagagaaggggtaccatgaagaagatcgtcagttaattctacctcctgagctcatcgttcgtgaatctactgggcctgtccaggtcatgcctggagaacactaggctggaagatcagtcggttttatttcttaacatgtaaggacaagttagtaagtatacagctttaacgcttaatatttgatggcatgtttctcgtcataccgaacagtctgttttctggattgcagaaataggctgtttttgttatattttttctgaaaatgagtacataaatctatcgagaaaatacataaaaaaagactagctaagttgtacgtacaatcatataatgaaagcggaaccaaggataaagggtcgttaagaccttcctgtaattttccatttgaagttagtttcagtcacctcctccattgcagatttcagaaatgatagtaaaaggtgtgtcttatacatattagaacaattgaaaaaggaagtatggatctgacggagctgaaattgctacacatgtaacaccttaccgtcatggagttatggatgaagtgctgcctggtagcggacgcaaattggaaatggattgggcgctggaacatccggctgattatattgaagtgctgactatttctatacctgccgttatgaaggagactggcatttctcaagacgatatcatcgggatcggaattgattttacagcatgcacgatgctgccgatcgacgcgcaaggacaaccgttgtgctttgacgagaacctgaaagataacccgcatagttgggtgaagctgtggaagcatcatgcagcacaggatgaagcggaccgtttaaatgccattgcctcgcagcgaggagaggcctttctgccccgctatggagggaaaatttcttccgaatggatgatcgcaaaaatttggcaaattctgaacgaggcaccggacatttataatcaaacagaccgctttgtagaagcgaccgactgggtaatttcccagcttagtggggaactgaaacggaatcagtgtacagctggctacaagtctatttaccatcatcgcgagggttatccggatcgtgaatttttcaaagcgctcgatccgcgtttagaaaatttaacggatacaaagctgcgcggtgagatttatgatttgggtgcccgtgcgggtggattaacagaggatatggctgcaaaactcggactgaattcgggaacggcagtagcggtaggcaatgtggatgcacatgcggctgttccggcagtaggcgtcgtcacaccaggcaagctagtgatggcaatgggaacttccatttgccatatgctcctcggtgaggaagaaaaagaagtagagggtatgtgtggcgttgtagagaacggaattattccgggctattacgggtatgaggctggacaatcggcggtaggaggcagtggctgcgggagctgaagctggagggtacgacgatatcgtcgaagcagcgcgtcatatggctcgtgtacgggacgagagctttatgccaatccctgagaacgcggccgtgtatgataagctgtacgaggaatacagccgtcttcacgactactttggacgtggaggcaacccggtgatgaaaaagctaaagaccatcaaggaagaagccagacgttcaactgaaacggcaagcattcatttttaagaaactgacaaaatataagcaagaagtatttaaaactctgttatctaaaaagcacagtacaccgaggaatcggcagactgtgcttttttttgcattttatattctgtgaattacatgatgtgaaagtctcagtggatgaaagatggtaatgcgttcctttcaaagactttcatgaaaattacaatcgtttcggtttacggacatttttactttttcagcatggcatcagcaaacaaaatggattttggaatacggaaaaactgttccgcctgatcctggaaggtttgcgaaggaacggtaccctgatgcaaccatttccgaaatgtaccggggtgaacgccaatccaatgactcacatcggtcaccgaaatatcatgtaccatgcacagacccgccaagatccgatttttaaccggagaacgagtcacagtccgtttcataaaacgggacggcgatggttgacagatgagtggtgaacgccggacaacctcttcattaaatagaatatggtgcggataaccaagtgtattacacgtcttttccagattagtgttgccgggaatgcgaccttcatatacccacgcactgacactacgggaggaaatggaaagctcctcggcaagttgggacagtttaatgtcattagccatcaaaacggcaagcaaaacgcgattgcgcacttgacagcgtgttggtttacgaaaacgtttgacacgcacgccttttcccaaatatttgcgattgatcagagaccacgcctgaatggaatgtttatcttgttgtttaggcatataccctccgattttttttaaccacatactactatacccgaagggggctttgcaagtgactcctctcctgattttcttttaatcccatgggcttaaccggtttatggaaaataaggtccatttggcctataaaaatggaagtttaaggtgccgatatattaaattgtgacattttttatggaaatggaggtaatatgttcttctcttatgattgtaaggatgtacagagagaaaagtgggtttttgcagcccaatatgcaatttttttgacgagagaaagggaggttatacagttagatgatttgtaaaaaggtaatggtatggtttctgacggcacttttggcaacgaacactatgctgtgcttgcctagtgtggcaggagcggaaaaacaagatgtaaaggacggaatgcgactggaccaagcagatttggtacagaaggaacaggagatcactaatgaaacagtttcttttgatccgccaacttctgtaacaaacagcgtttataatgcactcatgatgagcttggcggcaacggtggagtatacgtcaatcattatcgaacctggggaaacctatgaattcgagaatacagatacgatcagtaagtccatatatagcaacgcttctcaatcaaaaggcattttgtacgatagtgtaagttacaaagaggacggagacatcagcactgtccatatggactatggcattagccccattggtgttcctgggggaggcacagcgtttattacgaatacaggaacagcagcattaaccgtaaaagtaacggacgtcttcacctacagtacatcggaggacccggcactagagcgagttacggtctctaaaaatgaaagctatcggattgtgaatgaaggatggactgcccgttcgattcagcatgatgggtcaaatgcagacaatcgccgttttgattacgcaaaatacaaggcggacggaactttatccgcatctgatcttaatagcattgctcatccctctttgggtgatggcgaggaactgattattacaggttccactgccaatgcggtgaccttcggatttccatacggcaaatacagtatagaaagcaccggcgagccagcttatgcgcgggttaccctaaatcagggggaaagctaccaatttatcaatgtgggaacccgattggatacggtggaaagtgacggtacatctaaagataaacttgactatgttgtttatttggcaaacggaacagaggcttcacgcggcagtggcactacggcgaagccgcagattgctgtggacagatacgcggtaattacccaggtcactgcaaatccggttacatacggggctccatatcgcaattttattgctcgtcctgtgggtggtgatgcaatcagtcgtgtggagcttgaggtgggcaagagctacattttccacaataatggtacgctaatgaatccgatctacaataactcaaaaaaggtaggaagcttgttcgactatgcgatttacaagccggatggaacggtaaattcctctggttttaacagccagtctggtcccatgatcccgccttcgggatatgccattgtgactgtgatcggtccgagtcctattatctttgactatacagatgatttttcctgggaaacgagtagccatcctgctttcttgcgggtaacactttcgaaaggtgaaagttatgcttttaccaatattagtgatcatttgaggaatctgcacagcacagccaaaaccgttaaaggaaaatatgatgtggttctgtacaaagcagatggtacagagcaatccaggcgcaataccgggaactcaacctttttggttggtgcaggtaaaaaggccagtgtgacggtaaccagtgacacgccaatcacgtttggtggtatctatcggagctttaaggccagcgaagatgataatggtatcgggcaaacgacgctggagccaggagattcgtacattttccgcaatcatgatagcaaatcgaattcattgcggcatgacaaaagtagtggaagtgcacgctttgattcggcaagctatcgagggcttcgtttactgacatcagatcatttcaacaatacagtggacccagagattgttgcaggcggtgaagccattgtcaccaatgtatccgatcggccaatcacctttagttacagcagtaaggtagaggctatgcttaacgcacaggcagccttccatcgaattacattgaaacgcggtgaaagccggaaatttatcaatgtaagcactttggacaaggctctggatgtcatttcagtcagcggtatgaagtggaattacatcaattacaaggcagacggtacggtgtacagtcaggccagtgatacgactcaattgccgttggtacaggctggtggatatgccattgtaacgacggtttcggatgtgccagtgacttatggagctgtattaggaatattcgatgttgaggctgccgaggtgccaacaggcaatcaggttaccatcaagcagggagaaagctatgtattccataatattggctcacaggcttcctcattaaccacagatgcttcagacacaagccgtctctatgactatgccatgtatggagaagatagcggtgtgaattccaaggtggatagagcaggtatgagtgtttcattacctgaaatctcacttggagcaggaggtacgcttgttgtaaccgtcacttcgccgcaagctgtaaccattcatttcaacaatgacattaaagcagatccaagcacagaaccagcattattaaaaacgtctttgtctggcggcaagcaggaagtatggatcaatcgcgggagccaggaagcacctgttttgacgaatgcgaaagcaacgggtggaacatatcagttcactgttgcagatcgtgttggaaaagtgattagagaacataaagaggcgacagacactcaacagcaagtgccggctaacggaaatattcatctcgccgtagcagcaactactcctgctgttaactttggagcaccttatcgtgtatttgctgtaaaaaataacgatgacagcaagctggacgagctcattgaactcatagaaaaggaagctgactttacggcaggtcagcaaggaaaatatcgttttacacccaaagaagacggaatttaccgttttgcggtgaaggagaaatcaaactttgctgcgcaacagccaattgtaaccttgtttacggaccctgattttagtaaccagcttgtctcttcaacagagcaagcacaaatatatggttgggattacacggtcttagagtatgagatgaaggcaggccaaacggtttatgtgaagctgacagaaaccaatagcggcgcattacaaaccgtaattaaggcagcacatatggcgctcggtaaggatacttcatatgaatatggaaaagggaaccgactgaataaagttattttgttcaccggtgatcaaattcaactggattatgacttaaacggaaacgtcattagacggacgaagaaggtatttccttttacagattaaaaggatgtctttgcttcgaaaaaacataacagatagttagatgtacaggcattattaaataggggtgagcgagtgtttaaacgttatatttgtagtctactatgtatggcaatgttgctgggtccatggagcacatgggcatatggagaagaaggtcgtggagaggcagcaacttctcagtcttctacgtcttctactccgcagattattaccagagcttggcttgcagagcaaacaggtaaggatcaggcgtgggtcaatgcacagttatccaaaggctatactctgtatgatatttataaagcatggcaaaaagatggtggagaaaattcattaccagaacaaagtccaagcttgtgggtacagcagaatggactgacattgagcacaaatacaaaggtggaaccatccgatgagtcgtctgcgctgaaggagggcgaaaagcccgctcagaccacccaggatgaaaaggcaactcaacatccactagataaggaagagggtaaagagccggctccaaacacgactgagatggatatcccatctataccccgagtaaatgattccgtatatgctccgactctaggagaaaacggactgatcgggcaggatttacttaaacaaagtttattgcaggtatctgctacaacagatgtgtatgctccttttgatcaggtggcgattgcacaaagcaggttgagtgatgatacgtcgcgttatggaatggattatggtgacaacagtgtgtccaccgcttcaggacagctcgttgttcaaaatacggatttggtactgccgggatcattgccctttgcactgactcgtgtgtataacagttcattggcaagtaaccagcttggtgtgcagcaaaatgaagggttgtatacaaacacaagtgcgatccgcgaggaagaagcagcttctggtctggggagaggctggaaatgggatcttcctcatatgcagaaacaggatggtaaacggtatttatatattccgggaataggctcctatgaactgcgagatgatttgaagcttgaaggatatgcatataaagacctgaagatcggaacagatcaaagcgcaagtgtgcagggagtaagcagtgcatacaaaatagcagtactgaatggaaacaactattatctcgatcaggacggttatttgattttgatccaggatgcgtataagaatcgagtggaatttgattatacaagttctggtggagcaaagcttattcgttcgattcgaaacaatgatggcaaagagcttgatttcacttacaatgctggacagcttgttgttaaagagcaaggcacggaccatcagtatacctatcgacaaagtagtgagggaagcagcaaggtgctgtcagaagtattggattctctttcccgaagcacaagctatgcgtatacattcatggatgctccttttaatgtggtcatagatggtgaaggaaagactggagccctaaagcccaatgaaaccgcgttgcttacacgaattgtacgacctacttcatcgatcacagacattcgctatgaagcctataacaagcagataggcgtgtacggtacacaaggcgtgttcaaggtggcttcacgcgctgatatgtacagtacaactgccggcgatcgttttttaaataaaattgatttcgcgtattccggagaagatctagccagttatggcaaaaatgctgagtggacggtggttgccaaagggacgcgtacaacagaaaccttccattttggtaaagtctttagaggagataacacaccagacaagcttgttcttaaccgctatgatcaagagggtgattctaccggctatcatataaattacacatataatgatgccatggactggaatttgcctgtgcaaatgcaagagtcgtatacggagggaggttcttcgtcagaacctgtaaccacctcctatggctacaatgaatatggtcttccactaaaagtatcccaaagtaccggattggagactgttcatacgtataaaacctctagtgagccttttttctgggttcaacctacccagacggttactaaaataagtgaaggaaaaactggaacgacagttcgaacttataaagcagagggtacattgtatgaactgaaaaactatgaaggtacagagcaaggaaagcttttatcacatacctatactttttacaatgtaaaagggaatgtaagtggtcagaaagttcttattgatgacagaaactatacggatgtttctattgattataaatctccctatggttctcagctcccaacaagacagcttttgcctaaaggtgttgagtatgcgtatgattactatccgactggagaaatcaagtcccaaaccgatgccaagcgcaaaacagagtcctacgtatatgacgctttgggacgtgtaacgaaggttacttatccgaatggaactcagacggttgtggtgtataaggatgatacgaacgatgtcaccgtcaccggaccagatggagtaagtgctgaaagaatgtataatccattcggacagatactccagcagcaggtgggtgatgcgatttacggatatggttatgatgatcatggagatatggtagaaagcacggatgctgaacaagcaaccactcgctatgcctatgatgcctttggacgacccgtgaagacgacctatgcggatggcacaacagacaccgtgacttataatgcagtggatcgtactgttactcagacggatgcgtccggttatcgtgtgcgtgaagtatcagatgctttaggtcgtgtgacttccacacaagaagctaaaaatggatcatttcagccgctggaatcgttagcttataattatgcggatatggtcactagccgtacagacggtaacggccaacgtatgacctatgattacgatgcactgggacaaatgacctccgtcacagatccatctggacaaaagaccagctatatgtatgatctggccggaaatttgaagaccgttcagtatcctgatgggcaaaagaatatgtattcctatgatgagctgggcagacgtatgttactggaaaaatcaagcggaggaacaacgctcaatatttatgatacggatggaaccatcacccgtatgctgacaggaaaatcgcaagcgattacctttcaatataactcgtacgggctggttaccgaagcggcgggaccggattttaaaaccaattatacctatgaccttgcgggacgccgaaccagcatgacagatgggcagggaacgacctcgtatgcctatgatccagcagatcggtcgttgaccgggctgaagtacccggatggcacacaaataacctacgagtacaataagcagtctcgtacaggctatgtgctaacagacgcagcaggcacgtctatgcacgttcaatccaagctggacagtgtgggccaagttactcaaatggacattagcgccggggctggtatagcaaatgtgcaaagcttgggagaagcgagtgctgctgcgggcggatcattggatcatatgacatttgagtatgctccgaatgggttgctgaaaagtcagtcttcaagcagaggattgagtacgcgattcagctacaacggactggatttgtccggggttacggtagaacaagacggtacggcgctgcaccaatttggttatgagcgggatgggaataaaaacatcatcggacgtacacaaaacggaaccacggatcaatttggatatgatccgtccagccgaatcgccagcgaagccgcaggtgagaagaataagacctacagctacgatccgaatggaaaccgaagcaccgaaggcagcggcaaagtgtttggtatgacaaacgccagttatgactatgattccgtcagtcgtctgacccatgtgagcggtgaaggcaaagaggtcagatacagctacaatggagacggtctactgtacgagcgtacggaggatggtaaaacgactcggtactactacgacgaagaagcgaagctgattgcagaagccaaggttgaaggtggaacagcgaagatcacccacgcctacgtatatgacttgtccggtcaactgtgggccagacaggacaagtcaagcgggcagttgcaatattatcagctcaacggtcatggtgatgtgataggcctaagtgatagttcgggcaaggaactgaatagctacagctacgatatctggggcggcccagagaaggtcaaagagaccgttccgaacgtgctgcgttatgctggcgagtattgggatgacacgaccgggctccagtacctacgggctcgctggtacgatccaggcacagcgcgttttatgggtgaagatacgtatcagggcgagagaaacgagccgcagagcttgaactggtatgcgtatgcaaataataatccgttaaagtatattgatccaagtggacataaagtttggctaattcacggtacttgggctgattcatctacatgggacgatagtaaggtgtatattgaaaaagaacttttccatgagcagatcgagactgtggaatggagcgggaaaaatagaaatggtgcacgagttgagggggcagaacgtatagcaattaaaatttataattggcacaaagaccatccgaaagaacctataagaattatgggacatagtcatggaggaaatgtttctataatggcaataaatattttggctaaacgtgggatgcatgtggaaacgcttgttactattgcaacaccagtacgaggatataggctgaaaacagatgtaggacaacacattaatgtatacaatgattatgatcttgtacaaaaagaacttggaggtagtatttacgctttggggcaagcaatgcgcacattcagtggcgctgagaatgttaaagttaaattgtcgtcgtattattctaaccatcgaatcgaagctcattctgtaatgcacaataatcctaatattttggataaatacgtaaaaccacgagtgttatggcacaacttttctaaagccagatatgaaagttataaaaagaatcagaacaggtactaattactaaaaacaatttgcttattatgtattttgggataaatattttgttaaaagcgtttaaatgtaaattttttaaatattagtgacattttagcgagactggagggaaggaaatgaaaatgcctatttggtttaaaataatatggatgattcctattgttataaatatagcggcgttcatatggtttattttaggttcaacagggggctttcaacgtgggcatgatatcttggcaactgctacattagtcatatttggagtcccgtctattattatcgtattaatatcattaacgtatatatggcaaggatggccaccatttaatggtgtgaaatatttagtatcagcgatattgatggcatctttattattttgttcttattatttggttgatgggactcctacacgaggatggttatatgatgatgttagaagtgatcctgtgcgattaacatcagatcataaatacgagtatcgtattgatctaatcaatccttttcaaagaaatagtcgggagcaattacatttgaaaaatgtatcaacaggagtagaagtgaacatccctatcgttataagagcagaaagggatatctactctactggaggtagcgagggctgggattggggtgttttaaaaccgacaaaagtaccgaatcaatacgagctgtctacattggatgaacataacaacggtaggtatggtatggatccgagagtttttttaattgatgtagaagctggaacagcacaggtattgaagtaggatttgaattatttaaccacaatacgagatagtttcgtattgtggtcttttttcattattagttctgaattattaataaatcactaaataaccttaatacaaatgaaaatatcaactgcttactacccgggttagttacttaacctacaggacaaagaataggatctacgtctacgatcaaaacggcaaccgaagtgtcgggtccggttatttgtggtcaagaaaaggcaagcgggcaattgctatattatcagctcaacggtctcggtgatttgctaggctagaatgatagtttgggcaaggaactgaatagccacagctacgatatcttggggaggtacagagacggcctaagagaactttcagaacgtgctacattatgctgacggagtattagcaatcctaaagcttgaactagtatgcgtatgtgaatagtaaccctttgaggtttattgatcttagtggacatttcctttcggtgatgggatatgcactggttaacaaagacactagcctatggagaggagagcgggaatgatatcccacaaacagtggttactcagatgccatgatgattctgcaaatgcagttgcaaataaaaaaaattccattgcatttaatcctgcagtaccttcattaggtaaatatggtttttagtgataagcacttacgcactctaaagcatacaaggcttggcaaatggtcagaaaccataaaatggactccgtaataaatgctttgaaggagaagaggtataaatgaaagtgaaaaaaatattgttatatctaagcattccgttgttgttgatatttgcaatcatattgttcattgctttaccttggcttctaatattcatagggaatcaattagaacctaatccttcacaccctgaaatcacatatgggaaatttccatttcgtttggaatatgaaattaacgggcaacgagaggttattcaagatactttaatatgcgaatatgatggcattggttcaaatgaagctcgcggcaaatatcgtaagtggaaggaaagattagccggtggagatagattactaccggtgctagaagtcaatagcagaatagaaatatcctattatccagggattgcagagtactatatgggtgatttggatagcaccgacgagtatcagcaaaccgttgctgactctatatttattgaacaagaaggcattatcattaaaaaagatggaagggtttttgaaaatgatggaaggactattaacactcaattttccaattcaaatgaattacttgataagtaccatattaaactgataagctgggactctaccccaccaatcaaggataattttcctgaagccaaataacgagtaacttaaaacaaaattataaagcacttgaaattccttatggtgatttcaggtgctttttttgcgtccccgtataataattctataaatctagtaacataactatgacatttggaggatatagcttctttacaggagaaggcatacaatccatttcatttttatccttctaaacacagtcgatttattcacaactttgttacttatttggtaagatggattgcgagattgttttcgaattgttttactatatttacctactatagtctggtaatctattaatatatatagggggaacgaaaagacgtcaggttcagtcggttcatacgcgtttatgttctatatgttgagtgaatgtctatattgccatgtctatatcgtcatgtctgtataacttcatagacaagctagagatagctcccgcacattataaaatacagcacaggatggtgtaatgaatgaagcttttaaatgcaaaatggatggctgtatgcttgatggtaatctgttgtttgggtttgctaggtatacatacgaatacggcgagtgcacaagcgaaggctcctttgctgggggtcaatgatgtgttgctagattcgaataccattcagcccgtaatgaaaaatgataagttgtatgttcctatcgttacattagggcaaaagatggggatttctacttcggccaacggaaatacattggtactgactggacataatcgcagctttacgctggatttgaacaagggggatgtgttcgagcgtggagatcgtacaatggtgcccattcgcactttgaccgatgcgtttggcttcactattacgcttccaacaagtaatctgtatcgaattcagaacgcaaatgctagtttgtctgatgctcagtttttgaatacattcgcaacagaaattaaacagtatgcagctgtcaaaccggacaaagccagcaatactggcaacaagggaactgcctcatcatccagccgtacgatttatttgagcttcgatgatggtcctacggcgcatacgtcgcagttgctggatatcttggacaaatataatgcgaaggctacgttcttcatgctgggacctgaaattcgtcaacatagcgcagtgatgaaaagaatggtagaggcgggtcacggtttgggcttgcatgggatgacgcatcaggtgaagaaaatctatgcatctcctgcagcagcattagcagagatgaatcaggataacgaaattttatttaaggctacaggaaaacgcacttctttgattcgtacaccttatggcagcaaaccatatttgaagaaagcataccgcgatcaactgacgggcgcaggctatcatatttgggactggaacattgattccaatgattggcgttatactaaaaatccagagcattttgtacagactgtcctaagtgatattaagagattgaaaaagcaaggcagaacaccagtcgttcttatgcatgataagccatctacgatcaaggtgcttccacaaatcatggctgctttgcagaaagaaggctattcgttcgagccgttaaatgataacatgactccgcttaatttttggaatgatcatcgttaattgaatagcatgaaagaaaagacaccttttcaaccatttatatagtggttttgaaggtgtctttttgttgtatttgctcggagttgtgaagtttgcagcacgctttatatgaatctatgaattcatgtctatgcacaggtcatatgactttacgggttaccatgtcgctgcatatattacagtaaccgccccgagaggaggagaggtatgaatattaatccgagtatgtttagtatgatttgcgctaccgcaggagcccttattacgtttgcctttggcggttggaatcagctaatggtgctattcacggttgcaatggctgttgattatgtgactggagtcgccgcagcaattaagactgggcaaggtttgagcagtaaagccggcttttgggggctggcgagaaaggctttaatgctaatggtgatttctttggcgcatcacgtggatctcctgatgggtaccgaaatcatgaaaggggcgacgacgtatttttatttatccaatgaattaatctctattacggaaaactgttcacgaatgggtctgccgctcccaccgaagctcaagaatttttttgccctattaaaggacaaggagtctgatggtaaaaatggcggaaaagatcgctagaattacaaagtttctttccgtatgtggggcgttatgataaaattttcaagagaacatttttaagataaggagcttatacgcatgattaaacatattgttttgttcaaattgaaagaccgctcccctgaaagcattgagcacacagcatccattttgcgcagtatgaacggcaaaatcaaagagctgctgtcactcgaagtaggtacggatgtgattcgttcggaacgttcttatgatatttcccttaccgctgttgtcgaaacactagaggatttgcaaacgtatcaggtacaccctgtgcatcaggaaattattgtacacatgaatgaagtgaaggatgtatctatcgcagttgattatgaaatctaaagcgattactggaggtgcaggaccttgtattatgtcaaccgggaacaaattgagcttcgactaggggctgttcccgacattgtcgccggacttcgccagacttctgctgcctggaacggcgatctgttgcagggactagtgcaggagcgctgccttcatctggcgattgagacggtaacggacgtaggaagctatatcatcgacggatttattatgcgtgacgccagtagctatgaggatattatcggtatcattcatgaggaaggtgtactggatgataccgtatttcattcgctagtagagctggtaggcttacgtaaacctctagtacaggagtactttcattgggaccggacaagccttcacccgcttacaccaaagctgcctgggttgctggagctttttgcatctaacgtgcatgattatttaaataaggaattgggtccccagcccgagggagtgtaaaggcaaaagtgacggataagtatatcgtacccgaaatgcccactaggcgcatgatcatgacattattgaaaacccagggacctgtgggcgtcggaagcttggcagctcaattgggcattaccgaaatgggagtgcgcaggcatctcaaattgatggagcaggatggtctgatcgtggctacgatcgtgagacaggcgatgggacgcccgacgtttttatacagtctgagcgagcagggaagcgagcagtttcctcgtaattatgatcatctgttactggaactgttagaggagctggatgaagaacagggaatggaagctgtttactcgctgtttgatggtagaaaacgtaaaatgatgaagcgctacgcccctcacatggagggggagactacactggcttcacgtgtggaaaagctttcgggcatccaaaatgcttccggatatatggcagagtggcgtgaggaagaggatggtagctactctattgtggaatacaattgtcctatctctcaaattgcaggccgttaccgcaaggcttgtgaatgcgagcagcaaatgtttgaggagctgcttgatgccgaggttgttcgtgaggattgtttagcggatgggggccgctgttgcctgtatcgtatccgctctaaaaaaaagtaaaacttttcaggcttgttttctgtatcatgacaagctctccatgcttataatgcactaacagatgggcattcgcccgggcacaagggagagatgatgatgaaggagaactgcaaaagttttatccgaggcgcgttggcaggcagcattgttggttcggttgctgctttgttatttgcccctaagtcaggtcgtgagctgcgtcagaatattacagatcaggcgcgcaacgtaagtgataagggacaggagctagcggggaaaatttcggacacctcaattgagtatactgacaaaattaaggagacagcctcagccgtcattcatgaaatcgggcaatggcgtaaaaagggtgaaattgttcctgaagttagtatttcatcagcgactgttcaagaagatacggaaaaagatgctctgtaacggtttgtaaaacgtaggtgaaacactgaatacagtttgaattcgtggcttctcccgttggggtggagcctttttattgatcacttcctcgttttagggtaatcttttggggtaccttttacacgaatacgacataaggtatgtagcaacggatagctttccgagatgaaacaactcatatttgaacaaaaaaggaagcggtgtgtacgtgcagcaagcgattgcaatattggattccggtgtaggaggtttgacggttgtaaaagaagtcatgcgtcagcttccgcgggaaaaaatcatttattttggagacactgcgcgcactccgtatggcccccgaccatcggaagaggttaaaaaatttacagagcaaatggttgattttctgatccaatttgatccgaaagtcattattattgcttgtaacacggctactgccgcggcattggactatataagccaaaaggtatccattccggtgattggagtcattcaccccggggctcgtgctgcgatcagcgcgactgctaccgggcatgtcggagtgattgggactgtcggtacgattcgaagcggagcgtatacagctgcgctcaagcaattgtctccttatgtagacgtggtgagccatgcttgtcctgcgcttgttccattagtggaacaagggttattccgctccaagacgacatcgcaggttgtggaggagacattgagacctattcaaacgtatccgattgattgtctgattcttggttgtacgcattatccttttttgaaggaaacgattcaagaagtcatgggacctgcagtaaagctcattagctcggcagatgaaacggcgcgtgagacgagcaccattttgtataacaaaggcaagttggaagctggggacgaaacgccggtacatcagcttttttgttccggcgatcctgaattgttccagcgcattgccgcacagtggctcggggagcaaattcgccaaacgcctgtcgtctggcaagtcaccaatttggattaacgagacaaccgactttttttgtcattggacaaatgaagtcggttgttttgcttttcgctacatcaagacacgccgcgtctgcataacatgcagtaaggcagatggaaggggcgtagtaagatgagggaatatatcgttcaaaaaggagatacattgcaccgggtcgcctcggcttttaaactatcggcggatactttgatcgtagataatccgtgggccgccacgcaaccctatctgattagtggtcaagtgttatatattcgtccgtctacggatcgtaaatacgttattcagcctggtgagtatgcaagacagattgccaagcagtttggtgtggagcttgatgagttacggctagccaatctaggacttgcggagcatgattttacggaaggaaaaacaattgttattcctgaagaccatcaggatcagattgtacgattacgtggagagtatggatatgaagatttaaaggaagacctagcggccttggcccacagatatccatttattgaagttggcagcattggcaccagtgtcatggggaaggatattccttatgtacgtattgggcagggaacgcgtaaaattcatgccaatgcttctgttcatgctaatgaatggctgacgacgccttgtttgctgcgttttatagagcaatatgcacaagggatcgataggactgaagaacatgcagggacctctcaatgggtgtatggaggttctccgcgggatctgctggagcatacatccttatgggtggtcccgatggtcaacccggatggggtagaactggtgcaacaaggtgtactcccaactcatccgttgtatcatgacctcgaaaagtggaatgaaggacgtgctgattatcgcggttggaaggccaatattcgtggtgttgacctcaacgatcaatttccggcatattgggaagaagaggtacgcagacgcggtaaaacaggtccgtctcgacgagactatgcaggacctgcacctttgtctgaaccagagtccaaggcgcttgccgatctgacggagcgcgaacagttcgacatggtgttatccatacacagtcagggacaggagatctattggaattaccgggatctagagcctaaggagagccgagattgggccttacggctagctgccgcaacagggtaccgggcagtaaaactgggtggtagcgatgcagggtacaaggattggtttatacagcgatttggtaaaccagggtttaccgttgaagtcggtctaggtgtaaatccgctgcccatgcgtgattacgatgatattgcagcagaagtgggcatgttaatggcaacagtgctgtcatggtaaaaaattcggcctactgaaacgtatcgaatcatttgcgcgtattaggaggaacacgttttttataagtgttcctctttacatgtcccttcaatggggtatatttacttaggagcattggaaatggagtgaacaacctatgaagtggaaaagactactatctctccgtcaatggtcacatgtatttcgtcgtatgccccgattgattacttcatcaaggattccgctgggagaaaaattactctttgcggtgcctgtgttgctctattgggtattacctgatgtcatgccgtttatgcccatcgacgatattggtgtgacgctattgcttatgaattggtttgtcacccgtgccgaacgaaaatatccagatgtgcttgaaaaacagcgtgtacgtgttcggtagataagcttatgaatttcgtgattgcgatttttcacgattttctttacaataggaatattgccttttgctatgctgaacataattgtgatctattggctcataatgatgtttcaggcgcagctgtgccgccgtagtacctctttccctctgggatggaggctaattatttgagttgttgattttacccgctaggttgtgtggtgtggatatgtatccaatgaaccacattacattttatgaatatgaaggagatgaagtttgatgaactgcaaaattactcgtaacgcagctaaagtattgaaacttgaactggataaggaagagaaccaagggaagagcctgcgcgttgttattactcatgctcatggagatcatgctcattacgggctggatttggacacgcctaaagaaacagatactgttgtatctacagataaaggcattgacgtcattttggaaaacggccagccgctgctggatggtgtaaaaattgattacttgtactttcccgaagaaggatttgtcattactaacccttcccaaggtaatcacggcgaccactaagccggagctcggagggatgacagatggccaatgatattcgcgtatgtgatgaatgcaatcatatccgcttgaaaacgatcttgcccaagttgcaaaagatggcaccagatgccgagatcaaaatcggctgcaaatcgtattgcggtccttgtgggaaacgggcgtttgtgtatgtgaacggacgttatgtgagtgcggccacagaggatgaagtattggagaaggctgcgcgctttatcaaatagttccagtacgcagcatttgcaatttttgaatagttccccttcttctgatccatgctaatggatgtagaacactgcccagaaggaggtgtgactcatggcccaatatgattccaatctcgacaatcacagcgttgaggctcaaacacaaaactcggtggacaggctgcacaatgccgtctctcaagcattgtcacatccggctgagcaactgattgaacaggcggagcaatctcgtactcatgcggaacatgccatacagcaggcgaaggatagccttggtgacgatgcagtagaagttgcggaggacatgcttggtgaagaggtacaacggcttgaacaggctaaaaaaacgttgcgttcctaagcatttgtgaatggttacgagcgcagtcgagtcacaatccatataaaaaagcacgatccacagcgtacaagctgatggatcgtgcttttttgttatatgcagggcggttatgcgatcggcatccttaaaagagttcggggaggatgttatgtcagcaacctcccacagaaagtctattagatacagaaggagttacttctttgtttgtggttcccattcgcgaataagatcgtatgtgataacctgatcggatatgttcaatcgattgagggcttcggtatagcccggtccgcaggcgtttacatctgtaggctggcctgtattcaggttgtaacaggtccctttggagaatgtaccgtcctccgatggaatgtagtacactcgtccatcggtgaaagcaccagtacgcagcacaaccatacgaggcttcccgctaaacagatcgtttcccataaaatgatatggttttgttgaaatcccaagtaggtgcatgacggaaggagtcagatccaactgacctgccggttccgtatacgtgcctgcctggcttccatccggaagatgcacaagcaatggtacctgattcatgattttctgcatgtcgagatccgtaagtggcttgtctaaaaacttctcatacagtgctttgtctttaatagaattgtcatgatccccataaaacatcaggatcgtatcatcccacaatccgtctttcttcatctgatctaccaattcacccagtgcttcatctacataatggacagatttcagatagtctccgaacatggtaccttcaaactcgccaacatctaaatctaccgcgtcaggtgacaggttgtacggatgatggctcgagataccgaccatataggcgtagaacggctgcttaacttcggtggtgagatcattgagcgtttgatggaaaaaggatttatcccccagggaccaacccagtggctcatctattttaaaatcttttttactgtagaacttgtcatagttcattgccttatacatggtgtaacggttccagaagctgctgtcgtacacgtgaaacgcattgggactatacccagtatccttcaaaatggaaggtaacgtatcgaatttatggtccgcataacggataaatacggagcctgtagggagcggatgcagcgaagcatgtgtagagaagtccgcgtccgaagtacggccctgcgcagtctggtgaaaataattgttgaaatacatgctttccttcgtcagtttgtcaaaattaggcgtaatcgcttgaccgttgatctgtttgccgataaaaaagttcatgaacgcttcagcctgaatgaccatcacgtttttgcccttatacttgccagatagatcatttttaacctgaagcaacttctggtgctgattaaaccattccttatctttatcggattctgcttgagccaatgtaggctggggaccaaggtgatcctgaccatagcggtagatgtcatatccatgaaatccgaccaatccggttacgttgtacaaggccatcgaccaccagttgccgacaaatatgccagttgcccatgtggaggtataatatttgatcggcccaaatgttaatacatagccaatcaggaaggccaatgctcctttggagaagcgaagcagaaatctctttgtgaacgagcttcgggatgcttctaaataagtatcattcgttgtaagtcgacgtcgtaaggaagccacaaatatgacatacggaatgaatagaatccagtctgcaaaaaagaaaatgtcccaccagtacataagggatgcgatacttccgcctagagaatcaacttgtccggcttgaagtaagacgggaatcgtaatgaaatcctggaaataacgataataaaccatgtcggaataaatgagcgcggtgagcaacatatcgagcaccacaagagcaatcaaacgtccgcgacgtggcagccataaggtccagaagctcacaagtaaaagcgaaccaatagcgatgacataatccagcggattcatgtcaatattttgggcatgcaagttatagtgaatcagtacgagcttgccgatcataagtacaaaaaacagacctaatccaaaatattgagacagcagcattctgctgaacgtgttaccagtgcgacttgcactggacgtgcgaataagcaacactttaccccctctggcagaaatgttcggctagtataaactacatattaacgtaatgttaaaaccgaaatgcctttaattattatagcgctcatctcgcgcatttcaatgattaagtaaagaaaatacagcacaaatcaggccagaacaacgaacagagagttcgtttcctggcctaggcttcatcatatttaaggctgcaacggcgaagtatctttgcggcgcggaggcagagggcctagatactgatagtattggcattcgatccggccgttaaacaacttccggcgtttgtctgctttacgaccccaataatgctcaaattgcttggtggagctgatggcaaagaaggaccaagtcttcatttcggctgccgtgcgtgcgagtgaacggatcagcttttccacctcggattgctcgctcagtctctcgccataaggtgggtttgtaatcatcacaccatattgtccttcgagtctgactttagttacaggcatcaccttaagagggatgtctttagcaaagcctgctgcttttacagctgcctcagcaacttgtatggcatttgggtcgatatcgctacctgcaatttcaaaaggaatgtcatcgcgggtcaaatccatcgcctcgtcgcgagcctgatcccataattctctgccaatgacaggccagtcttccgagttaaaggtacgtctcaggcctggcgcaatgttccaggcttgcatggcagcttcgaccaacaaagtaccggaaccgcagcatgggtcatagaatggtcggtcagggctccagcgactaagctgaataagagcagaagccatcgtttctttgagaggcgcctctgtaacgagcttacggtagccgcgtttgtgcagtcctggaccggtcgtatcaagtgtcagcaacgcacgatcattcaatagaatgacctcaatgacgtaacgagggccatcttcagcaaaccaatctgtgtggtaggtttccttgagcttctctacaatcgccttcttgacgattccctgactggctggtacgctactaagctgtgatttgtgcgaacgtccctctacgggaaattcaccatctacaggaatccaatcctgccaaggcaatgctttggtaccctcgaacagctcgtcgaaggtagttgcagcaaattcacccatttttataagcacgcggtctgatgtgcgaagccacaggttacaccggcatatatccatataatctccggtaaaaacgacgcggccattttcaacggtcagatcttcgtacccgagttctctgagttcccgggccacgacggcttcaagtcccattggcgcagttgcaattagttgcagttgagtcattaaacgtattcactccgtccccataatcatgtaagcttggttcaatccctatagtataggtcattgtactcgaagagacaaatcattaagctgaaaaatttacgaaggacaccacgtccaacctgcgttatgattaagcaagaaggagagatgaaccgtggaaattacaccaaatatgacgcctgaacaatatgtagaccagctggtacaagaggatgaagcactgcgcagtatcagggaggctatcgttaaagaaggtatgccggaagtatccgttgcccatccttacggaaaactgttgacctttctaattgaagtatctggcgcacagcatgtactggaaatcggcgcattaggcggctacagcggattatgtctggcccgtgggctgggagaaaagggtcgcattgtgtcactggagctgaaagaagcgtacgcagcgctggcacatcgacatatggaaaacaacggctacggtgaccgtgtcgaataccgtatcggacccgcagcggacagcttaaaggaacttcaggaagagggaagaactttcgattttttcttcatagatgcagataaggaaaattacccggtgtatctggaatatgcgattgctctggcgaatccgggtgccattattgcgggagacaactgtttccttcgcggacggacgctgaatacggataagaacggccctgccgtccaagccgtgagacggtttaacgagacgatagcaacagatccgcggctggtcagcacgcttttgccagcttacgatggattggcgctagctcgagttaaatagcgttcattccatatgtatagctatgtaaaaaagaacctccttgtccacagcagcgtgaacaaggaggttcttgtctgttaaggcaggcttgtcttaccctaagattatcttacctgaaatcaggtgtagccttacgatcaaagagcttcatgcgtacccagaatatgttaacgattaacaggacacctgacatgataaacagtccttcgatgccgataaacccggatagcaccccgccaatgacagcacccagcatattccccagcgccagtgaactcgtattaaagccgaaagaacggctttccattccttccggtgtatacgtacgaatcagcgcatttacgcttggtagcagaccgcccataaatacacccatgaaaaaacggataatgacaagttgccatacttcattgacaaaagcctgcggaataagcataaccgccgttccaagcagtgcaatggtcaagatcttgtgtgctcctatcttgtcactcagtcttccaaggagcggtgcagcaaccatattggatacacctgtaatagccgtaacaaacccggcaatcagcgcaattccttctgccgatccatacagcttttgcacatacaacggcagcagagacaccgtactgatcatggcaaactggagcaaaaacgttacggtgaacaaagccggaagctggggcgtatggcttaactcctttaatccggcaagaaccgaaatttgtggtatgcgtgcagcttccgttttgctgaaattttctttaaccaaaaacattgcgataagcgaggctataaaaattagagtgcctgtaatataaaagatcggtctgaatccgacccagtcagccaaaaatccgcctagcagaggaccgagaatcgtgccagccatctgaccggattgcataattcccatagcgaatccggttcgctctttgggagtggtacccgacactaaggaaatcgatgccggattgaaacccgaaatcgtaccgttcagcaggcgaagcgccagcagttgccacgggtgggtgaccaaacccatacatccgatgaccaaagccataccaaagcctgagcgaagcagcatgactttacgtccatatcggtcagccagcttcccccacaaaggctggaacataaatgaggtcaaaaagttagcggcaaaaataactccggcccatagaccaatatcgtgctctcccttcacatgaaggtcctgagccagatacagggcgaggaacggagtaatcatcgtaatacccgcattgaccagaaactgaccgaaccaaagcacaatgagattgattttccatgtctcccacgttttcaatgtgctttcacttcctttctgcccattctcatcctgttgtaaatcctacttatcaaagcataacttctcccgagctttaaaaaagccatttctctagtatagcacacttcattgaaactttatccaaatgtcatgggtttgtcatggtttgttcgagagctgcggttgttacgactcttgaaaaagggcataataaaatatagtatttatgattcgaactggaggctgaagtcatgacctacaatgatacttttatccgcgcttgccgcaagcaagctgtggatcatattcccgtatggtacatgcggcaggccggaaggtatgaccctgagtatcgcaaaattaaagaaaaatacacgttgcttgaaatatgccgccagcccgagctggccgcagaagtgactttgatgcccgtgcgcaagcttggggtagacgctgcaattttatattctgatattatgaatccggtagcctcgctaggggttgattttgatattgtcaaaaatattggtccggttattgataatccgatccggtcagctgcagacgtaaacaagttgcgtccgattgatgtggaacgcgatttgggtcatattttggaaacgattcgtattttggaccgtgaactgaacgtgccattgattacgttcgctggagcgccttttaccattgcaagctatttaatagaaggaagaccttccaaaggatatattcgcaccaaagcgatgatgtatggagagcctgagttgtggcatcgcctgatggataagctaggggacatggttattacatacgtgcgagctcatatcgctaatggcggtaaggcttttcaattgtttgatagctgggtaggtgcgctctcgccttatgattttcaaacttttgtgctgccgactatcacacgtattttccatgaattatctgatctggatgtacctaaaatttatttcccgggcgtaagctctggtgaattgcttccacacttgaatgggttaaaagccgatgtgattggactggactggcgggtaagtatacctgaaggacgtcgtcgcttgggcaacggttttggtgtacagggaaatctagatccttatgtgcttactgcgccaatcgatgtgatcaagcagtatgcgaaaaccattgtagatgaaggcatcttggagccaggttacattttcaatctcggtcacggtttatttcctgaagcctcgctagataagctaagagagcttacgaattatgtgcatgagtattcccgttcggttttgtcaaaaaattaatacattagaaatgttaagaggtggtctactaatgaaaaccaaagtgggtgtactggtcatgtcctacgggacgccggagagtctggatcaggtggaagcctattatacacatattcgtcgtggtaatgctccttcgccggagcaattaaaggaattaaaggatcgttatgaagctattgtgggcggtgtgtttccgctacgtcagaatacggatcggcaggttcaaaacctgcaggaaaccttaaaccgggaaaatcgcaacccggacattgaatttgtctgttatcagggactcaaacatgcgaaaccgtttattgaggacggtgtggaagccatggtgcaagatggcatccgtgcagcggtaggtgtcgtgctggctccgcattattccgttatgagtgtaggcacttatattaagcgcgcgcaggctaaggcacaggaactggatctggccatatcatttgtggagagctattatcttcatcctaagctgattaagacgctgactgagcgtgtgaacgccaaactggcgctttttgaagaagctggagccaagcgggatgaggttcgtgttctgtttagtgcgcacagcttgcctgaacggatattggctatgggtgatccttatgtggagcaattaatggcgacttcgcaggctgttgcggacaaagcgggaattaccaactggcagtttacgtggcaaagcgctggtcgtacagcagagccatggttggggccagacattttggataccatgcacagccttaaagaggagcaagtggagtatgtgctggctgcgccagttggctttgtttctgatcacttagaggtgttatacgatctggatattgaagcacaggcgttggcgaaggaattggatatgcgttttcagcgtattgattcactcaatagtgatccactgtatatggagacgcttagtgatgtcatcatagaccaatggaaaaagggatgaggacataatggagcaaaagttacgtaatattgtgattgtaggcggaggcttgaccgggcttagcactgctttttatacacgaaaaatgtacaaagaagctggctacacacctcaaatcacgctggtggagaaagcttccgtgctgggcgggaaaattgaaacgctgcataaagatggttttgtaattgaaaaggggccagattcctttctggcccgtaaaacggccatgatagacctagcaaaagagctggagctggatcatgagctagtgagcacaaatcctgaggctaaaaagacatacattttgcatgaaggacagcttcatccgatgcctcctggcctggtgctggggattccaacggagctaaaaccctttttgcgcagcggattgatctctttaggcgggaaaatgcgggctatgatggattttgtccttccgcctcgccgtgtaccgggagatgaggcgttgggtgattttattgaacgccgactgggcaaagaagtgctagagaatgtaaccgagccactgttggcagggatttatgctgccaacatgaagacgctaagtttgcaagcgaccttcccacaatttgctgaggtagagcagcaatacggaagcctcattcacgggatgatgacaggtcgaaaaccagctgaaacacatacggggacgaaaaaaagcgcctttttgaccttccgtcaaggcttgcaaagtttggtgcatgcgttgctgaatgatttgtatgactgtgatttacgcaccgggattgctgttaccgaattcacaaagaccacagaaagtgaagacagcccatatcgcgttatgctggacaatggagagacgctggaggcggatgatatttttgtaacgactcccaactttgctgctgcaccgctattgcgagatcatgtcaatgtggctgcactggaagccgttaattacgtctccgtagcaaacgtggtcatggcctttgataaaacagatattgagaacgtctttgacggttctggttttctggttcctcgcaaagaaggacgcagcgtgaccgcttgtacatggacgtctgccaagtggctacatactagcccggacgataaggtgctgttgcgctgttatgtagggcgagcaggagctgaagacactgtagagttaccggatgatgagctgattgcactggtacgtaaggatttgaaagagatgatgggagttacagcaactccgctgttcacggaaattacacgtcttcgcaattccatgcctcaatatccggtagggcacccgcaggctatagctgatttgcgggaagagttacgcactgccatgccgggagtatatgttttgggcgctggctatgatgcgattggtttaccggactgcatccgtcaggctaaggaatgggcctcccatgccgtccaaacgacacagcaggaagcggttaaggtacaggtgtaaatgttcgatgatgaacccttcgcgatccaggcgaggggttctatttatattgaaatttgatatacaatggagaaggtgtaaaattcgccagctaataaagaagttatgcaaatgcaatagcatagaaggagtgaagaatgtaccctcccagatcacagcgaaatgaaggtcgcaagaaagcaagaaaaccaaaaataggcaaggcttggatctttacgaatctggtcctactgcttatgatcgtaggtcttttcggttattattacatatttgaacacgacaacagcggctctcttggggaaaatgccgggtattcgcaaacggagaagaaaatccaaacggaatctgctagtgaagagaggtctactccctcggtcagtgaaagtgatacagccttgtcaaataaacagctggacgaaggcccacatgcagataagcaatttgctgacgatgaaacaaagcaatctgctgtttcagacacaagccatcgtcccgcgacaacgtctgacacaaatgctcccgaaggcagctcttcaggagcaaaattatcctcagggaaagacgggcaggcagggaacgatatgtccaaggatgtatatgacggtaatccatccgcagataagggaggaacggaggatgtaaaaaaatcaaaaacagacgatgcagattctccgacagtcacgcttcactttgtaggggatgtgcaattttccggtaaagttgaacagcgattggagcagaatgggtttgattttccgtatcaatatctcggaaacttgtttcataaagacgatctgacgatggccaatctggaaacgcccgtgacaacgaatggtgtgggtgcgttaaataaaacgtatgtgtataaatcttcgcccaaggcgttaactgcgttggctgcggcagggatagacgcagtcaatttggccaacaatcacattttggatcagggcacaggcggattactggatacactgaaatatctggatgaaaaaggtattgcccatgctggagccggacgtaatgccaaagaagcgtatgcgccgcattattttgaacgtaaagggatcaaaattgcgttgttggggactacacgtgtcatgcctgaagccaactggaatgcgggcgccaaactgcccggtgtagcaggagcctatgattcgaccgctatcgtaaagtccatccgtgaggcacgaatgcaggccgatctggtgattgtcattgcccattgggggaaggagcgcgctactgtacttgagccccatcaaaccgagttatcgcacgcttttattgatgctggagctgatcttgtcattggcggtcatccacatgtgcttcaagggatggagcaatataaaggtaaatggatcgcatacagcacaggcaattttattttttctaaatcaacggtgccagccacttgggatacagcgatatttcaggcaacctgtacccgaaaaggggcttgcgaaatgaagctgaccccttaccgggcggagctaggtcaaccaatcccattgaaggatacggaggccagcaaaattttgcaaagagtggcggcactgtcaccgggaaatgtctcgatagggacggatggtacagcaagcgctcaatagaagttcgaaaagaaattttttatatgggaattgacggaacgatcgtatgagggactcctttgtggatggaggtcataacaagatgaatcatttgtgcgtggctcaccgcggtttttcggggattgctcccgagaacacgatggcagcctttcggcttgcgttggagcaaccatttgtacactggattgagctggatgtacagctgtcaaaggacggtgttccggtggtaattcatgattttacgctggagcgaacgacgaatggtacagggagagtaaaggattcggactggaaggcattgcaacaacttgatgctggtagctggaaaagtgcagaataccgtggagaaatgatcccctccctcgcacaggtactggatttatgtcgtggccgcgtatcgctcaatattgagcttaaaaccgctggtgacatgtatccaggactggagaaagccgtactccgtgaaattgtggtgagagggatgcagggagaggtggtattaacttcttttgagcgtgccgcactacgccgggctaaggagctgtctcctgagatccgtaccggattgattatcgatgcgcgcccagatgatttggcaatgcaactggagcaactacaatgcacttttttatccatgggctatccgcgtttggatcgaaacctgatgaaagatctcaccggacgcggtattactgttatggcgtggacggtggatgaccgccgtataatgcgaagattgtcctcattgcatcctgaattgatgatttgcactaattggccggatcgctgggagcaggtttttttgctttccaagcaccggatgtggcactatatacgtaaacttattcgttaatcaattgaactacatacgcgggaagggtgacggatcgtgatgaacgtggatattcgtaatgtttactgtgtcggacgcaattataagctgcatgcggaggagctgggtaatgaggttcccgcagaaccgatgatatttttgaagccgtctcatgcagtcgtgccgctggatggcgccacgctggagcttcctcaggggcaaggagatattcattttgagactgagctggttgtggctgtaggacgtaaatacgaaccaggcatgtccgcagatacatgtctgaacgcatttgcgttcggcattgattttaccctgcgtgatgtacaaagtgtgctcaagaaaaaaggccatccatggaccgccgccaaaggcttcaaatcgtctgctcccgtgacaccattcctgcctttagaaaaattggacatgctggagcagcaggatttttccttgctcaaaaatggacaggaagtgcagcgtggacatgttaaggatatgattttttctatccagcatatcgttgaatatatagcgactcattatggactgggcgagggagatattattttcacaggtactccagcaggagtagggcctgcagcaagtggggaccgctttgagcttttctggggaagtgatcgtcagggaagcttcaccatcgcataaatttgtgaatggcatccatgaagaggattaaaaaagggaagttcttggtggttggggagtaaagagagattcccgtagataagcattgtgaaggccgtgtcctgtgccaaagcatgggacacggcttttatataagcgtagagcgttgtacaatagtatacagaacgaaaaaagaaaaacggagattcatttcaaaagcgggggtatatcatggactggatcatcggattgctttgtgctgctgtggtggccggagctgcattttataaaaaatccttaaccttatctggctttgccgcggctgtactgatgggaactgtatattatggggcgggtaacctgttctggttcggcacattgctcttgttctttatcacgtcgacccttctgtcgaggttcaaaaaggagcgcaaggctgaactggaaaaatcgtatgccaaaaccggaaaccgggatgcaggccaagtatgggccaatggtggattaggtatgctgttatgcctgggttatgcgatatggccccatgttacgtggcagctggcttttgtcggtgtcatggctacggtcacatccgatacgtgggcaacggaatttggcagcctgagtcgtaggccaccccgttcggtgcttaacgggaaggtgctggcacccggaacctcaggaggagtctctgtattgggaacggctgcggccttggctgggggtgtactgatcggcataggtgcatggggctttggacacgtcataggaacgccgagcttgccgttatggctgtgggcactggttggaggtatatccggtagcgccggggcctttgctgattcctatctaggtgctacagtgcaaatgatgcgttcctgcacggtttgcggacgagaagtagaagtagactcacattgtggacaaacgacggtctatgtacgaggctggcgttggatgagcaatgatcgggtgaatagcattagttctattttcggaggattggtcgctcttgcaggtattttttttatactctgaacacagggctggagatcgttacaaggaattaactgttataagaattgaccatgtttcaatccttgtataaggaggtgctaagatgggcgatatccacggagataaatatgaagctattttggacgcagcttacaccgtctttggcaccaaaggcttttatgaaagcaaaatttccgagattgcagaacaagcgggggttgccaaaggcacagtatacttgtactttaaaagcaaagagcagctatttacagcagtcacacgtagagattgcgagcaatacctagccgaaatgcatggtgcattaattaatcgtactttgggagaaggactgctgcggatggcgaatttgcatctgcactactatttcaagcgcaagcagcatactaaattattttttatgacccccaacagtgaccccgatctaatggagtttatgcggggatttattcaggactatactgatttggtcaacaataaactgtcgtcagagggtgtacagcagtccgagtttcatgcgaaggcattcattggtatattggaacgcctaaaaatggatattttattgaatcaagatttccgcgaatgtgacgtggatcagacggctgaattagtggcgaacttatttatgcatggctgtaaagccgggttacaaaaatcctgacatctagttgctaaaaaaccgtactgacttcgttcaggtaacggtttttttaatcattggctgtgtctgtgttaaaataaacaggatgcatcacaaaattggggaagagtagggaatccgtatgaatattatgaccgttgaacatataacgaaaagctatggcgagaaaatgttgtttgaggatgcttcctttggtatggatgaacgtgacaaaataggggtcgtcggtgtaaatggcaccggtaaatcaacgtttttacgggtaatttccggattagagccgccagatgatggcaatattgcagtgaacaacgatgtgcgaattcagtatctagcacaaaatccggactttgatcccgaaatgaaggtactccagcatatttttcatggcaaccagcctgagatgaaagcggtccgagaatatacggagaccatggagttgttggagttaaatccgggtagcgaggagcttcaaaaccgtctattgcgagcaagtcagcaaatggatacgttccaggcatggcagctagagagtgaggccaaaaatatacttacccggctggggatcactcagtttgagtctcgtatgggcgttctatccggcgggcagcgcaagcgggtggctttggcggcggctttgatccaaccctgcgagctactcattctggacgagcctacaaaccacattgataatgagtccgttgaatggttggagcaatatttgcaaaaaagacgtggtgcgttgttaatgatcacgcatgatcgctattttctggatagagttgcaaatgtcatgttggagctggatcatggccgccttttccgttatgaggctaactatacccgttttctggagctgaaggcagaacgtgaggagcgggaagcgtctacggaacaaaaaaggaagaacctgctgcgtaatgaactggcatggattcgccgtggagcaaaggctcgttccaccaagcagaaagcgcgtattgaccgatatgagcagcttagggatcagcaaccggaagctcgttctggatctgtagatatgtccgtcgcctccacacgtctgggtaaaaagatcttggagatcgagcatctgtccaaatcggtagattctcgtaagctgatacaggatttgagctacattgcggttcctggtgatcgtgttggtatcctaggtcctaacggtagtgggaaatccactctgctccaaatgattgcgcagcatatagaaccggattccggcaacgttgtgctgggaccgacggtgaagcttggctattttactcaggaacatcaggaaatgaacgaatcattacgtgtcattgaatatattaaggaagaagccgaagtgattcgtacagcagacggttcgacgattacagctgcacaaatgctggaacgtttcctattcgcaccaagcgcgcaatggacggttatttcgaggctgtccggaggcgaaaaacggcgcttgtatctgcttcgtgttctgatgtcggcaccgaatgtgctattactggatgaaccaacaaatgatctggatattcagaccctttccgttttggaagattatctggatgaattcccaggcgtggtttttattgtttctcatgatcgctatttcctggatcggacagtggacaaaatactggcgtttgaaggggatggacaggtacgagtacatgtaggggactatagcgagtatgcagaatggattagtaaaaatgctcaatcttctgtgaatacgtctgtctcaacgagtacggcttcctcgaatcgctcttccgtgcctaagtctgcgggtccttctgattcagtcaaggagacaagtaaaaccaagcttaaattcacctttaaggaacagcgggaatatgagcaaattgatgagctgattgaacaagccgaacagaagttggccgacattcagcgacagatggaagagtctttcagtgattcagcacgactacaggagctcatggctgagcaagtgaaggccgaacagcatctggagcatcaaatggaacgctggacctacctgaatgagctggccgagcagattgaacaaagtaaatcttaataatacagaagcaagtcaccattcagagtggaggcttgctttttttatcgaattattaatatgtttttcatattaaaagtgcgtgaattatatatttttaatattaaattacggtgggtataatggattgcatatgggagggaggaattgaaaatggaatatcgtaaacttggaaaaagtggattaatggtaagtgagatcgcattgggaaactggatcacccacggtgctcaagtggatgatactatagcgcaagcctgtgtaaacgctgcactagactcagggattaccacgtttgatactgctgatgtgtattcggataccatggcggaaacggttctaggtcattctttaaagggaatacgccgtgaaagtattgaattatgtactaaggtttttcatcccacaggtaccggacagaatgataaaaggctgtctcgcaaacatatcatggaggcctgtcatgcttctctccgacgcctgcaaacggattatattgatgtatattatgcacaccgttttgatccaaccgtatcgcttgaagaaacttttttggccttatccgacttggtgcggcaagggaaggttttgtatgtaggagtaagcgagtggacagcagagcagataaagcaaggagctgctctggctaaggaattaaaggtccctttcgtggcaagtcagccccaatattccatgctgtggcgtgtcattgaagctgaagtgattcccgcttgtgagttggaagggattgggcaggtggtttggtcacctctggcacaaggtattctttctggtaaatatgcagcagaaaaagccgttacccgagggatcaagagcttctacgacagcagggtcaccatttttcgaacgtttggctggacaatggttacgtaaagaagtccttttggcagtaaagaaaattcagccgattgcagaagaatgcggactgacgctaccccagcttgcagtcgcatgggttttacaaaacccgcaagtgtcctcagctattatcggtgcttccaagcccgagcaggttaaagagaacgtaaaagcggcgggtgtccgtttagatgagcaggtcatgagacaattggatagcattttaaatggtattgttgaacgtgatccgagaaaaacaggttaagatatacgatcaaggagatttacatgtctaactcttcgttacaagctgtttcttcaaccacttccagaaaatgagtcagaacagtttcgtgtgtacctgttttccatgcagcataaagtgggatggacggagactcttcttgaaaggaacgaaatacgacatcactgcgttgaaagacagaaacggaagaggggacaatggagatacctatacctgccgctaccaagttaacgatcgtatacatttgaacggcttcctgtacgatttgaggctgaaatccgtgttgtccgcaaaagtccagtatgaggttatgaaaagaagctcccatatgaggcggagacaggataaaaaattcgtccgctaaagaacgtaaagacaaggttgaatggtgggctaacggatgtgtttgaggaagaacggccatgagtgattcattggtgtaaagacgagaattgatatgtatagatggatctgcacagcgcaggaagcctacatgaactttgccatcgtgtatagctttcagttgttggacagatgtcatttcaaataacgtaagcttcacatctggaaaacgctctcggaatttcttcaaggcattaaccatcagactaccagaggctgaatctacaaaagcgatggataattgtccgaatttcccctgacttgcaagctgtgtgatcttgatggatctttccaattgtgcaaccacgtttctggattcttctaaaaatatcgctcctgctgacgtaagtcgaacttgcctcttggttcgttccaaaagcttcacgccaagttcttcttcaaggctttgaatttgttggctcaagggaggttgggtaatattcagttttttcgcagcacggttaaaatgcagttcttccgctactgcgataaagtaacgtagttttttcagatccatagctgtgatttcctttcgctaagccttcaccgacctattctccaagggaacaggtcggtttttatcgttcgaattaaaccatcacataagctgcaagcagacgtgcagtgttcaccacggcctgcttgtgcgtgcgctccatggcatgggaggcgtgtacgccagggccgatcaacgcagcacggatgttattaccggctcttagtgcagccgaagcgtctgaaccgtagtgcggataaatatctaccgcatacggaatattcagctctttggccagctcaatcagacgggtcgtcatagtatagtcataaggtccggaggaatccttggcacagatagaaacatccgtttccttgcagctcagatcttcacccatacagcccatgtcgacagctatcatctcactgatttcttcaggtatgtaagctgctccgtgccccacttcctcgtaattggaaatgagcaatttaacggtatatcgaggcttccagtttccatgtacagcagattccagtaaaccaaacagtgcagctacactagctttatcatccagatggcgtgacttgataaatccactgggtgttacgactggacgcgcatcgaacgaaataaaatcgcccaccgcaataccgagctgaagcacgtcttcttttgacccgacaagctcgtcaatccgtacctccatatggctctctttgcgctcaaagctccgtgcatcatcatagacgtgcacggatggatggctggacagaatagtgcctgtatacgtttgtccgcttcgggtatgaataaggcagtattcgttctcaatgctgttcatcatgaagccgccgacggatgtcagacgtagggtgccttgtgctgtaatggaacgcaccattgcgcccaatgtatccacatgtgcgctcagcgccaccgtatggtccgtttcctgacctttcagagtcaagatggcaccgccttttgcattccattcgatttgtaccccgaggctttccgcttctttacgaatcagctccatcacatggtgtgtatacccactgggactgggtgtgttcagtagctgatttaaaaagttcatcatatattcttcatttaattgaatcgtcatttgttgctcctcctcatttggacaaccgatcagggttagaggacggttgctctatatcttggtcgaatgtagaccctgtgctggaagaacccgtcgagttataggtcacatccgcgtttgcttccaccgtggatgtgtgctcttcttgtagtgtatgaagctgagtagtcagacgtttaatctctctctgaagcctatattggcggaaaataccgaaagaaccgacaataagtccacctagaagagtgcaaccaagaataagcaaaatcaaaggaatgctaaccatactgaatagaaggttcacttgaaccgaattcacattaataacagcaaatacagctgttaacaaagcaataacaagagctgcgatcaaagaccattgtgttttcaaaatgccacctcctcccgttacattataaaatcccttgcccgccatggacaagggatttatccgtgcatcatttcaatgctggattttaagtgcgcacggttttactttccttcagttagcttttccatttctgtaatgacttcttcgaatacgctcatcgcttcgcggatcggctgcggagaggacatgtcaacgccagcttttttcaaaatatggattgaataatcgctgccaccgctcttcaagaagcccaagtaacggtcaacggctggctggccttcctccagaatctgtttcgagaaactggttgctgccgagaagccagtagcatacttgtagacgtaaaaactgttataaaaatgagggatccgtgcccattccatttcaatgtctttgtctaccttcataccaggcccgtgatatttcacattcagatcatagtaaatctctgataaaagctgcggtgtaagggattctccctgttcagcgcgttcatgtacaattttctcaaattccgcaaacatggtttgacggaataccgttgtgcggaattgatctgcatagtaggtgagaaggtacattttctctttcggatcggttgatttgttcagcaggtagtccattagcaacgcttcattggttgtggatgccacttcagccaggaaaatggtgtactgtgcatctctatacttcaatgcgttgtctgaatagtacgaatgcaacgcatgccccatttcatgagcaagtgtgaacatgctgttcaggttatctttatggttcagcagcacatatgggtgagtaccataagctccccaactgtatgcaccagtacgtttgttttcgttttcgtatacatcaatccagcgctcatcatagcctttttgcaacgaagccagatagtccgcgcccagtggcttaaggccttcctttgtttgctttttggcgtcttcatacgtaatgtccatcttgtattcgtccacaagtggagcgaacaaatcatacatatggagctcatccacacctaacaactttttacgcagcttgatgtagcgatggagcaggggcaagctttcatgaatggtatcaatgagattcgtatacacttccttcggaatattgtcaccgtacagtgacatttccagtacagaagggtatttgcgaacacgagaataaaaaatatttttgtttacattggcacttagtgtagaagcaattgtatttttatttttggcatatgtgtcatataccgctttaaaagcacgttcgcgaacttcgcgatgcggactttcgaggaattgaatgtagctgccatgagtcagctcaacctctttgccgttttcatccttaatttttggaaacttcagatcggcattgttgagcatgccaaaaatcgtttgcggggcttgagccagattgccaacctgagcgagcaacgcttcttctgtcttgcccagaatatgtgctttttcccgcttcatttcttgaagtgtaaaccgataatctgcaagcttcggatcttcaatgaaggcatcgagctgatgatccggcaatgccaaaatttcaggcgtcacgaaagaaagagactcgctaacctcaacgcctaattttttggctttttgcgaaagaccctggtatgtaggttcagctgtatcctcatcatgatgcagatgtgcgtacacatatacacgctcggttttaagcgacaattcatcttccaatttaaagcagctgccaatcgactctgctgaattgagcttgccttggaattgttcagcctttttggctagttgtttgacttcttcgtattcttgatcccatgctttgcggttgggaaacaaatcttccagtttccatgtattttccactggcgcattagcgcgttttacaatttcactcatggagagcctcctctgatcgaacgtaatgtggggtagggctgcggcagtaagggacggatgccaaaacgaagaaaccgccacgcttaccgtaagcagcagggcaagaggttttacaggatgcatgtaacggcagatcctccttataccatggcttattatgccatagtatgacctcttacgcccgaaagtataattttccttactgtgggttggaacctatatttaataagctgtatacaatgagataaaaggcaaggcaaaccatgattacagcagtgagggccatccactttttgagaggagtcggtatcgtatcacgcttcatgatcagcactccgcccagcgtgaaggccagaataatgaagatgagatagctgttggacaccatgaataggctagacctgtttgaaagcgttcatgatccgctgccactcttcctcattatcttgaaaggactgcttgggaaaccgattttgagcccaatgcattagcgccggacggcttaaaaacgtgtgggcttcctcgccccaatcatcagatatttcccgtagaacgatgtaacggccctgcacctcgacagtcatcatgttccaattgtcttttttgtatatttcgtgttttttcatcatatgcatgtctccgattttatagatgttttggttcatgataccgcagtttccgccgcaaaagcaaatcattccagcccgaaaaacccggaaaaacatcaattgcattgtgaaaaagcatgaagtataatatggatattcgccatagatggcggtatttttaggaggttgttcacttgaaaggtacagttaaatggtttaacgcagaaaaaggttatggcttcattcaaatggatggtggcgaggacgtattcgtacatttctccgcaatccaaggcgacggctttaaaactttggaagaaggtcaagcggttgaattcgaaattactgaaggtaaccgtggaccccaagcagctaacgtaatcaaactgtaagtgtaactgaattgtaagaatggttccgtttctacggatgtcttatatattacggttaaactatgaattgagagcgcagttcctttaatttaagggactgcgcttttttgcgtaaatacgtttatgatatgagaagattgagcaggaatagggtattatacgtaataaaactaggcagaagacatttcaaattgaaggagtgagaaaatgagtgcagcagaggctagtcgtaagccttccctgattgaaggtcctattgccaaaacgctgtttatgttctctttgccgatgctgttcggaaacattctgcaatccctgaatggaacgatcaattcgatctgggtggggaagtttctgggagaagccgcattgactgccgcttcaacggaaatattataaacggctacgggacagtggcagcagcagcttatacagcagccaataatttgtcgagctatgtgcagatgccagcaatggcgttaggtgcagctgtatcttcctttgccgctcaaaatatcggagccggacgttgggatcgagtgcgtatgacaacctggattgggattgtgtataattttgtgttgactggtggagctgtggtattaatttacgtgtttaaccgtcaggccttactcatgttccttccatctacggggggcgcattggaattgggtatgcggattaatatgatcaccttgtggtcttttgttatattcggtgttaccaatgtcattacaggtgttgttcgatcaacgggttccgtcatgataccgcttttaattaccattatttcattatggggcattcgtatacctttggcctatgtatttgtcgatgagtatggtctagatgctgtatggtggagctttcctgttggttttgctatttctgccgtagcagtcatttactattatgctttcgggaaatggaagcaggcaagcatgggagagggaatccaagccatgaagcccgcagaggacaagggataggtaggccatttatactatttgcgattaaagtcttataaggatagattttgtgtaactcctatttttgactaataaaacattacaggtataaaattctttttgtaagaatagctcatttccttgaattttaaagaaaaaagtgaggttgttcatttgtgctaaaaggacgatcatattataatggatatggtttggataggtataattacgtagacaacaatgtggaggcaccgtcatttgagttatgttgagcaaggacgttatcaagtaccgagaggccccataggtctaatgagccgaatgtacaagcacattctccctgaaacgaaactagaattgagtaactggaagagcaaggccgaacaaattccggaccctgagctgcgaagccaggcgcttgcgagcatagcggataagacatttcactgcgtgggtggagcggtttatgccgctgccaatatgtctgcccggcagacgctaattccgctgatcgtagcgtatcagaccattagtgattatctggacaacctgtgtgatcgcagtacgtccatggacccggatgatttcaggctactgcatcaggctatgctggatgcagttaatccgacggctaggccagtgaattattatgagttgcgtcgtgagcaggaggatggcggttatttgaccaggctggtgacaacctgtcagtcttgtgtaagcaggcttccgggctatgaggcggctatgccttacgttcaggatttggctcgattatacacggatttgcaagtatacaagcatattaaacccgagctgcgggaacaagcgcttttggattggtggtcgcttcataaagaccgtacaccagagttgcgctggaatgagtttgctgcggctaccggttcaactctgggggtctttatgctgtttcttgctgccagcgaccagcatctgacagatgcaggggctgcctcaatacatgcatcgtattttccacatgtgtgcagtcttcatattttgctggattatctaatcgatcaagacgaagaccggaagggcggagatcttaacttttgcaattattatgaagataccgacatggtgctagaccggatcgcctacgttgtgaatcgggcgcgggctgatattgcagatgtccctgccagctcctttcaccggatgattatcgagggattgctggctttatatttatccgaccctaaagttagcgagcagcaggacgttcgcgctgtttcgagacgtttaatgaaaaatagtccgctcatgcgtttgtttttcttattaaacagtcgatggataagaaggcttatatgattattttgaggaggtcataaatcatgacagcagttaagaaaattgcagtattaacaagtggtggagattcacaagggatgaacgcggcagttcgcgccgtcgtacgtagcggattgtattttggactggaggtattcgggattcaacgtgggtatcaaggccttttgaacgacgatatttttccaatggatctgagaagcgtcggagatatcatccaacgtgggggaactgtacttcaatctgcaagatgcctggaatttacgactgaagaagggcagaaaaaaggcgctcaaattttgcgtaaccgtggaattgacggcgtagtcgtgattggtggcgacggttcctaccaaggagctaacaaactgaccaagcaaggcattaaaacgatgtgtcttccgggtacgattgacaacgacatttccttcacggactacactattggttttgatacggcggttagtatcgtagtggacgcaatcaacaagctgcgtgatacgatgtcatcccatgaacgttcttctatcgtggaagttatgggacgtcattgtggtgatattgctctgcatgcgggtctggcttctggcgcagaaacgattttggtgcctgaggtagaatttgacctgaacgaagtatccgaccggatgaaacaaaactttaagcatggtaaacgccacagtatcattatcgttgctgagggtgtaggcaaaggcgaaacagtagcacaagttatccaagaaaactgtccggattatgagcctcgtgttacagtgcttggacacatccaacgtggaggcacaccaacagcgtttgaccgcaacctggcgagccgtttgggtgactttgctgttcgccaattgatcgagggcatatctgacaaggcttgcggaatgatcgacggtaagttggtagctacagatattgacaaggttgtaaataccaaaaaagatttcaatatggagctttatgagctggccttgcgtttgtcccaataataagagcctttatgtaaaatagatcggctctgatattggaaatgatcaaaattatgcggatgacccgagtcatccgctatttttttagctttgagtcctatcaggaggtagtcatatatgtacctattcaaaatcgaagtggacagttcggaaggagcgctgaccgtcattctcgctgctgaaaatgaagaacaggcatttgaagagattgaacaacatgtggagagacactttctatatcctcccaagctgaacgaagtggctattgtggagaaaaaacgaataactttaggcgcagcatatgtaatcgagacacgcaaaggctaaatagtctctgcgtgttgttttttttcggcgaaacgacgttgtactctcaccagacgccagagaagtaaaatagcacctactgccaaccctgttatcaaaccgatccagtagccgtagggccccaatgaagtccagcgtgccagtatatatcctacaggaagcccaatgacccaataggagaggaatgtgagcaaaaaggctggattgacgtctttatacccgcgtagcgctccttgtgtaggtgtagcgacagcatcagatatctgaaagaaaatcgcatagattagaaaatgctgtgccaattgaatgacctgcggatcggtggagtaaagtcgagcgacctgttcaccccagataagcagtacaatagctgtaatcagtgatagacctactgcgctgctaatccccattacactataagctttggcatcccgcggacgagcagctcctgtttcatagccaactagaatcgtaagtgccatgcaaatgctgagtggaatcatatacagcgtagatgcaaagttcatggcggcctgatgtgcggctatggtagctgtattatagctactcatgaagagagtgacggctgaaaagacggcagtctcaaaaaatatagcaaatccaatcggtacgccaatcttgatgagctctttcaaagcaccagcagcaattctgtatattttgctgaagattcggtattcggcaaatatttttccacgatgcgtagtgataccggcgaccagcatgatgatccagtaggtggttgccgttgccaccccggagcctacaccccccagacgcggaaaaccccagtttccataaataaggagatagttcaacaatacattgatgggtaacgacatgagcgtgatgaacatcgtaaaacgggtttgtcccaatgcatccatgaagcttcggagcacagtgtaggcaaatagaggaacaatcccgaaagccatcgcacaaagatagtacagggccacattatgaactctcaattccaaattcataccgttcaaaataggcttgaccaaaatgatgccagcaatcaaaacgaccatagacagggcaagagagagccaaagtgcttgaatgacatagtaggagactttatctttgcgctgtgctcctaccaattgagatacaatgggcgtgatagccataagtattccgttaaggcctgtttgtacaggaacccataggcttactccaatggctactccagccagatcggcaggggaaaagtgtcccgacatattcgtatcaaaaaaagtcatggcagatagtgcaagctgggtaatcaggatagggagcaaaatgtagaaaagttgcttccatttctgtcccgttgttagagtcaattgcatttttgttttcctcatttactagggattgattattcgtatgtatcataacatgtaagtatttattgtaagggataccgatacatttgaacagtaataaaaaagactgcacccgttcgccaaacaacgggacagccttcgaaatgattatataatttctaaattttatataaaataataaaaagtccggagagataaattatttgtatgttactccgctagtatagcggtttgtggcattccaaagtagatattcatccactttcatatccttaagcgctcgaatttggtcctctacttgagtttttccatacttagcataatgtccgctccccaaccaacttgcggtaaaatcctggatccaaggacgaataattggctttagcttgcccgtcggatcaagctttttgtgtgtatcggccatggagcctttaatcgtctggtatggattcttatcggggtcttttacaccgaaccagcctgtggtgtagtgacttggataaaccatgggcgaaatgacatccacattttcggagattttagtgaaatcctgtccgatcccctccgcagcaggaacggatgcggcatatccgaaaatatctaccgatactcgtacacctaatggagcaagctctttacgggcatattgtacgaattcagcgactgcatccgagcgggattgatctgatttggtatatttcagcttgtctgctcttttctcaaagccttcggggaaacgtacatagtcaaattgaatttccttaaaaccaagtttggctgcttccttagcgatggcgatattataatcccatacttctttattatagggattgacgaacccgtctcctttgccgtttttccagacagagccgtcagggttacggaaagacatctcgggatttttgttagctagtaccgtatctttaaatacgacaatacgagcaatcgggtaaacattatgctttttcaatcggtccatcaaaccggaaatatcccgaatgaatttttgcggcttgcccaatttgagcagctcgggattggtcgttggataagtgatgtaacctgcatcgtctttaatatcaataaccatggaattgagctctgtcttgtcaagcagttcaagcagctgagtcatacgcgaaccgcctgcgctataagccgtgacatagatgcccttgatagcaggagtcgtcggttgtgggtcaattttaactgggggattggaggcatccaccttcatattattgtgctgagcctggatcatggcgctactaattgttgttaccaccgtatcttttacatttggagcgttggctgactgatcgccgtttccgcctatccccatcgccaatagcataattgcccaaatcatattcatttcctaactctctcccttatgtatgtcgcttacctgattatacgtaaagttatgtatcgaaaaacaacacgcttgtaaccaatactggaatcatcaggcacagtcttacatgattaacccaacctgtgttcattgaatccataaaaatgcataaataatgccgctctcttcgcggttgtagatgtaaccggaagaagcggcacttggtaaagaaatttattgaagataattattgtcttgatgctcgcaaatactgtactgaataatttctagcgcatccgttggcttgagtatggccatcccgtcccgaagcacaatcatcgagttcagctcatcctttttgagagaagggagcatttctgggtaccatcttaagacaatgtcggacagttttaccgtttccatttccacaaaaatcaccctttcctgctcggaatcattccaaaagaatcattcaatacgattcggaaaagcaaagtgcctgtgaaatagcaggtaaagctggtctttatatactatgggaacagcgcacatatagtgtaccacagaaactgtattttgacacttgggtttgtgcttatcttcggcgaaatgaacccatcaccccaaccgtttccacaatattgacaaaagctgaagggtccacttctctaatgatccgttttaattcaactagctcgtagcgtgtcgtgacagtcatcagcatgtccttttcggtatgtgaaaatgcgccttcaatttttattttgctaacaccgcgtggtgttgtcaacatccgctccagtagcttgtcggtgtgttctgtaataatgtagacggtaatcttcgtgtgactgacatagatttgatccaataccttgccagtcacaaaaatagatagcatggacgcaagtgcaatattccaatcatcgttcaaatatcctgctgcaagaatgaccagtccattcatgccaacaagtacagttcctacggggaagtcacgataacgagtgacgatggaaccgataatgtcaaaaccgcccgtagaaccccctacccgaaaggaaattcctgctccaacgccgatcatcaccccaccaaaaacggaggctagtagggggtccgacacgacagattgcaccggcacccaggccaaaatccacgttgtaacgacaacggataaaatgctcaggctaataaaacgcttgcctaaaataaaccagcctgcaataagcatcggaatattgataataaaatacatcgcgctgatatcaaattttgtgaagtagccaattaacatggaaagaccagctactcccccgctcagcaagtggtgtggcacgagaaacagattaaaaccgcatgcaatggcagcggctccaagaatgacagttaagcagtttaacactatttttaacaacttattttcacctcatttaaattatacgggaagcaacttgctggtattcatgaattgttctgtgctataatgcgatgtggatattcttgagtagggacctatgtccagagaaacacttaaaatttaaactgttttaaaaaggataaattcgtttaagatgtatcggataggttccccaaattcattacagaaagatacagttataggtctaaataaactgtcactgtattggggaaaacttatacaataatatcgctacttaagaatacagacaacattgtggattgtccaccacatccaccattatgaaggagtttgaataaatttgacgacatttgcagaatttgatcttgaaccgaaagtaattcaggcgattacagaactgggctttgaagaagcaacaccaattcaatcccaatccatcccgattgcactgcaaggcagagacatgattggccaagcccaaacaggtactggtaaaaccgctgcgtttggtattccgctgattaacaaaatttctagaagcgacgaaaaaatcagagccctgatcatggcaccaacacgtgagcttgctatccaggtagctgaagaaatcgaaaaactctctcgtttcaaaggtcttcgtactttgccaatctatggtggacaagatatcgtacgccagattcgtgctttgaaaaagaaacctcaaattattattggtacgccaggacgcttgcttgaccatattaatcgcaaaaccatcaagctggaagatgtaaacacagttgttttggatgaagcagatgaaatgttggatatgggcttcatggaagatattcaatccattctgaagcaagttccagacgagcgtcaaacgatgcttttctcggctacaatgcctcctaatattaaaagattggctgagcaattcctcaaaaatcctgagcatgtttcagttattcctaaacaagttagtgctccactgattgatcaggcctatatcgaagttcctgagcgtcaaaaattcgaagcattgagccgtttgatcgacatggaatccccagaacttgctatcgtatttggtcgtaccaagcgtcgggtagacgagctggctgaagctctgcaaaaacgcggatattccgcagacggtttacacggtgatttgtctcaaaaccaacgtgatgctgtaatgcgtaaattccgtgacggaagcatcgacgtgctcgtagcgactgacgtagctgcccgtggtttggacgtttccggcgtaactcacgttgtgaactttgaccttccgcaagatccagaaagttatgttcaccgtattggacgtactggacgtgcaggtaaagaaggggaagcttggtctttcgtaacgcctcgtgaaattgaccatttgcactttatcgaacgtgtaactcgtcaccgcattccacgcaagccgcttccaacgttggctgaagctctggaaggtaaacaacgtatcattgctgaacgtctcctagaggctgtagaaagcggtgagctgaacgagtataaaggtttggctattcaaatgctggagcaatatgattctgtacaacttctctctgcagctctgaagctgatgactggtgagaagagagaagcatcgattgaactgactccagaagatccaatccgtgcaaaacgtcgtaaaccagacgtgcgttctggcggtcgcaagccttctaactatagcggtcgcagcaacggtggttacaattccaaccgttctggcggtagcggcggtagtggaagcaaaggtggatatggcggttacaaccgtggtaaagaaggcggtggctacaaccgtgattccggaagccgctatagtggagatcgcaaaccacgcccgagtagcaatggagaaactcgtcgccctgcaagacgtgaagattcctcttccgaataagaaatgaaataatgaaaagtcgaagcagatgaagcttcggcttttttgttatgattaatcagtaggtatgaaccttttagagatctgctttaatggatcacgtattgatttcactggcgtattagggctgaaatacggtatgatatagtcaagagccggaatttataggcatagcaacatgagtcttggaactgccaaggcttgcggagggagagactgacattggagtttaaaggagctatgggtggtatttaccgcctgaccgagtggattacccgactggcggctacaaatttgttatgggtgttatgttcgtcgccttttgtgttctgcctcatactgaaactacttgtaatgaatcagaatttggctaatgagtctttacaaatgaattgggcgatggctattttggcaccgcttactttatttccagccacatcggctatgttcacagtggttcgcaaatgggtaatgggcgataccgatacgggcgtgtttcgtaccttttttaaagggtataaagagaattataagcaaagtttgatcgggggtatcttttacacgttgctgtttgtcatcatgtatgtggattataccgtatatatgacacaactcagcaacttgcaaatcgtgggcgtaattatgcttattcttatcattattttgcttgtgtctatgtttaacttcttttcgatggtggctcattatcatatgtctaccggacaaattattaaaaatgcggtgttgctgacactgattcgaccattccgagtattttccaccctgctcggcagcgctgttgttatatttatcggagtcaaatatcctgtgcttttcctattcttcattggcagcgtggttgcctggttcgctttctttaatttttacggaacgttcctcaaaatgcaggatcaaatggaaaagatgaagcagaaagatgaagatacggcaagcattgaagacaaaaaaagtgataacccctaaaaataaaacatatttctcctagcatttactttctgagtgagaagcgctataataaggtcacatcctgcgatgcacgttacgatcatttgttgttttgaaccaatgacaatgtctagggagatctatacggatgaatagctgaaaagccctgtcaatacctgacaaggggacttcaaaagtttattctgcggtcacccacctgctaaagcaggttcagaagacgctatggtcggacggcatcggcgggtactccaaagatattgaatacactctgttcatgcttcgtgcagaaacagggtgttttttgtatgcaacaatgttaaactaagacatgaggtactaaggtcgcataccacaggtatggtcggttaactttttgttgtttaacgtttttataaagcgcttgcagcaaaaaaaccgatgtgctgcatttcggcaacgattatcgtgaaggaggaaatgtcttgtcgttgaagaggactctggtagggattgtgcgcagccaagaaggtacaagcgaccgggtcaaggacccccaaatgaagacacgctattataacttatcgagagacaaggcttgggaagaagtatcatctattttgaaaaaaattcctggctacaaggtactccatgaggtagcatccgtaggtgagattacgttagagaagcgaacggcgttcggtagaaccatcgacattaccgtttccatattgtccgtctcgccagttcggagtgcggtagatatttattctgcttcacggggatcgctaggggacttgggcgcgaattaccgcatcattttgcaactgttcgctgtgattgacaagaagctgtccgctcataaggtcgtgcagtaattgtagatgtgtgagcagtgatgtggcagataaacgtcaaaaaaagcgaggaaggcaacccttcactcgcttttttaatattcagtctgatttagacgagtttttttactgctgcaatcgcttggtcatagtcaggatgttcggacatttcgctcaagtattctacgtaagcgattttatcattttgatcaattacaaaaatagctctatgatccaaatggaattccttgatgaacacaccataagcttcgccgaaggaatgatccttatagtcggacagtgtcaatacgcggtcgataccggcagcaccgcaccaacgagcttgagcgaaaggcagatcgacgctgacagttagcaccacgacttgatccccaagggaatcagcttcttggttaaaacgtcgagtctgtgcgtcacacacgcctgtatccaaagaaggaacaacactgatcaatttgactttgcccgcaaagtcttggagcgtagctgcttctagcaggtttttctgtaatttgaaatcaggtgcctggtctccaaccttcagttcaggacctaagagtgtcaaaggattgcctttaaaagtagcagctcctgtacgttcttgtgccatatgtaatagcctccttggtttttagcattggttatcgttgccgaaatctattataatcttttataaaagacattgtccaatttgaataaggtggagacacccatgaaggaaggattgccttgatttttttacgttatgagaactggaaaagttatttgcggttttacccagtgacctgtctgattttgctcattaatattgtgatgtttattgtactcaccgtacagggtggatcggaaaatagtttgacgctgatccgatatggagctttgattaatgaagcgccattcactgatcagctgtggcgatatgtatcagccatgtttttacatgcagggtttgatcatcttctgttcaattccttcgccatactcgtattcgctcctccgctggagcgtttgctggggtccttccgctatgtgttattgtatctggtcacgggcattgtagggaacatactgtccatcgcgcattacaacatgatggcggaaacgacagtctctgtaggggcctcaggagcgatttatggcatctatggagcattcctatacgttgccctgttccagcggtcactgatggatgacgcctcgcgcaaaacgctgtacacgctgcttgggtttggtatcctgttttctttcgctgtagcgaacattaactggacggctcacttcggtggattgctcagtgggtttttcctttatggattaatgatcagattgactggccaacgcaaacgtcactaaagacagttttaccgtaagttagcagggtaagaaagaggatgatgttcgattgacgtcttcttccggatgttgaaaaacagattggagcgaatatcggagtggaattacgacagttgcagtacttcatgaaggtagcgcaaaaagaacatgtcactcaggcagccgaggagctacatgtggcgcaatctgcggtaagtcggcaaattcatcagcttgaagaggagctgggagttaatctttttatgcaaaagggtcgcaatttgcagctaacgccagtgggacagttattttgcaaacgggttgagacaattataaaagatctagagcgagctgttttggaggttcatgagtttttggaccctgaggggggcgaaatccgcatcggttttccgcacagtttggggattcatcttattcctacggtggtggctgaattccgaaagcggtatcccaatgttaaattcagatttaaacaggggatgtacccgagtttaattcgtgatgtgttagcgggtgaggtggatttggcttttgtatctccttttccggatcgtcatgatcatgtagagggggatgtggtgttgaccgaggagttgtttgctgttctcccgcccaatcatcctttagccacggccaaacacatcacgctgagtcagcttaaaggagaaaaattcattctgttcagagatggatattcgttacgcccgattgtctggcaggcttgtctggaggcaggatttacgccagatattgcttttgaaggtgaagagacagatacgattcgcggattagttgcggctggtatgggagtcagtcttttgcctgaaatggcgttgtttcagaccaacccgcttcaacctgcaagagtgtcaattgttgatccagaggtcacgcgaactataggcttgattcatcgcaaagatgacaagctaccattagttgcaaagtcattccggacttttttgttgcaatattttggtcttaaaggtagtgttgctactccgaatggaaatgcaaaagcagatttagggcagtgagtatagcttgttagttttagataaagaaaaaaaggttgttcctctaccgttaacttggtggaggaacaaccttttttgcgacacaagcaattaatcccggctgttaaagataccgattaagcgaattagttccagcaaggaaacgagagctgcagccacataagttaatgcagcagcatttaatactttggcgataccccgttcttcatcactacggataaacccttcggaaaccataatttcccgggcgcggttggaagcattaaattcaaccggtaatgtaattaattgaaaggcaacagtagccgagaaaaagataatacccaagccaatcaggttcgtgtagctgaataagaaaccggcaatcagcagaaacggtgcaatcccggaagcgaagtttacgatcggaaagatccgatgacggagtgctagcatgggataatgctctttatgctgaatggcatgaccgacctcgtgacaagctacggcaactgcagaaatcgatttttcataataaacgggctcggatagccgcacgactctttgcattggatcataatggtcagataacgcaccaggtactggttcaataggcacatcatgcaaaccattgcgatccagcatatgccgagctgcatcataaccggtcaacccattttcatttgggacatcagaccatttattaaaagtaccttttacacggaattgcgcccataaggataatccgaacgcaagaataatcaatatatacatacccatcataaagcaaccctccattattgttcatcatagcctgggcatctacatcatagaactatgctccagcagatacttcagagcttcgatacaagcggcgctttgtggtagtagaccagtaagcaacttgcgcgcttgaacgggcttgagctgccccaaaagaggctgtagttcattgacttcacgttctagacgctgcatgtgcatctctagactcgttagtttgtcagtgacgtgctcttcccccgcgaccgagttccatttaatcagtgtctgtctgatttcctcaaggctatacttctcttgtttcatttggttaatacgttcaagcctgtttaaggtttcatcattataaagccgataatttttcaatgatcgttcttcaggtgtgatcaaaccaagctttgtgtaataatcaatagttcgttcgctgacaccagccgccttggctagctcaccaattcgatacagcttcatatccccatctgtcttcacctcgcgctcttcgttcaaccttcaatattagcatttgcaaacggagtgtatataaagaatattttacatgatttccaaccatacagtcaaacgtcatgctttttttggacagaaacaagctacttttatagttagtaaatgtgacatgatgtgtttgggaccatatttttttaacataataaaaaaaatcttgtcaactttcatgtattctgattataatgacaataagaatttcacgaaatgtaaagaaacttaacattcgagggagtgggcttcatgagaaaaaagtggttagttgtattattggccatgctgacagtattagcttttccggtaggtgcgtttgctgctgacggtccgacaaatattcaacttcaagccgggctaaacacggcctttacgttcttggcatttatacttgtattttttatgcaagcgggatttgcattgctggaggcaggctcgacacgaatgaagaatgcaggccatgtcgctggtaaaacgattctcaccacaggtgttgcggctttgtccttctgggcacttggatttggattcggatttggtaatgatggcggcaacggatttatgggactgacgggtttcttcatgagtggtacgaatgctgctgcatcgtttgatgctctttcaggtctggatgttccgattacaattatgtttttgttccactttgctttcgctgcggtatcactttctatcgcatgtgggggaatggcagagcgtgcaaaattaagtgtatacattatcttcggtattttgttctctatcgtgatctatccggttgtagctcactgggtgtggggcggcggatggcttggtaagttaggcatgcaggattatgccggttcgacggtagtccatttgacaggcgctacggcggcactcgtcgctacactgctgctcaaaccgcgtctgggcaagttcaataaagatggcaagccgaacattatccctggtcataatcaggtgtactctatcttgggtgttattattctctggtttggttggtttgggtttaacccaggtagtgctgtatcggctatgaacgacggattctttggatatgtggccttgactaccaatattgctgctgcggcaggtggggttttcgctttgctcgtatcctggatggtatatggaaaagcagatattcctgctatgctaaacggtgtgctggcggctttggttgctattactggttcttgtgcctttgtagccccttgggcggcactggtcattggtgcagttgcagggatcgtcactttcttcacagcgcaatggttcgagcgtgcaagagtggatgacccggtatatgctttctccgtgcatggtgttgcagggatgtggggcgcagtgtccacagggttcttcgctactcctgagcttgtaaaaataacaggtgtaggtcaagcgggtctgttctatggtggtggatttacccaattaggagtacagctgcttggactgattggcaccttggctttcgtgttcgtcatttccttcattattctgggtgcgatgaaagcgattatgggtatccgcgttacggaagaggaagaaacgatgggactggatatcagtgaacacggtacgtacggctatcctgagcaaatgaagttggttgccgaggctgaaaagcgttctggaattgtgaactaatatgtaaaatttaaagaaccagtatggatgagcggaggagatggaagtatggaactgcaaaatatggcctcttgggtgagttccgctgaagcgatggatcaagcagatacgcctgaatcgctaaggcaggccagggtcgactctcaaaaatggctgctggcttcccaagcctccgctccgttatcagactggttacgaacggcgaatgaaatgcatgaccgcatcgcggccagagctgtacaaatgtgtgaaaaagggatggttgaggatggcttcggccctcctcccgtcccttatgcatttatagccttcggaagcatggggcgctcggaatcgacgctgtggagtgaccaggataacggtatgattatcagtaacacaatatctgttaataaagaattgtattttagtgagtttggtcgcagagtgtctgcgatgttagagtatttgggatatcccaaatgtgaggggaaagtaatgtgctcggagccgttgtggcgccaaacattgtctggatggcaagaacagctaacgaaatggtcggacgattttgcttgggagccgatccgttatctgattatctcgtctgatatgaggcatatcgctggagatgagcaattatctgtaaactggaaacgaagtttttatgagttgttccgaaaacatcctgatttaccctcagcggtacttcggaacacggtgaggcataaagcgacacttaatattttaggtcagattgttaccgagcgcttcggtgagcatgcgggcgattttgatgtgaaatacgggttgtacattccgctggtgaacgcagtccgttttttggcgttgcaacatggtgtagaggaaacctccaccctcaaaaggctcagtcgtctcgcatcattggaagcggcgccgttgcctttactcgatgcttgcgagcgagcctttcggatcgcgcttcagcttcgaatggctactccggtgaagaagaatgatggattgctggtcagcaatggctacctggctgtaaagccgctgaaacaaagtaaaggctggcatgagttgcgcgaggcgctttcgacagtacgacggctgcatcgtgcgttgcaaaggcagttgcgatttatggaagggagaaggtcatgaaggaaccagcgcagggaagtggcttctggagcgctctccgcagaggaggagtgccgtctgcgatcgcatctgtaatgggggctcctacggctcagcagatggcttttattcgctccttaacccgggagcaacggcgctctgaagtattgcggaccccgctggatcgtttggagacggtagtttttgatctggagacaacgggattttcagcacagcatggagatgagattttatcgttcggggcgattcgggttgtcggggacatgattatggaaaaagagcagttttatacgcttgttaatccacggactgtgattcctgagcatattaccgagctaactgggattacccgggaaatgacggatgaagctccaccgcttatgaacggattgcacgactttatgtcctttgtaggtgggcgagtacttgtggcacatgctagcgctcatgacaaggcctttttgaatgctgcgttatggaaaacatctaaagttcaattgactcaccgtgttctggatacgatgatgcttgccaaatggcttgagccacagcaacatcaaacctacagtttggatgaattgttgacctaccaatccattccgattgaagggcggcaccatgcgttagaggatgcgaaaatgacggctaagctgtgggttgcgtatgttcaggaaatgctgaagcgtaatgtgaccaatttggcagatgtctacgcgcatttaagtcatgcctgattcagtacaaggcatagcattcatatacacataaaaacagcaagttcgcgatttcgtgggtttgctgttttttggcgtcctgttcagatttagaaggttagaggtgggaacagtatgggcatcctatggagaaggtaagggtcatttagacgaaagacaggtgataagactgtgaaaagatttcttttcatcagagcgatggttatgttggttgtggttggggcttcgtggggagttattgaaaacacaatttatgcagcaaacctgtccatggaaaatgaaccattaaaagaggaatacggtagagaaagacttaaagctgagaaagaggtagaggatgaaacagatgcggtagaggtaatgaaaaagataaagcctggtcaacggcttccttctatgattttaaaggggttaaacggcaagacctacgatgtaggggccacgcgcaataaagctttggttattagcttctgggcttcgtggtgcgatccgtgccgattagaagcgcctatgctgaatgagttgtatagtaagtacaaagatgatgtggatgtgtatggtatcaatgtaactcgctatgatcgattggaggatgtacaaaagttttcccactctttggatctcaaatttcccattttacttgatgagcaaggagcattgtttgaacgatttggagggatagcttttccaacccatgtaatggttgatcatcatggacaggtccgcgaaatcataatcggcatgctcagtgagcaggagttggaacgcaaaatagaaactcttgaaaaaaagaaggtgtctttgggagccgagtagactagaccccaaagacaccttataagctcgtgcgagcacctgattagtgattaactaatccatgatgagtaagctctgcctgatcgttttttggagtcggtgcttccaataatgcgtaacggaagctgtccaagagagcttcccagctggcttcgattacattttcagatacacctacgttactccagacgtcctcgtaatttttagactcaatgagcacacgtaccttggcggcagtggcatccttttcgtcaagcacacgtaccttgtagtcagccaaatgcatgtcccgcaaggcagggaaatattgagaaagagccttgcggagtgcgttatcgagcgcgttgacaggaccgttgccttcagctgcggtatagacactcgtccctgcgacattcagtttcaaaaatgcctcggatacgaccgggcggccggcagttttctctaccagcactttgaaggattcaaaagagaacatttccttcacttcaccacctgcttcacgaatgagcagttccaacgaagcatccgcgccttcaaactggtacccctgatgctccagttccttgatgcggctaattacgccacgtgcctcatcactagatgggtcaagggtgatgcccagctcttgtgctttggataccacgttgctttgcccggccagttcggagaccaagacccgttgcttgttccccacgagttcaggagcgatgtgctcataagttcgcgagtcgcgcagaatggctgacacgtggatgccccccttatgggcaaaagctgcattgcctacataaggctggttcacaggcatattgacgttggcgacttcgctcacaaagcgggctgtattgtggagttgatttaacttctcagtatctagacagtcgtagcccagcttgagctgcaaattaggaatgacggagcacaggttagcgttaccacaccgttcaccgtagccgttgatggtaccctgaacctgccttgcgcctgcttgtacagcacttagagagttcgctactgccaattcgcagtcattgtgtgtatgaatacccaactgcgacctcgttatctggctttgcagcatagtgacaatttcctgaatctcatgcggtagggtaccgccgtttgtatcgcacatcacgagccaatccgcgcctgcttcttctgcttttttcataacggccattgcatactcgggattgtttttatatccgtcaaaaaaatgttcggcatcaaaaataacctccatgcccccttgctttaaaaaggcgatggagtcgtaaatcatagacagattttcctccagtgtcgtctgtagggcggtgtgtacatgaaaatcccatgatttacccacaagtgtagcagcctgagcgccggattccagaattcgttgtagattgacatcctgtgctgcgatgctatctttgcggcgcgtgctgccgaaggcgacaatctttgcctgaaggcctagctcttgtacccgtttgaaaaattcgatatccttgctgttgcttccgggaatcccgccttcaatataatgaacaccgagatcatcgagttttttggcgattttcaatttgtcatcagcagacaagctaattccttctccttgagtgccgtctcgcagcgttgtgtcaaagatagaaatagcggtggacatgagggactcctcctttgcggattgctcagattggtgatgctctgctttttttaagcacattaatttagttgtttaacgcttaaaaacaggaaagcgttagtttgtcgtgttcgtatgttagtcgattatatcaacttatgacttcaattgtaatatataattatcatttttagccgcaaaacctttattttttatgtaaaatagaaatagcatttaagggtatttcaagtataaaatcaaaacacatattcccgcaatgacgggtgaatttacagttaaaaagaagggttgagcatgaaagatgtcagtgcttattatccggctggtggacgagttattctgcatgtggatatgaatgcattttattgttccgttcatgcagcggaggagccggagaaatataagggactgcctaccgcggtggcaggcagtagtgagctgcgcaaaggtgtaattgtaacctgctcttatgaagctcgacgattgggcatttcaacagggatggtcgttcagcaggctcgtcggatctgtccgcagctcatcgtaatacagcctgattttcacttgtatcgtcgttattccaaagcatttatgagtattgcctattcatatacgcctatgctggaagcaacttcaatcgatgagtgctatctggatatttctggatccaaacagtttggaacacctatggaaattgctgaggaaatccagcgcagagtagaggacgaactgggtctgccctgttcaattggagttgctcccaacaagttgctggccaaaatggcctctgatctgaaaaaaccacgcgggatatctattctacgtttgcgtgatgtacccaacattttatggaaccttccttgtggtcaattgtttggtgtgggccgcaaaacggcagataagcttctacaaatgaacattcgcaccattggacaactagctaaggctgatgagcatatgctggttggcgtatttggtgtgacgggttcgtggttaaaattggccgctaatgggattaaccattctccagtcagcactgaacgggagccaaacaagtccattggtcacacgactaccctgcctatggatgtggtaaagctggaagaagcccaacgggtacttcttaacattagtgatcaggtagcccggcggcttcgacgacacggtatgctggcaggaggtatacaactgacgattcggacgccggatatgaagacctttacgcgttctcaggtcaggagtactcctacggaaagtgcagaggacatatataaggaagcttgttctttgtatcgtcgccattggggagaggataagccagtgcgcttgctggggataacgctacagcagctcattccaaaggaggaagcggccgttcaaatggatctatttgaataccaggatcagcctaagaaggaaagcttattgaagacgatggatgcactgcgcgataagtttggtgaaaatgcaattttgaccgctgggatgctgggagatgatccttcggtacttcttcgcaactccaagttgcgcggaacttcgctgcaaaaagacaatctaccaactccggagtgaacttttgggtagattattgcaagcatcacaagctacgttataagtgttttttgtatgaaggataaaggaaaataatttgtaataatattgggtttgtattaatatgtgaatagaatgcaaaagctggtttgtttgactgtataggaggaagagaaaagttatggctaaatacacttgggtagaaaaagatacatgcattgcttgcggagcgtgtggcgctacagcaccagacatttatgattatgatgatgaaggtttggcagaagtgatctttgaaggggatgcaaaccaaggcatcaaggcgatctcagaagatttgtttgatgatatgcaggatgcttgtgacggttgccctacagattccatcaaagtagcagacgagccgttcaataaagaaggttaagcgtaggcttcttcgataggcacagcactgacagctcccttcgccgtataacggtgaaagtaagctgttggtgctgtttttttagattatagaatggttcagcggagctgaactatcctataatcgcaagaaagacttctgccaagcgcggtctggcttccgtgagagtacgtcgatagacgtttttttatgtgctgtccatcgagtctatttttgccgatatacataataggaagtatgcaagattacacgatcaggaggatccgatgaaccattcgcctcatcttaaatcgtatgtaaaaaaacaccctgataataaaatggcctggtatttactcggcaaagagtatgagagcagcggtcaagagggcaaagcaaattattgctttaatcgcgcaggagaagtgttcgaagccttcgagcataaacagattccggcagacgtatggatggaatatcaggataaactggttcaaatgtcgaaggagaaggagcgaaggacggctcgaacacgccacctgttaactgcgttaatggtactactgctcatatgggttccttcagccaattcaccgagaccttcaaatgaaaatgcatctgatccctctggaactgagcaggtagcaattgataatattgaagttacgaaagtggccactgctgatccgaaggagatggcccagatcggtgtggttggtggtgtgtttacggctcaagcccgaaaagggagtggagctggaacggggcttactgatttgttggctaagactagccgactgccgtccaagactacagtgttgggtatggagcaagggggctcatggctgctctggagagagggtatgaagccattacttagtgtacagaacaaaggaaacggtggattagctgttcagtcttacgacgccgctgcgtgtgcttgcaagccatcagacagtgaaaatcttcgcaaagcaggtctaaaatgggctgctggacaggaggaattagctgtattgaatagctccatgcgtgcttttcgctcacagcatcaacgtcttccccagagtcttgatgaactgactcgagactttcccgctaatacgatgtacggtacgacagacgggatgaagaaggcttttacacctatgcgtaatttacttgcttcaccaggacagggaacagggaaggcagtagatttagacgctgactcgtcggccgaaagcagtccattactggcatcgtcattgcacggacgaccttttctggggcaaccgctgcgaattgtggtggacaaatccaagcacaggcttgccctggtaagtggcaatgtacttattcgaaattatcctatcggtttgggcggagaaagaacaccagaagggaagtttgtgattaccgataaagtagtaaatccgaacggcaaatccaacggtgagtttggcagccgtggaatgcaactgtctgcaacgaattatgccattcatggcacgaacgagccggacagcattggcaaaaatgagtcgttgggttgcgtccgaatgggtaaagaggatgtggaggaattgtttgcactcgtaccttcgggtacggaggtagttattggtaacgggggattgcctgatcaagtgcttgtgcctggttctcgatttacaagtgagccgcagcatgaccagacgaatccccgcaaaacctatcactggctaaattaacgttttgatgctattgctacttggtgtttaacgatttcctgcttgtgctaaaacaatgaccagaataatcacaatgatgaggagaacaaagctgacggcggtccatacaatcgctttcttgttcacctcatcctttttcttttgcagactgggcggcttgcgcttggtcttcatatcagcaatccctcttttctaacgggctaaggtcttgtcttactatgtccattgtaaatggtttgattatacattttcaatgacatctccatgacaactgaattgttctggagctacacctcgcaaattactttctttttggtatggaaaaagctaaactattttgtagagatgtttttttaggattgtgcaagggcatagaacggagtggatgaatcgtgttgtatcgaaggattgcgaaacctgttttttttaaaatgagtccagagacggcccatcatgtagtcattgacggcttaaaacatgcgggctcattccctggtggagcagcgacactgcgagggatgtacggagtcaaggaaacggaggatcttgccgttgatctgtttggcattcattttcccaacctgattggactggctgcaggactggataaaaatgcagaagcggttactggtttttcttccatcgggtttggatttatggaagtgggaacggtgacacctgtgggacagcccggcaatgatcggccccggttgttccgactacctcccgatgaggcgttagtcaatcggatgggctttaacaatctgggtgctgagagcatggccaaacgtctagctgcactcaaacatcgacctgttccggtcgcagttaatatcggcaaaaataaaatcacgcccaatgaggatgctcataaagactatgaaaagtgtatttccgcactgtatccgtatgcggacttctttgtagtgaatattagctcgccgaatacgccggatttaagaaagctccagcatggtaatgaactgaagtcgctattggaagcggttcgggcagagatgggagttcaggcgaaaaagtatggcaatgccaagtctgtactggttaaaattgcgccagatgtatcggatgaagaattggaatatatgacagatgcgattgctgccagtggagtagacggcattattgcgaccaatacaacaatatccagagctggtctgacacaccgaaatgcgagtgaaacaggagggctgagtggtaagccgctgcgtgaccgttccacagaggtcatcggacgggtgtaccgccagacggaaggtaagctgcctattatcggatcaggcggcatcttcacgagtcgtgatgcctatgacaaaattaaagcaggcgcaagcctgattgaaatttatacagcattgatctacgaagggccggaagtaaatagggctatacatgctggcctgcgtgagctgcttcgaaaggacggctttagacacattaccgaggctgttggtgcagatcacagataaaaaagtgttgtcggaagagacaggaggtacggggatggacggaagagactggggaacatttttactgccatacgatcaggcggtggaagagcttaaggtcaagttcaaaacaatgcgtgcggagctgaaaaagcgcgaggaatacgctcctatcgaattcgtaaccggacgggttaaaaaaatatcaagcatcctcgataaggcaaagagattacaggttccttctgatcagctggagacgggaatcgaggatattgcaggcattcgcattatgtgtcaatttgtagaggatattcggcgggtggccgaatatatcagaagacgtaaggatttgaccgtactgtatgaaaaggactatatcaccaattataaagacagcggctatcgcagctttcatatgattgtggagtatccggttcaaacagcagtggggctgaaaattgtgctagcagaaattcaaatccgtactttggctatgaatttttgggcaaccatagagcattctcttagctataagtatcgtgaaagcttgcctgataatatgcgcacacgattgaaaaaggcagctgaggcagcctttgtattggataatgagatgtcttctatgcgtcttgaaatattggaagcgcagaaaaagttcgaggatgaagccaatatcgtttctaaagtgctaacaggtatgcaccggctgtatttctaccataagatcagtgaaacgattgatgcgcagcgcagatttaatgaactgtgggaacggcacgacatggaaggaatcaagctgcttcacgatgaggtcaaagagatgctagaagcctctaccaaggaagaagacagggatgagtattaaatggaaaacctttcctacgaaccgctgtacgtgacttatttggtatacttcaatcgggatcgggattactttgaatgtcatgaggtactggaagagctgtggcttaagctggaccgtgaccctgtatataaaggtttgcttcaagttgctgtaggactgtatcatttccggaatggtaactatcgtggtggacatatgatgctgaatagtgcggtccacaggctggagcatgctccttcgcaggcgctgggcattaatatggcgaagctggtggacgaggcgcgcgtttgcgcccgtcagcttgctgaagcagatatgaccggtacggaagagcttcagcaccaaccgccggtttatcgggatttgacgattgaaatcgtcgagcctgggctacgccgggccgtggagaaggcatcgtcgtccattccagtcaacatcccacagcagagaggtcctcggcgtggggagaagcatgagcagcgtcagcaggcgctggcagcttcaattaggcgaagacaggccgctgacggctcaggctcggcggaaacgaaggatacgccttgagtttgaagcacatgataagcaagcagcccgatccgtttcatgaggattgggctgctttatcgtttcaggtgtgtgaacgtttgactaggaggttacgttctttttatatttctcaaagaaggctttgaaatcgtcgagtgtgtacccattgtccgaaggactttccttcaacccacctactatacgttccttttccacgcctttttcgtaataaatgagcgtaggggtatactcaatcttatacttgtcccagccatcctcatactcacgcaggttaaattcgtgcatcgtaatgttctcctgcttgcttaaaggcaagagcttaggggtagtggcgcggcaatgcacacagtcggacgcgaaatgatagacgaagaagttttcctttttgtcaattttactctgtagatcttccggcttaataatttgctgatagttcgggtcatttaacagctcttgagtagcaggatttaacgaggctgtggaaacgccatacagcttgtttttagtgcctgaatttaaagcgagcagtactccaagcaaaatgaccagcacaacaaaaaagccgatgacaggtataagcttttttttgttggatttttgtgcgttcaatgcaatctctcctatcaaaattcaaaatatgtagctatgaatctcattattatacaacattacagattgtagtgaaagtttgtaaatcacaccgatattgcagaataacaggttgaatatggtacaataaaatttattttaaaaggacaggatgattacgattatgggtgtacagctccccacagcatttgtaaagcgcatggagcaactgctcggcgacgaatttgaagcatttatgaccgcctatgaccacatgccccatgccgggattcgcgtcaatacgttaaaaattccggtggaggactttaaggaacgttctccgttcgaactgcggccaattccatggtgtgccacgggtttttacattccgcacggtacgaagccggggttacatccttactaccatgcgggactgtactatatacaggaaccgagtgcaatgtctccggttgaactgctcaatgtagctcaagatgaagctgtattggacttgtgcgctgcaccgggcgggaaatcgacccaaatagctgccaaactacaaggaagcggcgtattggtgaccaatgatattagcgcggaccgaaccaaagcgttggctaaaaatgtggaattgtacggtgtgcgtaatgccgtggtactgaatgaaagcccggatcgaatcgccgatgccttttctcatttttttgacaagatactaattgacgcaccttgctcgggagaaggtatgttccgcaaagatgaggatatggcaaaacaatgggaaacgcattcggtggataaatgtgtagtcatgcaacgggacattttgcgtgtagcggcctcgatgctgagcacaggagggagaattgtctattcgacttgcacctttgcgccagaagaaaatgaaggaatgatcgcagaatttctggaggctcatcccgattttgacgtagtccctgttccatcggaagcaggttttgcaccaggccacccggaatggatgagtgaagaggtctcggcatcacaccccgaactgcggggaacagcacgcctttggccgcatctcgtagagggtgaaggccattttatcgctgtgttgcaacaccaaggtggtcgtgtcactgggactgaagatcacactgaatccggggatttgactccatttgagggcaagaatgacagggcattgaacatagatgcagcgtatccacggaagaagcagtttttgtccgtcaaggaagcactgacgccaagcggtcaaggaagacatgcgactggtgagcctaaacgaagtggaaaaggaatggacgggaagtccggtaaaggaaagtccgcgcgcggcttgggtggcaataagtctcgttctggcaaagagaatgtaaaatccgctgcacgctccccacaagatgtgttggagtcctatcaccaatttgtgaaggatcagctggaggtgtcctttacaggctatacggtggtctatggagatcgtatttatcagtcgccattggcatcacatcgtttggacggccttaaggtggtgcgaccaggctggtttatgggtaccgacaagaatggtcgctttgtgccctcacacccgctggcggtggcattacgcccttcagaggcggctagaagcattaatctctccagttcagatgctgaggccatccggtatttaaaaggggagaccttgtccatccccgttgagagaatggcactgcggaacgaagtccagcccaaaggctatactctcgtgtgcattgatggttattcggctgggtggggcaaatggcaggacggcatgctcaaaaatgaataccctacaggttggaggtggacatcggtatgagtggaaaagggagacaaacgcaacgtttggataaagttttgacccatatgggatatggctcccgtagtgatatcaagcgacaggtgaagcaagggatgatcacggtaaacgggaggatcaccaaggatagcggcttacaggttcatccataccaggatcagattgaagtgaacggggaacgtgttgtttttcgggagtatatttacatcatgctgcacaagccaccgggcgttatatctgcaaccgaagatacaagggagcggacggtgctggatttgctgagcgcggaggaacgacactttgagccttttccagttggacgcttagacaaagatacagaagggctattgttgttgaccaacgatggtaagctagcgcacgaactactttctccacggcggcatgtccctaaaacatatgaggctgccgtattgggtcatgtcacggaggaggatattcatcaatttacagcaggagtggaactggatgatgggtatgttacccttcctgcacagttgaccattcttcgccatgaacatccgcaccaggcagatggagaattcatttcctatatttcgcttgtaatccatgaggggaagtttcatcaagtgaagcgtatgttcgaagcggttggtaaaaaggtgacctatttaaaaagaatagctatggggccattaaagctggatgaacagcttccactgggcagctatcgagagctgactagtgaagaactggcatggatcggccgggatatagcatctgcaacgtcagaagtttgatgagcagattaaatataaatgacgcacaggctcttatgagattcctgtgcgtcattttatgatatagacaaccagcagagaattattcaaactcaacgttcaacactgaatcgcagtttacgaattattgtgcgcgtgctgcccgactctttttcacttcggctgctgtataagctgtaaccttgtttttacctgtcgttttggatatgtacatcgcttgatcggcctgcttgaccagttcatccgggttcatttccttcttcactgtactgtgtccgacactgatggtgacaatgctttcttccgcgacccgctggcggatacgttctgcgacatgtccaaccttggcacgtcgatccacaaccattgcgaccagttcctcgccaccgtatcgcccggtcagtccgatttcatccagttcatcctccataatctgtgccacctgtttgagtacttcatccgcacgagcatggccctgcgtatcattcaactttttgaaattgtcaatatcgcaaaaaatgaccgacacgcggattccttgatccatatatcgccgtagtcgtcccgaaaaatatttacggttatatagcccagtcaggccatcggtgatggaagaacggtaaatcctttggagcagttccacaatccgttcaaacaggatgaggaataacgtagtgtagtacagcaatggtaaaaatgacatatataggactgtgtttgatcttccagcttcttcagggatgtcatttcgcagccacaaatagccaagccagagcaaatacatgaataagcccgctacatacttctttggctgtccgattcgtggggtgatgaacacaaggctcagtataagtaccagtactcgataaaacagagtgaacccaaccagtttcgctgcgctgatccaagcgggcaacaaacctgcagtccaggcaataaccggcaatatcaataacgcacccagcagcagcaaggtccatgtctgcaagcgtttcagcttccggtagagttgaaatacggcggcattgatgagcacgaaggcagacgcctccagcacatttttccacacgattccttggagttgcatcttgcctccacctgctgaatagagattcatggcttcatatgtcataataataatagcggcaaccgaaaaaaggatataggctttttttcgttgtctgctatatatgatcacgcacatcagtgccatcatgagtataatatacaaaccgcaggctgcacttacagccccggccagagatgggaaacccaaggttcccgataaggacaacaacgtcaacatcaccgactccatttgccaaaatagtcaatctattgaacggttgatatcgttccgatacaatagacaggatttatcctatttaaaatgttataattttcttttgtgactaacatttattctcaatatatcatctttcagaaaatccggaaacctatacatacaatctgtgatccgggcagtttaattgcttgaaaggggaagcacgtcatgaaattgctacaggctctctttttcccacccgagcaaccgggaggcgtttcatccatgattccatatctgcaagagcgatttacatccccccgttgggaaatggagctattttcaatccctaaacggattcgtaacaagggtagggacgaagtaacttttgatacctttgactggacgagatatgaacaatatccaatcgttcaaaaatatattcagacgtaccgtgactatttgtggtggacccggcttcgtattcagaagccctatgacctcattcatgcccatcatccgattgcgggaatcgccatgaaaactgtttttcctgacattccgctcgtacagacgattcactcttcctatgagaaggagttaattctaaacgggaaaatagaggagaacgggcctgaacaccaattcttggtgtcactgtatggggaaatggagcagaaggcggatcgcctgatagcggtatctcattcttttcagcattacttaactccttacgttcagaatccgcaagacatcgcagtcattccgaatggatatgatgagaagcgcttcaaacccattccgcacgaaaatgaagtgacacagctcataaccgtttgtcgccttgttccggcgaaaggactggatattttattgcgggcctgtgccgaacttaaaaaaagaaacctggattttgtgcttcatattattggagacggcccggttcgccctgagctggaagagatggcgcgacagctcgatatataccatgagacgattttttatggatatacccttcatccagaagagtttatgcctttctttgatgtatttgtcttgccttctcgggcggaggcctttggttcggtatttgcggaagcagcgttaagttgtctggcattggtaggtacagaagtgggaggaataccggagcagattgaagatggggtaaatggtctgctcgtgccacccgacaatccgagggcactggcagacgcattagagaaggtcattgctgaccctgcctatcgttatgagctggctagatctgcctgcgataaagctaaatcaagctattctttaagtcgggcggttaacgagttgaagaaaatgtatttgaaattcccacattaaccatgacgagtaccacctggtttggaatcggaatgccgaaagctggagcgaggacgtgaggaacggaaaggtctcctgcgtcctgctatgatcagtttgctaacccacatcagactgagcattccgaaaataggataaaggacagataacagtgaactgaagccgaactgactgattaaaaaacaggtgagcataatgaatagtgtgatgagcttgggcgaaatttggacatgctgacgaatttgcagactgactccataaatgtcggctacaaaggtactgaagatttccatgaaaatgagtagaatgtatatgatttcgacaaaggcacccagacggtaagcaatgcttcccatagggatttcaaattgctgaatacccggcatatgtgctgacatggcaaagtgtgcagccatcagcataaacccgacaccaactccgcccaaaactccgccccagcggatggttcttcgggaaaaggtttgactgccaagtggtacaagtacggcttgggccatagttaggttgaaggacgtgtacagcagtggagagagcaaggttcgaaatgtactgtgatctgtcgtattcgtaataaaactctgaggattgggcatggagagcgtgctgtgaacgagcagaagagacatgatgatcatcagagggacaaccacggtgttcatgtgcaagatggccttaatgcctttacttagcagcaaataagtaccaatcagtgtaataagcagtccggtttggtaatgcaggtgaaggtgctctacaaaaacagagccggctcctgccagcatgacgctgtttacgccaatcaacacgatgagtgtgaaccagctaatccatttcccggcattggcaccaaaaagatgtttgttcaggtcctcgtaggatttggctgaaatatcatgagcgatcagcatcattttcgtacccaaccatacaaatatgattgtggatagcataatagtgagtgtagcccaacgaccatactgcgtaaaaaattgcagaatttcttgtccggtagcaaatccggcaccgacgattgtaccgatgtatgtaaaagcaatttgaaaaacatgaatattacgtttcatccccagtccctccttgcctgcttgaataacgctgcagcgagcatataatacaaactatgttcaactgaaataggacatgactggatgagactgaaaataattaaagtgaattaatgaatagcttgacgggagcgtaatttatgggtcaaatccttgcatggatacttgaatacggatatttggcaatgttcggcttgcttgcacttggagtggcgggtatgccgatacccgacgaagtgctaatgatcgccttcggcgggctcgtgtctcaagggcactacaacttcattgctgcactggcagtcacatttttcggtagtatgacgggtatgatgcttagctacacattggggcgtctgttgggcaaaccacttttgcatcgatacggaaaatgggtgaggcttacgccttctaggattgcctcttctgaaaattggtttgggcgctatggtacctggggaatcctgtttggatattttgtccccggcctgagacatgtatcctcatatctggcaggtacaacccgtttaggcgttttccgctatatcagttatgcatcagcaggagctttgctgtggtgcggtacatttttggggattggacatgcggtgggcatgcattgggagcaggtggcgaagctaatggagaaggtgacgcatcaggtagggctggtcgttattcttttaatcgttgcgggaggaatcaccgcatggttctggaacaagcgtaaaaaaaatgtcacatgaccgcatgggaaagcagctatagcttgaaagcggcgggtgaagtatggtacttttaccgcataggattgccgtgggaggtcatgtaatggaagtattaaagaaacgaattttaaatgaaggcgtgattgcatcagatcaggtgctgaagctggatggtttgcttaatcaccaggttgatccagaactgacaatggcaatgggacgagagttcgcagcacgtttccgagaagagaagattaccagagtagtgaccgtggagtcctcaggcattgccatcgggtttgcgacagcattggaactgggtgtaccgttggtatttgctcgtcgtaaaaagaccctattagctgatccagacgcgctgtgtgaacgtgtaccttcgtttactaaaggtattgttacggatattatgctgtctcgtcaatttattcacgaagatgaccgtgttctgttcattgatgatattattgctaatggtgatgcggcgcgaggtatggttaaaatcattcaacgctccggagcggagttggttggatttggtgtcgcggtggaaaaaagctttcaggccggagcgagaaccatccgtgagcagggtattcgtgtagagtcattggtcaaaatttcgtcgttagctgacggcaagattgagtttgctgaatagtaacaattcaaaactcctgatccttatttctaataataacctttgcatgagcttcaatttcgcttataatatagataaggttttggagaggaggcagcaacatggggaaagaacaattgaccgaacagttttttctggaaaaactggcagcggctaaagtacactttgagcgtgccttggattgtaagcatacggaattcgacgatttgtatccctatatgattgaacatcctcagtttttttggtataaacgctatgtggcctggtctgagttgttgacgttggttaacctatgcgaagaattgtccttctcttggaaagaagaatttactgctcaccaagtggagtatgtagatcagcgagtgttgtctgcacaagtgctggacttctggtatgagaagaacgatacaaaagaacatgatcacagtgtgaatcagtcgggataatttgtcgctctgttggcaatccatataagtagtaagagagaagagacctaaatgattcgtttaggtctctttttaaacttttttcatgtatatagaaccatgatcgttatgctaaaaaagtgaataaggaggggacaaggatgattatggacgaagaattggatgcttatcgactctccggtgaaaaggtacgtgtcgtacgcgatggattggagtccaacgatgttgtgggcattgtactggcatgggatgaggaacaggtgcttattcgtcgccagaatcgacgtgtggtcaaattggatcgcagctatacataccagtcattcagcgagccgcgtcacaatccgatagatctggattaggaatgggttctcaaatgggtgttggataaaaataactgggtgattcattaggcatacagaaactctaaatcggacacagtaatgaaggaaaatccaacagagaggacgtgctgtgtcaatgacggttatggacgaaaaagtacatgcatacaaggatcaaatcagccatttggaagatcggttgcccgaggtagttcatgcatatcatcgctttaccggagagtgctttcaagccggcagtctagatgagaaaaccaagcaactgattgcgctaggcattggcttatttgccaacaatgaagtatgcacgttttatcacgtggacgaggcgcggtccaaaggagccagtgatcaggaaattatggagaccattgctgtagccgcagcagtaggtggaggacatgctctaagccaaggggtaacgcgtgtacagaaggcgttgcaataaggcgaatcattaattgatgagcttatacttcgtcatagcggttatagatcgatttggatatatgatgaatatggaaaaaagcttccgcgcacagttggtgtctgcggaagcttttttcttttgcgtgttggttgtgcggggattatgcaaaagcagcagggcgagacgttttacgcttataagccaaagaggatgtaaccaaacttcgttcaacgatgcgtagaggtttggatgttgaattgtttggtaattcggagcgatgtttctctagtaaaggaagggcagctgtatggggcatagaggttgagagcccgagatatgctcgcatccgctcatacatttctttgcggaacgctggcattgccatactgaactgctctttattgcctttacttatataggtggcgtgaacgccggagtggttttgttgtatgtccagaacatgaatgtgatatttattaaattcatgttttatttcagacagcaggatcccggtacgatctacacctgcattaaccatttcgacataaagaccaggggttttcagcataccgctttcttcaagaattaggctgtcccgctcaaatactttttgaataaaggtaaggagtagataacttttcacaagagaccattcatgctgagtagtatctaaagagatcattaccattcaccgccttaggaaaatgtgatgataattcataaccgaatgaagaaaaggaaccttcgttcccgagaacttatgttcttattttagtttattattccttttttatcaagaggaaattaacaagcataaaaggtttgacatctcgatatgagcatggtatgatctatcttgtcgctaagaaagattgatctttcgaggataaacgacaatttatatgcggtcgtggcggaattggcagacgcgcacggttcaggtccgtgtgggctaaccccccgtggaggttcgagtcctctcgaccgcatctattagaaaaggtctataaaattgctctcgtagcagttttagaggcctttttcttatatttctggggatttgctcatagtttaagctgaacacgtttcttgtcttcccgaaaactatggatttccataaaggattctgacaaattacttgatttcttttaggtggaatttttgcgaattcctcaagttcataaacaattcttttataaggttatcttttaagatatgatagaaaataacgcactttatgatgaagttattgaaaggttggatgtaagatggagaaagcgacttttgcaggtggatgcttctggtgtatggtgactccgtttgaagaacagccgggcattcatggcattgtgtcaggatacactggaggaacaattcccgatccgacctacgatcaggttaaaacaggaactacaggtcactacgaggtggtgcagattacttttgaacctgagctgtttccttatgaaaagctgctcgaattatattggccgcaaacagatcctaccgacggggaaggtcaatttcaggaccggggtacacagtataaacccgcaattttttatcatacagagcagcaacgtgagcttgcacaacagtccaaggagcagttggcacaaagtggacgctttgacaagccaattgtaacggagattcttcctgcttcgattttttatcctgcagaggattatcatcaggattaccacaagaaaaacgtgaagcactataaggaagatcgggcccaatcaggtcgtgatgaatttattgataagaactggtaagcggctttaacatacgtttctacgcacgataaggcagtcagggattattccatggatctgccttatacatatttagacgacgttactcacacaatgaagggacagagaaggaggctgacctgcaatgagtacacgacggaagctgcacatgagaaatataataaaaaaggctttaaaggaatctcgcgctcggaaagagccagcttatgtacctgtattccattcaagctccaaaatgcgaagaaccgtagtactctgtatttcggtatgcatgttattcatggtctgtagtactggtgttgcagaagcaatagacaaacaggacgatccgcaaaagatggttgctgtcattattgacgatctgggaaaccatatgaaaggaactgagcaaattttaattttacccgttaagattaccgttgctgtgatgcccttcctgcctacaaccaagcaggacgctatggaagcgcataagcgcggtcatgatgtcatcgtccatcttccaatggagccaaagcaggggaagcccgaatggcttgggcctggagcaattaaggctaatatgacggatgaagaagtacgtgcgaaggtgacagcagccattaaggatgttccttatgcgatagggatgaacaaccacatgggttccaagatcacttctaataagcgcattatgtccattgttcttgatgtttgtaaggagcatggactattttttgtcgatagccgtactaattatcggtcagtggtccctgagcttgccgctaaaaagggaatgccaccagtacgaaatgatgtttttctggatgatgtccataacctcgcccatgtgaatcggcaacttacaaaagtggttgaatggctggatgagcacaacacctgcgtaacgattgggcacgtcggcgtgtctggtatgtacacatcctccgctcttcattcgtcggttcccaagctaaaggagcacgccaaatttgtgggtattagcgatttggtacgagctgtatggggatggacgggagacccagccatcaacactaccatgccgtcaaatgcgcaataatgcctgcggcaatagcttcggcaatgcttttttgaccacgatcctcggaaagcatagctctgtcctgttcgttactgataaacccggtttccacaattacagcgggttgccggattttattcaaaagataaaagggttttccgtacactgtttttctattcatgcaaaataagcggtttaatgaatgctgaatccgttcagctaacagatagctgctgccttcatcctgatacagtacaatgggtccccgtttttcggcacgtttgctccaattgacatgcaggcttacaaccaaagcggtgggcagttgttctgttaggcttttacgttgggcgaggtctttaaggtgccgggatttggactgcagccaacggttgtcgtcactcagtgcgtagtccttgtcccgattcaggacagcaggatatccctgggagcgtaaaatcaagtacagcttttgagcaatggcgagattgatatctttttccaaaattcctttgtgacttgttccaccatccacaccgccatggcctacatcaatcaggacaacgggcttagcaaaagcgtgataggacgaatgtacgttggatggactatctatatacttgttcggttcgttacttttctcgtcgggctgagcagctatataggtaaatggggcgaatacagcactgcaaaggatgcatagactgaaccccaagcatgtcagccatattttgtttaacctttttttcctcacattctattcccccagtggacgaattgattatttactgaaaaaccatgcataacaggcatcaaacctaaagcagcgtagctgccttcaaatatggcaattagccttggggtaactgttatgttgaagatagtatgttccatttaagggaaaccatgcatagttattcccacaggggttagaccttttggaaaatgagcaagctagttttatctgcacctaacgtgtgaatccgatatttccaagcaacgtaattggaaacaataggtgcagattggaggaggtcatggaggatggcgaagagtgacgaactggtgacgtatattacgcagcggattgttcgctatatggaaacgccgcgtgatgttcggcgcagtcaaaaacaagccagagagccgtgggggagcaaatggtttggcatgttgcctctcgctctgaaaatgtggatgaaatccacacgcagagggcgaagggagcgacattaaactcgccaaagagaccacaagaggcataggttatgccatttgaggtctctttttatgttgtagagatcattccgatctttttcgtgtttattaataactaggagtccaaacgataaaattcgccagctgacaataactgttttagcggtacaaatcgggaaagtccatgatggtaggttaacgcatataaattgggttgggacggatgatctggggatatccaagactgatacccactaatggataagggacctccaaaggcaaaattgatacctgtggcagaaaatataatacgcggtgaaatactcagtgtatccataaattgggctgtgttacggacagaaagtttttgcttgggttgaagccaacccagatcgtcatagggatcgaaaggagcagacgagaccgtaactgtctgcgcctgtgttttcaaaaagggtacagatgaagagaatacgttgttttggagcttatgtttccaactcccatctgccacttctacaggtaacggatcgccagttacagcatcaatacatatttcgctgcctgtagaggaacgcaccagccagtaggctagtagcggttcctcatacataggtgtgatttgcagcttgtcgatagatgaaagatcggtttctgtgagcgacaccagagattggcgaagtatatccatactataaggtccacccggaccattcccatattcgttgagttgatatacgccgtttgagtctgatccgataatcaggtagccgatgtattctcccgcacggtttacttgaacaagccaactatgggttccaggtccgagcggatgatagctaagctcagcatctttccacgagacaaaagggggctgcgacgatagggattgtaccatgttgtctgcagtctgttttacgtctgcgggcacgccttgctcctcagtaggaaaacttgctgaaacgtcacccggggaaggagtagcaggactcgtggagttcaatggagcaacccgcgagctttcattgtagagagacaccaagtttaaattgttgccttgtgcgactgagggagccgcatgaatggaagcgaacggacagactgcggacaggccgatcagaacagctgcgatcatacctatggtatagtgcccggaatgattcttcttcaatgaaatccacctttctgtcggcttgattgcccgacggaggcattctttttatacagcatacagcctgtccgataaaaagactgctgcaccttgtcggcgcaaatgtcgtatccaggttcgctttttgctgtcgatacataggagacatgtttaaccaaacttgtggttacagcagcggaaactggtgtaggctgaagcaagatgttacaagctgacgatacctctgcaactctcctgcgaaggagcaagagatatcggttaccgcagatgaaatatcccgcagttaatggcggatacgagtaccttgggctcatactgccataccatttctttacggcgggcttgatgctgctctgatatggcttcttttttatcctcttcctctttctgttccttgattagatcatcgtagtaatggtcaataacctccaattcctcgcgcaatcgttccttcgcctgctcagcccaatcataatcttgctgacggagctgttcggtgagatagctttcaagcgagctagaagcttcagggacagataactcggcaggctgcacatgcatattacccgccagcagcgggctgagctgccgggtttcgagcatggcgccaaaatcggttacaatggtgccgcttttaagcgaaatacctagccactgaagttcctcacgcttcaaatcgcaggcgaattcaatcttatagcagatgctgagccaagcttcatagactacgggagagcgggcagacagctgacgggcatcaggctgctcaaacaaataaacatatttccctccatctcgtgcggcttcaaaaatttgatgcagccgacggcttccatatcgaagctcctcctgcaaaatacgtccaggtcccaattgtggtaatgtcggtacatgaccgaagtaacgccccatgacctgatcttgtgctgcgttgcctgatgctggagttggtggcgtatgatccgctaaacgttcctgttctgtacgataggcttccccatcaaagatgaaagtgaaggacatcgtctgcgctggaacgccagtacgctctacgtatccccaatagtaggggcggtttgttaaggctttatccgcttctggagaaagcttgacggttacatgatgaggcgacctctcaatgacactgcatccggtagcttccagataggtgtgtacaaaacgctggacttgctgtgcattcatggtcaaactagcgacctcccttcacactgcgtcgagctttgcccggaggaaccgtattgcctgctaggcctaataaatcctctgtgtttggctggtctgtgcgcagttgttccatttcctgcttgatggaatccagcgagtggcccagcttttgcatttttttgcgaatttcatcatcgctactggattcaagcatgattttatacagacttttttcaatggattcttttttctcaaatttctcaagaataacgtccaatccgccaatgaccatctcaaacatatttatcttttcatgcagcagatgcaggatatgctcctcaatcgttccggttgtggacaagttgaaaatattaacatcatgcgtctgtccaagccgatgtacccgtccgatccgctgctccacgcgcatgggattccacggtaaatcgaagttaatcatatggtgacaaaattgcaggttaatgccttcaccacccgcttcggtggcaatcatgacctgaatgcgcccacggaacagatccatcatccaatccttgcgtccacggttcataccgcctcggtaaggaacagcagataggccacggtcacggaaataattcagcaaatactcctgtgtggcccggtattctgtaaaaatgatcactttttcgttcatctgacggataagctcgagcgctttttctgctttggaattggccttgatcgctttaatatgtgcaaccaaatcccagacacgatcgcgtaggggagagtctggggccatttttttagacaaattgaccagcgtcacgaacacagcgtcccggctgctgcacacttcccgttgaagggtgacgagagacagcatgctacttaaatttccgccattcgcctggtattgctctttgacaaaagaagtcaccccatcgtacagcgcttgctcttccggcgaaagttccaagtgaatgttggaaacatttcgtttggtgaattgaaccgggccttctccgcgacgattgcggatcatgactttagatagctcatccttgagctgatcttcatttttgggcagacgtttatctacaacaaagttggctgaaaaatcgccatgtcttcccaattgaccaggcttgagcagtgtaatcaggttaaacagctcagacagatcgttttgtacaggtgttgctgtcaggagcaaacaatattttttgcgcagcttcataatgaactggtagttggatgtctttttatttttcagcttatgagcctcgtctataatgagcaggtcataatcggtatctagtaggatgttactatggggctcccgcttggcggtatccatagaggccacgacgacctcggaagaccaagaatacgcttttttctgggcgacagcgggaataccgaatttgctgttcagctcacgcacccattgtaggaccagagatgcgggtacaagaataagcactttggaagccagcccgcgaaccagatattcctttaggatcataccagcttcgattgttttgcctaggccgacttcatcggcaagaatggcacgtccggacatttgaaacagtacctttcgagcggtatccagctgatggggtagtggagtgaggtcttgcaaatgctgtagacattgaagctcatcaaagctcggcaccagtttgactttttcagcctcaatggccagctgatacagattccaatctccccaagggccacctttgcgcagccgctggtccagctcatcctgccagcttcgatcaaattgcaccggaacaggcagtggcgcttgattaggtatgtgcggggaacttgtcgatttggctttcatgatgattccctccctcctggtagtagcacagttgaagctcttggttctgtcacatatgtggcatctatttagcacagatcgtagatgtagtatggacggaaaaagatatcttcataacaggagggatgaaatcctttagctgccttccattaacttttggagtttactttccgtagaggtctgcgcattaggggtgtagatgctgcaacggagatcaacactgccctgtacctgaagagaagtcaggtcaaatagcattttgccagccttggcatgacgaaattcaatgagcacctccggcgcggagcttacttcactctgattccaaagctcgttaaactctgggtaggtctgactcatattttgtataaattgtgcataccaggggtctgttacgtattgtccgtaataagcgcggaaaattgcaaggaacccctttacaaagtgttcccaattcacggctagacttttaaactcctttttggtgaatagcagttcaatcatattgcgttgctcatgtggtagctcggcaaaatccataaaaacatgagcagcagcggcgttccagccgacaatatgacaacgccgatctgaaataatagcagggcagtagtgtagctcttgtacgatcttttgcagagagggggaaataacggcctgctctgcaggaacaggaaggctgtgagacccggcctcgatcgccaaatcatacaaatatttgcgctcgtctgtgttcaactgcaatgcggcagcaatagcatccaacacagaggcggacaccttaatatctcgtccttgctccagccaggtataccaggtcgtactgacacctgccagctgagcgacttcttctctgcgcaagcctggtgttctgcgacgtgatccttgggggagaccgaccatatgtgggtgtaggcgggccctttttgtttttagaaaaacagatagtgcttccagacgtgcttccgttttcataggtattttctctccattcaatgggtatatccgaagtgagcaaataaggcgtttactatagtagtgttcattataccaggataaacaaacacttgtaataggataagacaagggtaaaatgaggattataagtaactcaccgagcaggaggaatgaatagcttatgcaaagagtagtgataacaggtatgggtgtcgtttccccactaggtaatgaagtggacacgttgtggaagaatttgctggaaggcaattcaggtatacgtaaaattgatacattcgatgtgtccgatttgaaagcacaaattgctggactggtacaggattttgatgcagaaaagcaatggggacgtaaagatgctagacgaatggatcggtttactcagtttgcattatatgcggcagaacaagcgcttaaggattccggtctggaactggatcacaccgatttggagcgtgtaggtgtctatgtgggatcgggagtcggcggtttggatacgttggtggacaatgtagatgttctgctacaacgtggaccgggtagagttagcccgacgctggtacccatgatgatctcgaatatggctgctgctcaaattagtatcgcgtttggagcgatgggacctacgctttcacccgtgacggcttgctctattgggaatacagcaatcggagaggcatttcggacgattcgaacaggagatgcggatgttatttttgctggtggagctgaagcggcggtgactagattggccttggcaagcttcgctaatgcgactgccttgtccacacgtaacgaggagccttctatagcaagtcgaccttttgatcaggatcgagacggctttgtcatgagcgaaggtgcaggtattctggtactggagtcactggaacacgctatccgccgtggtgcggaaatctatggtgaggtcatcggttatggagccagttcggatgcttatcacatggttgcaccgcatcccgaaggaaccggagcttacttggcgatgaaagcagcccttcattcggcccacatctcccctgaagaagtggacgtgattagcgcccacgcaacgagtacgtctgtcggggatgccgctgagacccttgcaatccataagctgtttggtgattatgcctatcagattccggttactgcgaataagtccatgctgggtcatatgctgggagctgcgggcggggtcgaagcgattgcgcttgtgcaaagcctacgggaaggcatcattccaccaacgatgcatctggacaatccggacccggtttgcgatctggattatgtgcctcacgaagcgcgcaaggctccactaaatattgggctatctaattctttcggcttcggtggtcataatgcggtcattgtgctgaagcgctacgagtcataatatgtaaggagttattgaaaccaaacctcaggcattctatccggctggatagagcacctgaggttattttaatcgaagaataacagattcattttagataagagatagagtaagatgaaggaaaacatttggagggacgggaagccatggttttaatcaggaacatacaaccagcagacgctgaggcttattggaatttgagactggaagccctacaaatgaaccccgaagcttttggaacctcctatgaggaagccgcactagttccgctatctgatgtggtgaagcagatacaaaataaacgagatcattacatacttggtgcatttacaaaggatcatcagctggttggcatgaccgggtttagaagagagcagaaaataaagacgtagcataagggagcaatttggggagtttatgtaccatcgacctatcgaggccaggggatcgctaaaaaacttttattggaagtgatcagccaaggtagaaaagtggaaggtttgaagcaaatcaacctgagtgtggtgactaccaatcaagctgctgttgagctgtataagaaattgggatttgaaacctatggtatagaaaagaatgctttggaatatcacggtcagggatatgatgaggagttcatggcttatttttattaatgacgaaaggttttgaaaaaatgaaaattgaccgattgctttctatcgtcattttgctgctaaagaaaaatagaatacaagcgaaggaactggctgatttatatgaggtttcgatccggacgatctatagagatattgaagcgattagtatggcaggtattccggtggtcacttatcagggagccaacgggggaatcggtcttatggaaggataccgcctggatcgcagtatgctgacggatcatgatataaaggatatcgtgatgggtttgcagagtttgtcctcgtcgctgggcggcccgaatgtgtcgcggttacttcataaatttgaaagtattataccggaatctgggaaagagcaatttagtgtccataccacacagtttatcgtcgatcattcgggatggggaaatcgggctgcgcaggaaggtaaattgataaaggtgaaagaagcaatgagccaagcacgtactgtcgcctttacctatcgaaatgcggggggagccataacagaacggaatgttgaaccgcatacgctcgttctgaaaggacaacaatggtttgtatatgcatattgtcccgatagggagcagtttcgtctattcaaactttcgcgcatgagtgaccctgtggttacaaagaccgtttttgctcgcagggatctttcttatgaagtgctgccgtggaatgaggagcggatggaggtatccagagctgtacaaccatttacgctgcaatttaaccgtaactcaaggcatttggcggaggactggtttggtgtagaagcattgaccgagcaggaggaagggatctatacggtttcggtcccgttccccgaggatgcatgggcgtacggatttattttaagcttgggaccggatgtggttgtcaaagaaccagcccatttgcgggacaagattcataagatggcgctgcgtattgcatctaattatgaagaagttcgggaatcataaaggaaatcttagattaaagtaaaacaaacctgacccatagttgtcaggtttgtttcgttatactggtggcatacctaatatcagttagcgaaaggggatttacgaggatggataaagcttgtcaaagttgcgggatgccgctagagcatgaggaccaatatggaacggatgcacaacatcataaaacggatgagtattgcaagtattgttacaaggaaggcgaatttgtacagcctgaattgactatggagggaatgattcagcagtgtgtgcctatcctagtagaggaagggatgcaggcagaagaagcgacttcgatgctgcgcaattacctaccgtatttaaaacgatggcggtccccagaggatacagagcttcaacttgatggacccattcgggaggagtaccgaggtgaaatccatttaattgggttgaaagcacgtacaaataatcagaaggaacaaacatctcacgggatcattccaaacatgtgggaacgtttttggagtgaggacgtgcctggtcggataaaggaaaaagcaggacatgcttctgtctatggttgctatactgactatgaaaatggagctttgggcgagtatacgttttttatcggaaaggaagcggataaggatttccagactcctgatgaccttcaggaacttgtcattccggctgcacgctacgccatttttcaggcaactcaggaaccctcttctatcttccgtgtatggcagacgatctggcagtgggctgccacgggacaaggggagcggacatacacaggtgattttgaagtgtatggcagtcctgatgaacctgttttgatttatattgcaatcaagtgatgattttgtcatgacagaagagaaccgccggtcattgtcgtggacccggcggttttttctgattcaatcaatagcagtctccccatcaagttgaacgtcgagttaaagcccaaaagatgagagccagagcactgacaccagctcctaatagacacaccccgttccatccggcatagatgtacatatgagtggaagcaatggcaccggtggcgctaccaatggaataaaatatcatgtagcctgcagtaagtcggctccgtgcctcagggcgcacattgaaaatcaagctttggttggtgacatgtacagcctgtaccgccaagtccaaaagaatgacgccaagaactaaagcgaacagagaatgctcggtgtagcggataggtaaccaggacagcagcaacacaactagtgcgatacccgtcgtccgttgtcccaagccctgatcggcaagacgccctgctcgtgctgctgctaatgccccggcgactccagccagtccaaaggccccgatagcagtatgtgaaagagacaatgggggtgcactgagaggtaacacaagcgaagtccacaatatgctgaacgccgtaaaaatgagcaatgcaaggacagcacgaatacgcagaattcgttcttgcaagaatagcacgataaccgatcggagcagctgcggataggaaagtgtcgcacttgtgggttcgttctttggcaacacccgcaacagagttccagccataaacagcgtaagtatagcagaaacaaggtaaactgaacgccagcctgccagatcagttaatacaccggccacggttcgtgccagcagaatgccgataacgactccactggtcaccagacctacgatacgcccacgttcagtcggattagccaaggtagaggcgaaagccacgagtgtttgagtgactacagccagcagaccaaccattgccattcctataagcagtattgtacgggtaggagcaaagctaaccacaattagtgccagcacggatagcagcatttgccctgtaatcagtcgccgtcgattcaaaagatcgccaagcgggacgagcagcaataatcccaacgcataacaaatttgcgtgatagtaatgaccatgcctaccgatgagtgcgtaatgccaaattcgtttgccagcgcatccagcaatggctgtgcatagtaaatgttagcgacagccagcccgcaggctatggcaaacaagagtgccacagatcgggatagggagggaatgggggctgtttcggcagcatttgctaccgtttgatgagggaggcgtatcgctttttcttctgacgtcttcattttcacataccacgtcgctttctgtaatttacataccgttgagtataatataccgattggtatgtaatgaatttaggtcaatataactcgtgtatatatgaaatgtcaagagttcatcatgtacatatttgacagtttcttatcgtgatcatacaatcttaatatactgaacgatatgaaaagaaggagctgcttatggttcgaccacgggaatttgatgaagatcaagcgttggatgcagcgatgcgaattttttgggaaaagggattcgaggctacatcattaagtgatttaacctccaaaatgggaattcagcgccctagcatttacgctgcctttggagacaagaagcaattattcgaagctgcgctgcgcaaatatacgcaatcccacgctgcttatgtacgctctagactacaaagcaattcttctgtaaaagaagcgttttacaatttttttggagaagtcgtggcagaagagtacgaggatgggcctaatagaggatgcttttgtattaatacgatggtagaattagcccctcatgatgagaaatttgagattttaaccagagaacatcagatgtatctttctgccgtctttcaggaaactctcgagcgtggtataagatcaggagagctggaggctagcatggacgcacgagctctggcccatacgatggtctctttgttaatcgggattaccgtgatgatgaagtcacgcccagagcgttcttttgtggatcatgcggttgcgactgcactcatgttgctagatggaaaataacttaggaagggagaacactggatgccacagataaaggccgttcaaacttcaattggagaattgtatggacgtgatgcggtctatttggaccatgtgcatatgaattatccgaagaaggagctggttttaaagggagaaattaatggggggctggcaacggaagcagcagatgattttgtgccctatgaactgatatttacagaagtctactacttcaacatgattgaattagacgtcgctttgcacatgtctgaacgggaatatacgcagggcagcagctttgatgagcttacagatacgccattattagctacaatagcaagcgcgcgggggaaaaatctaaagcactatatgctgaaaacctatgacgatatagtagaaattgcctgtagagactataagatgactatataaacgagttgatttttagaagaggaggcggatcaatggatacatgcactccaattagctttaaaactgaatgcacgaagcattgtctttccgaatatcagcacaggcatctaccgtttcccgaaagaaaaggcggcggatattgctatacaggaagtgacacgttttgtacgtgaacatgcggctttgaatgagattgtttttgtttgttttgatgcggaaaatgctcagttatacagccgtaagttacaagatggtgttaacgatattcaaaaagatacagttgaatgagagaatacatgagtagaaattaggggggatcatgaatgcatgaggagcaaaaccaggaacattggccggtgtgggctacggagcctgtaaaaatagtgaatcctgatcctgcctggtcagaacagggcttaaagatcatttatcaattgcgggagttattactgccgtttaaggtgacggaaatcgaacatataggaagcacggcaattcccaatctttctgctaagcccattattgacataatggcaaaattagaatcttgggatcaactggaacagatcgtgtctgctttacaaccagcaggctggaactatgttccgcctgaattggacggtcgggaatggagaagatttttggttaaagtggaacaggatcaaagaaagggacatctgcatctcatactgaaatctgatgagcattgggatcggcagctgttgtttcggaaccgacttcgtgaacagcctgagctgattcagcaatatgatgtattaaaaaggcggctggcgatggaaaatcagcatgatcgtgaagcgtacacggaggccaagactgattttgtgcaaaatgttctgaatatcggacatcctaaagattagaatgtccggactcccgggtactttccgaccaagcgccgaaatctccgacatttgttattgccgtgtaggggaatggccggaaggcttgccagcacaccagaaaaagcttattcagaagctactacaatagtgttcatccagtactcatgttcatttcgtgataggaaaatcgtatttatagacgtttcaagaatgcgctgatgcgttccaaagccatttccagctgttctcgcgatgacgcgtacgagcagcggataaagccctcgccgcctgggccaaatgcggaaccgggtacagtaatgactccttcttcttccagcaaccgcttggcaaactgctctgaacttaaccctgtgtgcataatggaaggaaaagcatagaaggcaccgtttagttcgtgacatggcagtcctgtctgacataggccttcaacgaaccattttctacgcagattgtaagattccatcatacgatctttttcctccagcccgttacggagggattcaatagcggcaatttgcccgataataggagcgcacatggcggtatattgatgaatcttcagcatagctgaaatcaactctcttgggccacacacatagccgaccctccagcctgtcatcgcaaatgctttggaaaagccgctaatgagcagggtacgctctttcattcccggcagagaagcgaagcttacatgcttctgtccataggtcagttcagcatatatttcgtctgatataacgacaagattatgctcctcaaccaggcgggcaatcggcaaccaatcctcataggtcatcaccccaccagtcggattattcggataacagagaataagcactttggaacgtggagtcagcttggcttggagtgcctcagctgttagcttgaactgctgatccgcagaggtttcaaccgttacggtatgtcctccgttcagaaacgtgatgggcgaatacgaaatataacatggagccggaataagtatttcatcgtgtgtggtgatcagggcgcgtagtgccaaatccagtgcttcactgcttccaatggttaccatgatttcatctgtcgggttgtaggatgtgctgaagctgctctccagatacccggcaatctcctcacgaagctcgggaagtccagcattcggtgtgtatgatgttttaccattttccagtgctgtgatacaggcctttctgacatgttgaggggttacaaagtcaggttcaccgacaccaagcgatacaatatcttttctgcctgtactatattcaaaaaacttacggatgcctgaaggtggcatttcccgtacagctggagtcaaaaaatcggttatagatactgctgtcgatacatttgtcatgatgatttcctcctttttgaaaaacaaaaaaacccgcccctgtaaagggacgagttttatacccgtgttaccaccctagtttcattccatacgaaatgacactctgttcacgtatccatcaatacgtgttccggttaacgctggaaaggcggcagagcttacttcaggttcagcccgcttctcagagatggcgttcggctaccctcggaatgttggctttcacctgccccaactctctgcaaatccgctgtatagcttactcgttctcgtcattgaaatttgttaccgtatcaagttaggtgtaattataagcacaacatttcaggatggcaagtctttttttataaaccttaaagacagatcatcattattgacgactggaaaataacgtatatagtggtatcaaggggattgtgccccagatttcaatgtgttatatgactatattgccagagaggaatggtatccatatgaacgtatttgaacgctttagcggtaaagttttgccggcggattggagttggatgaatgagccggctgtatggggattcgatgattccaagtctttgcaaatttctgcaccttcacaggcggatttctttagagatccgtctggcgcagcggtaaaatcgtccgcaccctttttgcatacaacgcttcaaggtgattttacaatatggacgagggttcgtgttgatatgaagcagccttatgattcaggatgcttgatgatgatggcggatgatacccactgggctaagctgtgttttgaatattttgaaagcactccatctattcttagtgtggtcactcgggatacatccgatgattgtgtctctggggcgatggacgtgtccaatccgtatttacgagtggcacgagctggaaattgctttgcatttcattattcatcagacggtcagcattggaagctggcgagatattttggtatgaatgttcctaaccagctcaaagtcggagttgttgctcaatctccggtgggggagggctgtgctgttacctttgatgccttgacgataacaacccatgtatccgaggacatacgaaacgtggagtaaatagacaaaggccctctctaagtatgaaagcgctaaaaaatagggcttaaaaagacgtatatacgcatgctcaggcaggaggtagatggaaacttgctgttaagaaggaagggttacaagctgcccagtttgttgggagtgctgcttgtagctacgttgggctgtttcggactcattatgtatttacagtccacaagtggaacgaggatgtatcaatttctgtattgggatatattcctggcctgggttccggtctttatcactctgggaatgatggctttatcccgactgcgaagtacaaaagtgagaagtattcttttatttttctcctcaattgtatggttgttttttctgccgaatgctctttatttggtgactgagttacttcatgcgtttcgtttttacgatgtgaatcctgatacacgtttttggttgaacacacaattttggttaatcttatttacgtctttttcagcagcagggcttggactttttcttacatccctttgtgtattggtgatccaccatatgctgaggaggatttgttcaggtgggcttgcatgggctgtagtttttgtgttgttgtggctggccagcataggcgtatatattggtagatttgcccgctggaatagctgggacatattattgcagccactggtgctccttacggatatttggagatggggagtacatgcagtaccaaggcttcatttgctgtccttttgctggttggtgtttgggatagcagtcattttttatttattgatctatatctctttaagtgaggatcaggatatttaggccgaggacatgtattcaatgaatacaggcttcggcctatttttacatgtggcgtgtcaggagttggcgttgtcctctccgtgcacatcataaagcacacgcacaagcagatcctgactgaaattcccaaatcttttgccgaaaatagtaagcccacctttgttttccgattgatcggttacggataagcggagtgtaatgtcgcttttatagttaaggttaatatcgtcaattgtgacttcggaaatgcggcacccgtcaatgaagctgccttgctgattgatgcgaattaatttgagcataccatattgatttaaatgcggtggccaccaatctggattgagaacccccggcacttctccaaaatctccggcgctggtccagtgcccaatagaaataccgttaatgtgaaaacaaatgtcggagggatattcctcacaatagcagggtgcttctgagcctagttctgcggagaattgaatttctttaaaggattgattcgctttcaaatagttggggatgcggtattccaaaaagccttcggccatccagatcatttccgactccagccgcccgggatctgcaaaatagcgtggatcatcaaaatcgccgataatgctgtctcgggtcaccaatccacaagtggggaacgcttgatagttactgtaatggcctacgcgaatctcaacctcatacacatttttttgttctctgctgcgcaaatctaccatcagcttatccttgttcaaataacacatttttcgggtaccgtgcttgccactcacggtattgatctccacaagaccgcattcttccaattttcgaatatgcattgtaattgtaccgttactcaaattaagtttattggcaatgtcattcatactttgtccctggtaagcaagtaactcgagaatttgaatgcggatttctgaacctagtgctttaaagatatctaaccctgacattaagttcttaatataaatcatagctatagaccatccttatctataaaaattgtaatgtaagcgcttatatatttactttgatttatgttaaaataaaatcaaaaagaagtaaactgcttttttgtaaattttttttactaaaccaagaggggagcgaattgaactccaaattagggattacttcataaataaatcgtatttaagatttatttatagtttttttgatgtaaataaacttaaatacgatttaatttcgctttccatggtattctaacctatgttttataactatttaaaaagattgaaaaatacattgacgaaccgaggaaaggcatgctatattttttttgtaaacgaattcattattgataaagaaaaatattaattatacggtacatgagagggatgataatcacagcggcaatcaacaacgggttgtgtaccgcacagttaaagattaggccgagtggtatgaaattattttagcaccgattgtatgcggtttcatttaaatttaggaggggtcgcgttgataaagaaaaaaggttttgcaataacaatggttgttctgttgttaatggtggctgcactggctggttgtagtgggggaagttccagtggtgatggaagtaaggaactgacattcatgttccgtggtggaacagatgaacaaaaggcttataaggaagtaatcaagaaatttgaagaggaacatcctggcgtaaaggttaaaatggtcgtgacggcagcagatcaatatgctacaaagcttagagctgcgattacaggaaacaacctcccagatatcttttattttgcccctggagatgtgaaagcttatgtaaacagtggggtgttgaagaatctcactccttacattgagaagaacaaggatattaaactggataacatatggaaatacggtatagatttgtatcgctatgacggcaaaatggccggtcaaggagatatttacggtatgccgaaggacttgggtccattcgcacttggctacaacaaaacgatgttcgaaaaagcgggcgttccattgcctgataaagacaaaccgtatacatgggatgagttcatcaaggtcaaccaagagttaaccaaagatacaaatggtgacggcaagccggatcaatacggtacaggttttaacgttcagtgggcattgcaagcctttgtatggagtaatggggcggattggctggatgagagcaaaacgaaagtaacggttgatgatccgaaatttgcagaagcgcttcagtactttgctgacatgcaaaacaaatataaaatcacacctgggattgaacaatcacaaacattggacacataccaacgttggatgaagggcgaaatggcattcttcccggtaggtccttgggatatgagtacatttgaaaaactgccatttgaatatgatttgctgccgttcccagccggatcgactggcaaatcggcaacatggattggttctctgggtatcggcgtttcctctaaaacaaaatacccggatgaagctgttgaactggttaactatctgacaacttctaaagaaggaatgaagcagctcgtagatgccaaggtacaaattccaaatctgttggacatggctgatgaatggtccaaagatacgaaaaccaagcctaacaataaacaagagtttattgatatcgtgaatgactatggacgctcattaccaggcaactatacgtataatgcagaatggtacgatattttcttcacagatattcaacctgtgttggatggtaaaattacggcggcagattatgtgaaacaagaacaaccgaagatgcagaaactgctagataaagcggtggagcaagagaaaaaatcacagaaataatgcgtaaatagaggaaaaagggatgatgttagtggctaaatatcatgctgctaacatcatcttcattccaaattagaaacagaggtgagccctgtgataaccaaatctaatctctaccgcaaagagaaggtatatggatacttatttattcttccacctattctcggtctgctaatctttacgttattcccgtttgtctattcgttatacggctcttttacagactgggacggattgggacaaatgaactttattggcctcgacaattttaaagatttatttagcgatgagctcttttataaatcgatgtacaatactcttttcttaatgctgggtattccgatcggtcttgtactagctttactgctggcactaggtttgaatcgcaagattccaggtacgacaacatttcgtgtgatttactatatcccggttatttcttcgttggctgccgtttctattatgtggaactgggcatacaacggagactatggtttggtaaaccaattcctcgaaatattcggtattaagggtcctaactggctgatggataaagatacggtcaaaccggccttgattctcatgaccgtctggaagggtcttggatatacgatgctgctatatttggcagccctgcaaagcgtatctcgctcttattatgaagcagcagagctagatggggctagcggattccagatgttccgtaatattacatggccaatggtgaaaccagtaaccttcttcctggtggtaactaatatcattggtggttcgcaaatctttactgaaatgaacattatgacacctacagggggtccggaatactcatccgcctcaatcgtcttttatatttgggataaggcatttaaaaacctgcaaatgggatatgcctccgcgatggctatgattctcggcatcttcatttttatcgtaactttgattcaatttaaaatgaatgaaaaatcgtcctttgatggggattgattttcgcggaaaggagtgagtctgattatgtcccatagtcaaaaaacgaaagttaccaatatcattatctttattgtactagcgattggagcgattgtgatgatcgcgccgctgctttggatgctgtccacttcggtgaaagaaaagcaggatgtctttgctcttccaccagtatggataccagaggtgttccagtttggcaagtataaggaaatttgggaagcaggacctttgttaagcgggatcaagaacagcgtgattgtggctgtaagtgttaccgttgtaggtaccttcacatccagtgtggccgcttttgcatttgcaaagctgagattccctcataaaaacaaactgtttttggcactcatcgcatctatgatgattccatacccaacggttatgattccacagtttatgatgttttccaaacttggctgggtcgatacacttttgcctctgatcgttccaggtttgttcggaaatgtagttatgatctttttcctacggcagtacttgcttagcgtaccggatgccattatcgaagctgcgaaaattgacggaagttcttatttccgactctattcgtcgattacgttcccgctcattaagccggcagttgcggcacagcttattttatggttcatggggatttggaacgattatttggcaccgattatttacttgaactcaccagaaacgcagacattgcagctggttatcgcgaattttaatgcgacttacgccattcagacggactatccgcttattatggcagcatcgattatagccttgttacctgtactgattatattcttgatcttccagaaacaaattattgaatcggttgccatttcgggtgtcaaaggttaattgacacttggaggggacggatgaatgttgtaaggcagtcacaatatgtaatgggtaaaggaaggaggagaataacagttatggtgatgctgctcatgctgggtctatccggctgtggggataacactccggaccctgtgtatccgcaggctccgcctcccgatcacttgtatgatcagagtacgattaatgatgaacagtgctggaccattaacaatgcacatgacccggcgattatcaaaacagatcaaggcttttatgtctactcaacggatgtaaagacaggtggagaattgagacctggtgtcatggtacgcaaatcgactgatctgattcactggaactgggttcagtatgcactccccggcattccaaaggaagcagaggcgtggtcatcggcaaccaatctgtgggcaccggacatcatcaaggtgggtgatacctatcggatgtattactccgcttctacctttggcagcacacggtctgcgattggattgcagacatccagctccccggaaggcccttggaaggatgaggggttggtcgttaaaacaggagagcatgacaagctgaatgcgattgatgccaatccggtgctggatgcagagggaaatccatggatggtatacggctcttttttcggcggtatctatattacaccgcttgatccccagactggaaagctcaaagaatctggctatggtaaaaatatcgctgccagagatcgggcaactgaggacggtgctgtagaagggccttacattgtgtacaatccaatgttccgtaaatactacttgttcgtctcgtatgattctttgtttgaggactacaatgttcgtgttgcccgttcagattcgatcacaggcccttatgtggacatgaatggacatgatatggcagataccagctatttgcctcaatacgagattggaaacaaggtattgggcggttatcggttcagcgaaggagaaggctgggttgcgccaggtcacaattctgtcctgaaggacggtgcggattattatattgtacatcatgcgcggggagaaacggacaagagctggccgtacctgcatgtacgcaaaatattgtggacggcagagggctggccggtcgtctctccggagcgctatgcgggcgaaaaggagcaggatatacccaaaaggctattatccggcaactgggagcgcatcgtgatcaggcaggaagtagacggccaggtggaagctgaaccgctccgtctggaagatggagggcgggcaaccagcggttctcttgaaggtcactggagttttgatggcaagcgtactctaacaatggattggagcaatacatccgcaggaacaaaggaagaattgttattgcttccttcatgggactgggagcttggtcgccatactttaattttcacgggtatgaatgaaaaaggaatttccatttggggaaaacgtatcagcgattaattgtttgaactacatactacacatagaggagagaataaccatgaatcaatctgtacccattaataatccggtcattgagcaacgggcagacccttggatttacaagcatagtgacggatactattatttcaccggatctgtgccagagtatgaccgcattgaggttcgacgagcaagtactattcaaggcttgagtacagcagagcctgtcgcagtgtggcacaaatatgaaacgggcccgttaagtgcgaacatttgggcaccggaaattcattatattaacgacaaatggtacatttattttgcagcagctcgtacaacggaaacgaaggaaggcctgttcgaccaccgaatgttcgtgctggaaaatgaatcagctaatcctttggaagggaaatgggtggaaaaaggacagatcaaaacccgttgggagacgttcgctctcgatgcgacaaccttccagcataatggggttttgtattatgtgtgggctcagaaggaccctgacatcgtcggtaattccaatctgtatatttctgaaatgagcaatccatggacgctgcgcggtgagcaggtcatgatctctactcctgaatatgattgggaaatcatcggttttaaggtgaatgaaggagcagcggttctgaaacggaacgggcggatctttatcagttattcagctagcgccacagaccacaattattgcatgggcctgttgacagcagatgagaatgcggatttacttgatccgaaatcatggacgaaatcacctgagccggtattctgcaccaatgaggaaacaggacaattcgggccaggtcataacagttttacggttgctgctgacggtagcgatgtaatcgtatatcacgcccggaattacaaggaaattacaggcgacccgctgtatgacccgaatcgtcatacacgtgttcagccgttcaactggaaggaagatggaacacctaattttggtattccagtgccagatggcgtctccgttaataactaagcagaatatatgctagacgattgacgcgtcacatagcgacgctataactttataaaacatcgcagagaaatgattttgctgcgtctaacaatatcaatgagatatcttcggccttaggctggaaggtatctttttgcttttgggagggagagacgtctcggaaactatgggaactttaaatcaggttatgtgaagcctagaatatgtcaagcgattaattgatacaaatgtttaatattttccacgagatggaagctacaaatgtatggtaaagtgtactatatacaaggttttatccaaatatcctatccaaagtctcctgtgcataccgaatccgaattacacgaggtgagaaaaatgctgcaatcgttaaaagccattgctaattacaggaaagaaagtgatctggcctgggatacaccgacttggttaaagctgcttgtttcggctgaggagcgtattgttaatctggaacgcattcgatccataggtgagttaaaggatgccaatcctgtactggattacgtggagcgtacgttgcttattttggacggacttccattgtcattctgggttaaagagctactggaggatgttttggtatggtctgagacagccaaaggaggcacagtccgcgaacggctacgttggcagcatgagggcattaatttatttgtacataatatcggctcctctcaactgtatgtcagacaggcccaagcggagtcccctgcttacccgcgcaatagcatgacccgaattctgattgagacgcatggattgattgggcaatatatacggggagaaattccttttgcggaaaatcgactgctgcttgaaattactcgtaagggctggctgagccctgaggaactggagcttgttttacgggctctgaatgagtgtattatcgccggggtagaacctgcattatgggaccaagtacgcggggaagtggaggagctaatcggttggattgcatgggataacgcacctgtagtctggagtgtaaaggagcgactggaaagattacggtcggtttccattcatgaaggggagccgttcgagcaggcttacacagaactagagcgggacttgaatgtagagaaggctctggctccgttggagaatcggacactttggtatgtagaatcagctttgcaggatttttcacttcaagaactggtaaaggtatttttactcacattgagggatggcacagggcaggaacagcctgcaaccgttcgccatatcagtttcgaatcgctcatgaatacgatgtattatgactatcgtggtgtcaagaaaattaacgtatataaaaaacgaatgatagaaaaatatttaaacgcactgtcctggcaggatatctcaaaaggaaaacggaagcataatcctcatttgaatgtaactgtagagcataaagaggagctgccaagtactgtattttttaattttgtattttcatcagctgctgaaaaactaatcgatttttgtattgaggcagaaaaaacacctctgtatgacaaagcagtcctgctgctgttcgatctgtttgggttacggcgtgatgcttatgatcgctttcacaatgaggaaacgtatcttacagatatgaaccagacggtagattacaaaagggtcattttggattatatgactggaacccgcatactggatatcggacctggcgggggcgtactgctggacctgatcgagcaggaaagaccggactcgaagccgttgggtcttgatatttctgtgaatgtgattgaggctcttaaacgtaaaaagcaattggagcaccgtcgttgggatgtcatcaaaggtgatgcgctccgactggaagaatttgtggaaacagaaagcatggacacggttattttctcttcgattcttcacgagctgtattcctacatcgaacgagatggaaaaaggttcaactcacaaacagtggaagctgctttgcaaagcgcttatcgtgtacttgcacccggcggacgcattatcattcgagacggtattatgaccgaacccgtagagcagcgtagacgcattcgatttttggagccggacggaatggaatggctgatgcggtatgcgcaggattttgcgggtcgtcccatagaaatagagcgtataggtgagcatgaggctgttttgccggtaaatgatgcaatggaattcctatatacctatacatggggagcggaagcctatgtgcatgaagtgcaggagcagtttggttattttactccgtcacagtatgaagaatgtattcgtaacacacttggttcacaagcgattatccgggtgagtcgccactatttgcaggagggctatgccgaagcgctgtccagtcgtgttgagttcatggatgagcagggccagcgggttcctttgccagacagcacctgtctgatcgtgattgagaagccgaatgatagggctggaattgctaaatgatttttaatttgaacaagagaatgccttctgatttgtgccaagcacgattagaaggcattttttagaaagctagtggaggtgtgttcatgtatgtcctcgcaggtggaaatatccgggtatgacccgcagtgggctgaagagtatatgcgagagaaaaggaaaattgtagaggctctcagagatgtatgtgtcggcgtagagcatattggcagtacatccgttcctggtctgggagccaaggctattatcgacattatggttggagtagaagatttggctattattcaatccgaacagcgacagcgtttactaggtattgaatatgaatatgtacataagcctgattttccagagcgagctttctttcgccgtggagaatggggagctgggactcatcatttgcatatttacaagtataaaggagaacattgggaaagccatttattgttcagaaattacttgaaagcgcatcctgagagcctgcgagcgtatgagactttaaaaaaagatttggcgcatcaattcaaacatgaccgtgcagcgtataccgaagccaagggacctttcattcggcagatagttgaacaagcaaagcttggacaaaagcagagacaaatggaattttagtacgcatggacaaggtggaggtatgatgaagaatatgatgcttgatgcacaggtaacgccgaatggcttaaaagacagaatgctgctactgtcagcgctggacattatattgtctccagaagattggttacgcacgtatcgtatgcagtctgaatggtctggtgatgtgtgcctaggtgaggtgaacaacggcgctggagatacgattcatatgctatggacgtgtggaggtgtgctgttgaagggttttgaccacgaatcccctgtaagtcctcatgcgagagacgaatatgaggtctggccgggcatgtacgacggtgtgcctgatgatatgatggagcttttggaagatgaagcgttggagaaagaggacgttaccttttgtatgtggagggaagcgggagatgaggagtggcgtatgggcaacgcgaactttcctgagggatatgacgatggctcatcctttttgctggggaaaattatagttacaccggaggaatatcaggattgggctgaaagttactatgagttgccgatttctctaggggtggtaagccagattttcaacggcgttccgatcactgcccagatgatctctgcgcttcatccacagcgtaacgttacggaagcgataaaggagctaaagcagcttggcgttcaagtgcatgaaagctaagaatacagatttgtttttcttgacaagttttgtatataatacaggagaaatgctgggttaatcacctcgaattaaaggagctgtgttgaagatgtccaaacgtttgattccttacatcacgatggatggaaatgcaaaagaagcaatcgaattttataaagaggcattggatgctcaactgctttttattcaaacctttggggaaatgccggaaaaccccgattttcccattcccgcagaggtcaaggaacgtgtgggacatgctacccttaaagtgggtgagacagagctcatgttttctgatacctttcccggatcaccgtttagcagtgggaatcaggtgagcatctgtattacaaccgatagtgtggagcaagctcaaaaaatgtttgatgctctacagcaaggaggacaggtgggaatgcctttgcaggaaacccattttagtccagcttatgggaatgtaacagacaagtttggtgtcacctttcaaatgttcacagaggctcggtcttaagaaatggaaaacggctcgattccgctactttagcgatctggccgtttttttgcgtgtatgtcctcgtctgaagaataaatatacatacagcatggggagtgatatcttttttaccctgcttgccgtttagtagattaggtttatttactgaatgcttagacgcttgttgaaatagaaacaaaaatatattatattatgttgttaatgcaccaacgggtgggaggacaggccatgaacaaagaagaacaggtcatgatggggttcagggacttatataacaagatggtgtggcttaataaggataagatggaagacagtcttaagggttataagtcttctgaagtccattgcatcgaatacattgaaagaaatgtagattccaacgtgacaaaacttgcggagtccctttatatgactagcggtgccataagtaaaataactaagaagctcataaaaaaaggcattatcgaaagctaccagaagccggataacaagaaagaaatctattttcggcttacggagcaagggaaagtaatctataaaatccatgaggacttgcataaagagtttcaagagcgagataaagccgtgtttgaacaggtaaccgaggaacaatttgatagtatgcttagcttcgtggaaaagtataataggcatttggatgcggaaataaagaaacagggtatagatattaagtcggaataaatctgaataatgaaaatcaaatcacaggcagccgggctctattgagaacaggctgccttttttttgctattattttgttgccgaggaagcaaaattgtgatacgatgtttttgcttccaaggaaataaaaacatagcctttgaggggagaatttaatgttcaaatttagatcacacaatgaacagaacacagaacaaaccgtagataaacacgctttaatattcggtcttatctctgtgtttctttgcggaataggcttcagtatcatagcacctgttgtccctttcttagtacagccttatataagcaatccgggagaacaagctatcgttgtcacgctgctgacttctgtttatgccttctgcgtgttttttgcggcccccgtgcttggagctctgagtgacaaatatggccgtcgtccattgctcttagtatgtcttttgggttccgcaatcggttacttggtttttggcataggaggagctccatgggtactatttgcgggacgcataatagagggtataacaggtgggagcataagcacgatcttcgcctattttgcagacatcattcctacagaacagagaactaaatactttggatgggtgagtgcggttgtaggtgtaggcaccgtcattggcccaactgtaggcggattacttgccaagtttggttattctgtacccatgtattttggagcaattataactttagtgaatgttatatatggattcttttttatgcctgagagccttgacaagaaacatagactgaaagaaattacttttgtaagacttaatccattcatacagcttgcaaacctgcttttttccatgaaaaacttaaacaggctacttatctcggcgttcttactttggatacccaacggatctttacaggccgttttttcacaatttacaatggatacttttagttggaagcctgcactaatcggacttatgttctcaattatgggtgtccaagacattatctctcaaggtttcatcatgccaaagcttttgagaaaacttagtgataaacagatagccattcttgggatggtttcggagattataggctatagtcttattgcgctatctgctttgttctcattctatcctcttattatcgctggaatgtttatatttggttttggtgattcggtctttgggccttcatttaatgggatgctctccaagtctgttgattctagtgaacaaggaaggattcaaggaggtagtcaatctattcaggctttagcaagaatgatggggcctatcattggaggtcaaatctatgtatcacttggtcatgccgcacccgcttttatgggtataatccttatagcagcggcaataccagttttatataagcgaacgcaagtaaatgagaattttgcaaaatcctaaaatatgtaaattatctactttgtttacagtctgagccatccgcatgcggacggctcttcatagtatcaccttgctaaattaatttcacgtatttgtacttagacgccaaaattaaaatcatcatctgtcagcggctctacattcatcgcccgcacatagccgtttccttttttagaaaagaaatcatgctgcttagtgtgagtgctgatgccgttgaatacaatgggattaacttcctcttcttcaaacagtggatcaaagcccaagttcatcatggccttgttggcgttgtagcgcaaaaagactttcacatcgtctacgagtccaataggagtgtaaatttgctcggtgtattgttcctcgttattgtgcaagtagcgcaacaagcctaccagcgtctggtaaagatcacgttgttcttcctcatccaattctgcataaatctcctgtgccagtacacctacgtacacaccgtgaatactttcgtcccgtaggatcaaatcgataatttctccactgcatgtcaacttgccctggcccgccagataaagagggtagaagaagccgctataaaataaatagctttctaacagcaccgacgctgccatcgcgagatacaggtctttcggtgtgtggatattcatataatactgacgaatggtttctgccttggtttggagatggggattttcttccacccagcggaatacgccgtcaatttcttccgtggaagctagcgttgtaaagatgctactgtacgacttggcatgaatttgttccatcatcgccataaagcttagtacggctttgcgttgcagtccgtccacatgctccataatttgcggcatacccacgccgccttgaatggtatccagtagcgtcaagccgcctagcaccttcatgtaggcttctttttcgatatcactgagggttacccaggacattttatcgtcagacaacgggatttcatcatccgtccaaaattgcataatgttctggttccagaacatcagtgtaaaatcatcgtccgagcgattccagtttacagcttgtatacctgtcattgttagcattctcccttcagcttgcgagattccctgaaaacacacattgaaatagtgcaggcgaatcatcgtatgcttgacatacggaagctgtatccgcgagggtctgtccagtcccgtaaaggtctgaaccacacgctggatacagcttctaatgcaaagcatctatatctattcaaaatctaatttttatactacagcttgttaccctttatgctttagatggagcaggtgaggcactcttccacagacagctttttggtgcgtgtgtagtataacgatttaagtcctttgtgtgcagcgtacagatagcaacgtgctaactgacgcgtagtcacgtcactgttcacatgaagcacggtcgaaattccttggtccacgtgcggctggatttctgcaatcagatcaagcactttgaactggtccatttgataagcagatttatagaagaacacgttatccttttgcaaataaggcattggatagtaggtcgtcgaattggcataggtacgggtttcaatctgctcaacaatcggcatgacgctggatgttgcattttgaatgtacgaaatgctagcagtcggcgcaatcgccatacgataggcgtggtacagaccatttttcatcacatctgcttttaatttgtcccagtccgctgaagtcggaacatagatgtctttgaacaactcttgtacacgtgcagttgttggacgataatctgtgttcaggtatcggtcaaaatatacgcctgtcgcataatccgattcctcaaatccataaaagctttgtccagctgctttcgcgatttccatacttttttcgatggaatgatagttcatcgtcatgaagaaggtacggacaaagtccttcgcttcattgctttcatacgcaattttgttcttggcaagatagccgtgcagattcataacacccagtccgacggagtgcatttcacggtttgctttcgcaacacccggtgcattagcgacttgggtcatatcgctgaccgaggtgagagcaatcataccctcgtgaacggattcgcggattttgccatgttccatcacatttacaatgttcagagaagctagattacagctcacgtcccggcggatggtatcctgttggccgtaatctgtaatttctgaagtttcctgcaactggaagatttccgtgcataggttcgacatcttgacttgacccacgtttttaagagcatgtgcctggttcgcgttacttttgttcatgatatatggataaccagactccaactgaatcatggcaattttcgtcagcatgtcacgtgcgctcatcgctatttttttcttcacccgatcgtcagcgagcaacgtgtcgtacatttcatccaaatccatgtcgtccagatgcgttccataggttttgaacacactgtaaggagcaaatacatgcagcggttcattatcttgagccagcttgtaaaagcggtttggcaccagcaatccaatagaaagtgtcttgagacgtactctttcgtcagcattgatctttttgctatccaggaactcaagcacgtcccatccgaaaatgttgtaataggctgccccagagcctttacgttgccccatttgatccgcataggagaaaccgtcttccatcagcttcagcacaggcataatgccttttgctgcgccttctacgcctttaatcgcttcgccgcgtgcccgcagtttcgacaggttgaccgcaacaccgcccccgattttggacaactgcatgcaggtgttcagcacatagttaattgagttcagggagtcgtccatttcgagcaggaagcaggataccaattccccacggcggcttttgcctgcattcaggaaggttggtgttgctggctggaggcgttgctccatcatcgagcgggacaacaggcgtgccgtatcggcgttaccgcgtcctaaatgaagcgcgacagcagcaacccggtcagggtaatgttccagatagactttccggtcgttactcttcattgcatagtcggtgtaaaacttggatgctgccatataggaaggaaatttaaaattatagctatgagtgatatggaaaatatcattaatttcgtcagccgtgtagctgttatagaaattttcgtaataatcattctcaatcatatacagcacttgagcggctgtgtcagcaaacttcaaactccgttcctgaacttccttcataaactccgctacagcctcttggtctttttccaattggaaaaagccgtctgtatcgcgtttcatcaacatgttgttcaattcaatatgccgcaactcggctcacctcctgtttaaaacgctctacatctccgaacgttccagataattcaaatttactaatcacggggacattataatgatcggcaatcaaatccgcacttttggcaaatttctcaccccagttacggttgccgcttgcagctacaccaacaaggttttgagcattctttttcaaaaaggaagataccctctcaggtatctgcccaaacccagttgtatatgtaataagtacgtaaggttcttctatagtcatttgctcctcaatctgaaccgctggaagcttgagcttgtttataaatctttttacattgccggtcttcgaatcatatgcaatcagcatggtatgcaacctccttaaacaattaacgaaaaaagaaaacgcattgcctgggatctattatagatggaatcccttgctggctgcgccatttaagattttgactctatatttacatgtattttcatacctgtatcttcaagatatcgggcataaatacgttttttacactatatttagagtacattctctattttatatctatatatagttttgtcaatcggtctagaggggatcagaggacccagatcgggtataagtccaagcggggtgcggaaaagagcgaaagaacttttttttcgtaagtatgttaaaaaagtattggagtttttgagggtgaagatgtacgatttgtcaatgggcaatagaatggaaaatttacattttactgtagaaaggatgaagcgaatgggaagtgattttatggaatttcaatcgtttaatacaatcttttttatcgtatttggactcattgcttttgtaatgattatgggaattgtcaaaacgataggagcgggcctgtccaatcaagcagccgaacgggtacaacgttcatgtaaggttgtggataaacggacgagagtgcgtgggggatcaggcgatttttcagcttcgacatattattatatcacctttgagtttgacgggggtgagcgtatggagctggaggtgaaggatacggattttggtatgattgtgatcggggatcgtggggagcttcattataaaggtacacgttttctggagtttgtgagagtaatggaagcgtaaaggtgttggcggcgagttagtattgccaaaacaaatacataattgaagggaagattacgatgccgcatatcattggaaaacgaatagtattgagagaataccgtcaagaagatataccagctatccgaaaatgggtcaatgacccggaaatcacacgtggtttaagcgacgtgtttatctacccgcattcacaggtgaatagcgaatcctttgtgcagatgatgattgacggcaaccccgagatcaaaggttttgtcattgcgcataaagacacactggactatatcggacaactggatttattcaaaatcaactgggtgaatcggcacgccacccttggtgttgtgatcgggcgtgacggcgatctgggcaaaggttacggacgggaagcgatccggttgttacaaaaattcgcatttcatacgctgaatctgcatcggctggagttggaggtctatgcgttcaatgaacgtgcacaccgttgctatctggcctgcggcttcaaggaagaaggtcggctgcgggaaaagctattcagggaagggcaatactatgacattattcagatggggattttgcgaagtgaatataaggctgcagagcaagcgacggagtcctgagagtgcaatctcataagctattttactccgtcagctttcttcaattttttatgagtgaaatcacggggactacgctcatcctatttctattagctaaaggactttctctgcaaagtgcgaacttcttactggttgtattttttgtaagtatttttttgtttgagatacccacaggggcgattgcagacaagtatggcagaaaaatttctgttattttgggactttgctgttttttagtctacagtgtgttgttcgtttggacagatcatatcggggtgcttgtgttcgcgcaagtttttgggggtctggctatatgtttacaatcaggttcgttagaatcctgggttgtggaaaacagtgataagcccatggaagttctttttacaacctctaacagtatacagtacatttcgggatttatttgtggtctgttgggggcctttctcgcaacctataactattcacttccatgggcagtcagtattttatctattattgtatgcatttttctatgttccttttatatggatgaggagaatgttgctcatcgaaagacgtctactactcgcattaaaacgattatcggagaaagcgtccgtatcggttttgaaaataagtctatctggattgtgtttatgattggtttatttatcagcttttcgaactcggcggggaatacatttcaacagccacgtctggttggcctttccgaacaaggggtttggattatggggtttatcaaggcaggctattcactatgtatgactttgggaagttatctagttcgaaagctaggcgccagatacagtgatgtacatatactcgtgtatgcttgcggcatgataggggtctggctcattttagctggtgcgttcaacacattttatcctgtactgcttacctttttgatctatgaaattggacgcggcatgtacccggttgccaaacaaatttttctgaacaaaagaatctctaatgagtatcgttctacactactatctctggattctgcgatttcacaattaggcatgtgcgtaggtttaatcgtgacagggatcatcagtcgaaattttacggatttgtcttccgatcaaacacctattcaaatatcttgggtggtgtgtggcgggattgcgttgattccaatcattttattgttttacgtccatcgtgtttcagggaaaagtaattcttggaaagaaaaagaaaccaaacagaatatttaatgtaaaagttaatgtagaagggctgaacaacatggtctgtcagccctataatatttcattaaaaagcaagcaaaccttatttttcgccgtaccacagtttcagccgattttggattaggccagtatagatttcttcagcctttggcacacctgcctgatccagctcttggagcatgcggtcatacacagcgtcgaactgatctggcttggcgagtacagcctcaggaatccgtttgcgtacaatgtcctgcgacttttgataaataacattgtaattcgtatcggtcggaacaggcatgttgtaggcagcaccccactcttttaccggaaaatccttttcgttcggaaacaggtctttccacgtctgggctttgtatgcctgaagggactctttttcggcttgactataattttcggtaatcatctctggataattggttgtgtaatagttgccagaagggtccttcacgctatcgccataatgtggcccccatatccagtacaaaccgattcctgactctctgctaaaagaagcgttatcggtgtttttacgttgttgcacatccgccggaatgactcgtttgccgttctctacgttgtaatgctggccttcaattccccaattgcgtaaaatttgtccttcgtcggaggccagaaaatccagaaacttgatagctcgcaccggattttcgcatgaggttgtaattccgatcccggatgcagtatcgaagccaatgggctggagggaatggtcctcgtatttctcatttaaagtgactggaaaatgggcgtaagtgaattcatccttacctgctgccttgagcgcattttcggcatcttgatagttccattcctgatcaatgagtccgatgacacggcctgcggcgattttggacttgtactgatcacttttttgcacaaaagtatccttatccaacagtccttcattgtacatatggttcaaccaacggaaatattcgcgttcttctgggcgcttgtagtgaagaatggctttatgtgttttaggatcaatataatattcgccatcgtcgggtccacctgtagcagtaacagccgggttagtcactgtaatttgaattttccagtcttcggcatcaagtgatagggggatggttcgctggccattggtggtagggtatttggcgacataatctttaagtgctttttcaaaatcttgaacggtgtggattttagggtatccgagcttcttaagtgcctgatgctgaatttcgaagccggcttgtgcatcaaacgcgatgtgatccacacccaaattggtcgggatcgtatagatggctggatcttcactactatatttaatacgattaaaatagtctccatacacttttttaatgttagggccgtatttgtcaatgaggtcggttaagtcaatgagtgccccggcatcgaccatttttccaatgtctcccttggggtacacgagatctggatactctccgcttgctgccattaaagcaaacttttcctcgcctcgaccattgacagcatgttcggcatttagcgtaacacccgttttcttgataatttcctgcccgacagcatccttcatgttgttccagttagagctggaatcaccgccaaagaaagtaagagtaatgggactggtgtcattaggatcttccttttctgccttaccgtctgttccattcgcgcagcccgttgtaacgagcagcagcaaagacaggagtagaatggaactctgtcgtaccgacctgttcttgaacatttgcaaatcccccttaataagtatgatttacacaatgtaagtgctttcaatagtaaattgtaggaaataaagaacctctcgtcaagttatttataattgcttgttatgcggtttgtttttttattaagcaaacatattttggtggagggtgtggatttgtacaaatctatcatttgatgatctaaaacaaagtatgctacgatggtaccagtttataggtacacccgtgtattagaaaggttaagatagaaaaagactccgaatagggttgggtgagaagatgcgtggaaaagtaacgttgcaagaaattgcggatgcggcgggcgtttcaaagttcgctgtttcgcgtgcactatcaggcaaacccggtgtaagtgaagagacaagggcggttctggtcaagcttgccgcccagatgggctattttcgcagtcaccccaaaatgacaggggtagagcctcgggacacagataccagagaatggtcaggtaccgtgctagtgttatttccgaatattaggtatcagaacagggaatctagatactgggggccagtatttgaagggatttctgagcgtctgaaccgtaagggtatggatatgatcacgttaacggagccctcgactgaagatatgttttctttactgaacccggaggcgattaaagggattatcacggtagggacgatttcaacttcattgttgctgaacatttatcggatgggtattccggtcgtcatggtagatcattgggattctgcatttttaagtgatacggtgtttacagataatcgcacatgcatgagtgaattaatgaaggacttgctgtgtaggggctatacccgctttcagtttgtaggtcatattgatgacgctcacagtttctacgaacgctgggaagcatgtcgttccacactggaaatgagcggagtagaattgcggcagattaaagctcttcttcacaggggagcgcaagcgcttgctgaggaaatggaaaagttgtccgaggacgaactgcctgaggtttttgtatgtgctaatgatgtgactgctgcgcaagtcgtggatgtgctgaaagaaaaggggattgacgttccgaggcgttgcggagtgaccgggtttgacgatacgaatgaacaaatgccgatttgtgccacggtgagagtggataaggaattgctgggaatgcgtgcagtggaccagttgttatggcgcataacgaacccgaactcgcctgtcgagaaaaagttgctacatgctgagctattcgtacgggaagttcatgcaccccggatcagtcgggaaaatgatgaccgtgagcgtcccatcagcacaatcacatatagttaatgtccagatacgtgttatgacaccatacaccatgaagacgaaggaggtcgcttttagcctgtttaggggcagagggcgacttttattttgtattttgtcatttgttctaaaaaacaattgactattttgttagcttaatgttatttttgttatgttactgacgaatccagatgttcccaatcatgcttataggaggcttgtgacgatggttaatgtgatagggttggatggctggaggtttagggaagcacaaagtgatgagtggctcagcgcgaaagtgccgggttgtgtgcatactgatcttttacgacatggcaaaattcctgatccgtttatcagtatgaacgagatggaggtacagtggattgataagcaggattggatatatgaagcccattttgagataaatgcagatcagcttcaatgtcaatgtgtagagttggtgttggaaggtctggacacatacgcgaatgtaaaagtgaatggccaatatgtcttgtcagccaataatatgtttcgggtatggagacaggatgtgaaggcaattgttcagcaaggggaaaatcggctggaaatcagttttcgttctccgattgctgaagatgtacccaagctggaaaacttaggttatggactccctgcacccaatgatcagtccgagatcggtggtttgtccgacaaaaaggtaagcgttttcgcacgtaaggctccctaccactatggttgggactggggaccgaggcttgtgacgagcggtatctggagagaggtccggatcgaggcgtggtccggtctaatcgtgagagacttgtttattcgacaggacgaggtgaattcggtaggggctaaactcatggcagtggtagagatcgaaaatgcagatgagattagagatgccgagttgcgtatttccgctgacgggaaggtgtggtccaagccggtacggctgctgaaggggaagcagacggtcgagctggagctggagatgaagaagccgaagctgtggtggtgccgtggactgggggagccgcatttatatacgtttgtggccgaattggtggagcaagtacaaggagctgtaatcgcggaaaaatcagtaaaaacgggactgcgttccatccgtcttgtacgtgaacgggatgcagcaggagagagcttttattttgagctgaacggaatccctgtgtttgcaaaaggggctaaccatattccgaatgacagctttgtcactgaagttacgatggaacgatatcggtatgaaattgccagtgcagctgcctcgaatatgaatatgctgcgggtgtggggtggcggtatttatgaacaagacatattttatgagctttgtgatgaatacggtttgctcgtgtggcaagattttatgttcgcctgcagtatgtacccaggggatgaggattttatggacaatgtggcacaggaagccgagggcaatattaagcggctgcgtcatcatccctgcattgccttatggtgcggcaacaatgagatcgattctgcatgggcgcattatgaagagaatggaggctggggctggaaaaaggactacacacctgagcaacgggaacgcctatggaatgattatgaaacactctttcatcggattctaccggaggcggtacacacctggtctgcgcagacagcctattggccctcctccccgctgattgacctgaccagagatcggaaccagcatgcccatcggtcttcaactgcaggtgatattcattattggggtgtatggcacgcgtctgagccgtttgagaattatcatgtacatgtgggtcgttttatgagtgaatatggttttcagtcctttcctaaatacaagtctgttcgtacttatgcggaagagaaggatttggatctggaatctgaggtgatgctggcacatcagaagaacgatgcgggcaatcgtctgattaaagaatatatggagcgatacatgcgagagccaaaggattttacatgttttcttcacatgagccaaattttacaggcagaggcaatgaaagcagctatagaggcgcatcgtcgtcacaagccctattgcatgggaacattatactggcaaatgaatgactgctggcccgttgcctcctggtcgagtatggactattttggtcgttggaaggcgctccaatatacggctaagcgcagctttgctgatgtgctgttgagtgcaaccgatacagaacaggggaataaggccctgcatctagtcaacgatacactagagccgatatcaggtacgctgcggctgactcttttgcatatccgtagcagccaggcaattcatgaagagaacgttaaggtaaagcaaccagcaggcgatgcaggaattgtacatatactgcctatcgacaaatggctgagtggcctgaaccgtgcggagcatatgctggtcgcgcgtctaacgcagaatggtgaacaggtggcctctggtgaaatttattttgcagacacgaaagagatggatttaccgcaggcaaaaattgaagtgacagagattcagggaagcgggggcagcagattcatgctgtgttcggatgtacttgctaggcacgtgtggctatcggcagagcaggaaggtattttcagcgacaaccatctggatctagctcctggtattccgaagacagtggaattcttggtcatgcgcaacggttcatcagcatttgtgacagctgcgccgggtacattgacagtacattcgttggtcaattggatacaaggttagacaaacagtaaaagcttatccgtctttaagtagatgatggataagctttttttttataatataaatttattttatgatatgtagagcgtcttcataatgttaatatacataacaaaagagaacttgggagttaagtgataacagatcatttgtaagaaatctatttatttagcctctaactgttggaatataaaaaaagcatacggtcggccgagaacttgtagaggaaatccgtcagttgggctttagcagggtggagctgaactataacattacccgggaaatgctaacgacgattgaacctatgattgagcggggaacaatggcatatcgagtgtgcacaatacatttcctcatacaccagatccggattacggcacgaattccgttctgctcgggtttgacgatgaaagcaagcgacaacgtgtaatagagctactggtgcaatctgtggaatatggcatcattatgggcaaaagcggtaattgtgcatcccggacgccggatggcgaatggacggggttagtgacgaaatttataatgccgttagcgatattacgctaattcatactgcccgaatattaaaactaccggagctacgcctttacctgtgagtgaagtctaaaacacagtaagcagctatttttcggggatgaagtccattcccggagaacggatgtttttttgtgttcattgatgcagaggtagagcgcttccattgagcttgaagccattgtggtgtacactgtccagaacaggtgtaaattggaacgtcaggaaggcaggacggttacaaggagggaaagacacatatgtatgcccgtttaagatcgttaaattatccactaaaactctatgtttttttagcactggccttatgctccgtaatcagtacattgtggatcattaacgtgcgactgccctcagggggccgcccttatctttttatttggtggaatatgatgttggcctggattcctatgctgttgacgttactgcttgatgtaatgtacagctcgtggaggcggggaacgaggacatttttactctgggttacgggggcggcatggcttttcttttatcccaatacaccctatttgatcacagatttgctgcatgtattcgccagatatccatttctcggggagcaacgtttctggggcaatccgcacttttggaatcatgtactgggaatgctgctggtagccgtacttggcctggcaatgggttttgtatcgctcgaatccgtacgacagttggtacaacgtgcacgtggtgggcttgttagttggctgtttatgctggcggtactcttgttgagcagcctgggtatttacattggccgtttctttcgagggaacacatgggatattgtttctgcgccctctcaactgtatgcacaggtatcttccatatgggcagactccttgcaacgtactcattttgtggagtttagtgggatgctattcgtcattttgctcgtcagctatgtatccacgatgtgcgtagtctggatggggaacaaccgccaggacgaatggcgtcgctggtgatttgattgcagctgagtggctgaatatcatcaaaaatgtaaatcaaaggaggaatagctacaatgaacggacagaatcgatccgatatccgcgctggtcttcaggtggatattgtgcttaaaaaggatcagtctactggtaagttgacgcgaggaacggtgaaagatattttgaccaattccccgcgtcatccgcatggaatcaaagtgcgtttggcagacggacaggttgggcgtgtcaaacatatcgtaacgaacgaaggatagagctttgggtgaggaggaatgaagatgattcaggcaacggcatggtctaaaaatgatcgctacccgcttgttttacttgtattgctggcgcttgccctcatttggtctttaattcgcccggcggattactttacatgggtactggaagttctcccggcagttttgggagctgtgctgctggcggctttgtaccgtagatttcggtttaccaatctggtatacaccctaatctggctgcacgcattgatcctgattgtcggtggacattatacctatgccgaaatgccactgttcaactggattcgggatacgttcggactggagcgcaattattatgatcgacttgggcattttgtacaaggttttgtacctgcactcattgtcagggaagtgctgttgcgtaaaacggccttgggaagcgggagctggcttactttcctcacggttagtgtgtgtcttgcgatcagcgctgtgtacgagctgattgagtttgctgtagccaaggcaaccggaacggtagcagaagcctttttgggcacacagggagatgtatgggatacccaatgggatatgcttcttgcgttcatcggcgccttgaccgcagtgattttgttgagtggggtacataacaagctgctgaagcaattaaggtattagcagaatttatttaacccgccactatcatgctatctgaaattgcctgtttttgaaggctacattcgcgtcatgggacggctgtcgaggtgtagggttgctgcgtccatgtagctgtccagtagccgttcaaaaatacggtcccatgtctgctccaggctgtaggctctaccagctctggacatagcatcacgaagtgaggcatcctcgtacaataggtgtacagctttggcaaaggcagcggcgtctccagcaggacacaatagccctgtatttccatggattagattatcttttaccccgccttcattggcaccgaccacaggtgtaccgctcgccatagcctccagtacaacattgccgaaggtttccgtggtggaagggaagagaaatacgtcggctgcggcgtagagttcagctaattccggccctttcacaaaaccaagccagtggactgcatgctccggcacccctagatccgctgcagttttgaccttatacaatggaccatctcctgcaatgaccagcacagaggctgcgcggacgtcatcgggtaactggagataggaatccagtaacgtgtctatccccttttccggtgcaagcctgcctacatacaaaataacaaatgcatctgcatgaacgccccatttcttccaaactgcattacggtccacctttggttggaaccggtcagtatcaatgcctctactccagatttcgagctgtcccattcctttattgcgcaacaattccatggttgattgagaagggacatataccctttcgcaatgtctgtgaaaccagagcatgtatttccataacgcaggttcaagccagcgaagcttgtaatattcgaggtatttatcaaaatgggtgtgatatgaggcgacgagtggaatatggtgtttggctgcgtagcttgttccatacaggccaaggttaaatggagtagcgacatgaatcagatgcggggaaaaggctgacagacgctcgttgatctgtttggcgttggggatcgcaagtctgcattcccggtacaacaaaaagggaatactccgaaatcgctctacacccggcccagagggcagatgatggtctgcctccggtgcgaagacgagcgtagatactccatgtgtctccagatagccaatccatcgttccagggtcagagcagcgccattcacgtcaggcgtatacgtgtccgtaaataatgcaactcgaagcatgccttcattcctcctccgccattctcatttatcctatgacgttccaagggagtccgcttggaggctccggcttttattgtgtcatgattttgtttacgggcttgctgggttttgtaaaagctggcctgcggacgggagcttttctcggaacattctgtaatagacgagggaggacaaaatatagaaaacacctgtcatgctaaatgtgatggcatagccccagtagttgccatatgttgtaaccaaataggcttgtacaggtcccatacctgcggtgcctagcatccaggtcgtctggagaatggagttggcaatgccgcgatttttatctgacacacgttcgacgagaatggcggtttgcagcggattggctgcattcattagcgcttgcctgaatagaaagctgatggaagcgatccatagcacattcgtaaagcctgtaatgagaaggaagggtagcgaaagcagttggaagccaactacagctctgaccagtccaatccggctgccgagggtaggcccgatcaacatggagaggatggtcataagctggccgagtgcaatcagtaaactcattgcgctgagcgatacggagaagcggttcgtaaaatacaaattaagatacgggatgaccagacctgaacctaacccaagaaaaaactgggcaagaacaaattgtccaataacccggcgatcagaagcagcagcaggcgtctccaaggcagggatatcggatgtactgtgcggtgtatgtacttgttctgtttctgtatgaggtgaagattcggcaggagctggtgcttctaaggttgccgtagtttttgtgatgaacaatagaggaataaaagcagtcaatgttgccattcctccaaggaacagagcaacccgcagactggatagcggtgtgattccccacgtctgtagcccatctgcgagtacgccacccccgaagctgcccaggacttgagctgccagtacaagagctgagtaatagctgaatatttttaagcgctgggatttactaatgctttccgctaaaaaaggcacagccagcacctgaataaaggcggcgaatacacctgagattacggcaaataccaacatgcttccgctggtatctgtaagggtacgggcgagaaaggccaggccgctgaataacgcgccgatgaccagcatatttttgcggctcgtccgatcccccaaaaatccgaccggaatgaacagcaacgccgtcgctagcgcctgcatgctgaccacccggccgttcatatcatcatcaaagccaagcccttggatatacaggttatacagtacagaaaacattcctgtacccatctggtacagcagattggccataaaaaacaatcggatattacgcggccactttcggggctcttctaacattttgctaatccatgacacgatgagttcctcctgtgacgttgttgcaaataagttaatactgttgatatgtattctatcaggaactgtacatttcataaatattcctgatctccgattgttttgggtaataataaagcatggactttacattgaattttcattatagtaattcggtatgaataaatttgaaaggtaagcaggagggatggctttggcttttggagcacgggtgttaaaaacgggaatcgcagtgacgctcgccctttttctgagcacgcttttgaacacccattcgcctgtgggggcagcgatagccgctatttttgccatgcaaccgtcgatatataggtcgtggcgttattttctggatcaactccaaacaagcacactcggtgcaatcatggcgttgctgggcggaatggtattttcgaatgagccgattgcagttggactggtatgtgtattggtacttatgatatgtctgaaaataaatatggctgatacggttggattgacactcgtgaccgttgtttctgtaatggaagcctcaggggactggaaatttgcggtgacccgctttgcgctcactttgattgggattgtgtctgcttttgtcatcaatgttagtgtttttcccccgaaaccgaaaaggcagtttattaatcagattcaaaatgtatttaacagcatgtccttgctgctgcgtactgccatttccgatgagattaaggagtctgtcttcaaagaggaaaaaggaaatctggagggagccattaaatcgctgtcggacaaatatcatttgttcgaggaagagcagaagaagctcaagcgctccaagtttagtcaaacgagacaaatggtagtatacaaacaaatgctcggaagtttgcacaaaggatatgaggtactggatgcggtggaaagacactacttccagtctttacggccaaagggaacggatgctttttttgacagtcatctggagctgctgattcgttttcacgagcatgctctactgaaattcgaagataagctaaagccgaatgaggacgaaagtgaattgtttcagcaagccaacggcgaatttatgaagcatgcgattacacgttttgaccattgtcaggaaggaatgctgcggctgtccattgtggctgcggcgatgtacgattatggtcatcagctggagaggttgagcagactggccgatcatattcatcctgtagaagagagcagataggcgaatttcctaaagaaaagcgaccgcattcatcaatcagatggacggtcgcttttttatgtaatgaattcaagtatgtaagaacaggttaatagatggttgccagaacacacaaaaaaagcccgctggttgcgaacagggactgaacttgctacaatagaggatgctctgttttatggtgaaaccataagcgtaagttgtgaactacacttcttgttacattatagcatgcttcaaagaattagtcaattttcccggatcagggggatgccgcgagtatgcccgggtccataatagagcatagtttgtacgcaagggagccctgcatggagcaggaggaaacggaacaggagcgatgccagtgactactgaacagcaatggaatgaagaacaacgaagagtagaagatgtgaccgcagtgattagcgggcgtattcggaagctagagacagaggttggttctgtgcgcggagatgtcgtcgatatgcgtaaagacttctgggatgaggtaacgatcaatttcagtgaggcggacgatgtgggcgagacgtccaccagtttgcgtcagcagtctgagattttgtctgagcgggaacgaagacacaagcattccacagaggcgttaggtcgtttgaaaaagttgcttgattcaccgtattttgcacgcattgattttgctgaggaagggcagactgcggaacgtgtttatctggggattgcctccctgctggataatcaagatgaggaatttttgatctacgactggcgtgcgcctatttccaatctttattacgataacatgccggggcccgcctcatataagaccccggccggggagatgaaaggggaactcacgcttaagcgccaattctcgatccgtgatggacagatccggtttatgttcgatacaggagtgacgattggagacgaacttcttcaagcagtattgagccgcagctcggatgctcaaatgaaaagtatagtcgctactatccaaagggagcaaaatcgcatcatccgtgatgatcgaagccggatgctcattgttcagggggcggcaggaagcggcaaaacctctgctgcgcttcagagagtagcgtatttgctgtataagtatcgggatcgcttacgagcggatcaggtcgtgttattttcgcctaacccgatgtttaacagttatgtatcgacagtattgcctgaattaggtgaggaaaatatgcttcaggccacgtttcaggaatatttggagcggcgtttgggccgggagtttcagttagaagatccatttgaacagctggaatatgtgctttcagcatcgttacagcctgggtatgaagctaggatggagggtatccgctttaagtcgtccaagacgttcttacatgtgattacaagctacaagacgtatttggaacaggagggaatgcgttttaaacccatccgttttcagggacgtgaggtggtttcagtagagcaaatggcacgcaagttttatgaattcgactctacggttcggctggcgaatcgattggaactgctacgggattggatgctcaaagagctggcccgctttggtaaggaagaatgctccgccccatgggtggatcaacagatggatctgatggagccggaggattatcagcgtgcctataaccgcatgcgccgtaaatccaagaataagggcgataccttcgacgattttacgcgtgaaagagaaatattggcacgtatggtggtcagtggccgcttaaagcccctgcgcaaatggattaaggcgcttcgcttcgtagatacgacccggctctacagcgagctgtttatgaatgaggcattgttgagccaactggcgaatcatgcagagctgcccgtcagctggggtgaaattagtcgacaaactctggaacgaattcgggctggggagttagcgtatgaggatgtgacaccctttttatatttgcgtgagctgatgctgggctttcgttccaatagcaacatccgtcacgtgtttattgatgaggcacaggactattccccattccagctggcgttcttcaagcgtttatttccacaggctaaaatgacggcactgggtgattttaatcaggcgatctatgcccatgcctcggtgcttcaggatgcagaaccattgtatgacttgtatggtgcagatcagaccgagatgatttccctgacacgcagctatcgctcaacacaggagattgtggaatttacccgggggatggtcgctgggggagagcacattgtaccgtttaaccgtaaaggtgagaagcctcttgttactgaggtgcgttcgcttgaaaagttgcatcaattgatagttgggaatgtcacagaattgttggcagaaggctatgaatccatcgcggtgatctgtaaaaatgctgacgaaagcgcggcagcctacgaagcgctggaaggacagctgtcagtgaagccaaaactaattaagaaaacaactcctgcttttgaaaaggggattcatatcattccggcctacctggcaaaaggcgtggaattcgatgcggttctgatttatgacggatcagcgaaacaataccagcgtgagagtgagcgtaagctgttctacaccgcctgtacgcgagcgatgcatctgctgcatatttatagcataggggagattacgccattcgtgagtttacgggattcggatacgtataccctcaaagtggaagaaagtgatcgtgttctatagagaggacattggcaatcagccggggacaaatgccttagaaacccttgcgatgcctgaatagatgtagagttggctggcattatggagcgtattccagtaacataagcaaataagcaaaacaggtaagaagcataaacggaggttacaaacgtaatggacatgaagagtgtatttcaacgcccgccgctagcggactgtgtacccgagttggtagctacagctagaggagagcgcaaggcatcgctggtgatccgcggaggaacactggtcaatgtggtatcgggcgagttgctgccgggcatgtctattgctgtgcaaggtgctcgtatcgcttacgtcggtagggacgtcagtcatacgattggagaagacaccataatcattgaagcggaaggccgctatatggcaccggggttactggacggacattgtcacatcgaaagcacgcagctgaccgtaacggagttcgctaaggctgtactgccactgggagtgacgggtggtttttttgacccgcatgaaatttccaatgtactgggtctaaaagggcttcgtctaatgctggacgaagcacgtacgacaccgctggctgcttacatgcaggtggcttcttgcgtcccgtccacaggtccggagctggaaacgacgggtacctccttcggcccggcggaagtcgcagaggcgttaagctggggcccggatatgatcgggctgggcgaagtcatgaatttccctggtgtcgtctatggagacgatgtgatgatcggtgaaattcaggccacgctgcgcgcgggcaaggtggcggatggccattttacatgggcctccgatgattggcggctgccggtctatgcagccgcgggaattacgggcgaccacgagtgtgtcacacccgaggatgtagccgagcgtatccggctcggcatgtatgccaagatgcggcaaggctccgcatggcatgatgtagccgagacgatccgagccagcacggaaatgggtctcgacacgcgccgcatgatgctggtaacggatgaccgcagcgctgaatccttgctccatgaagggcagatggatttcgtcgtgcgtcatgccattgcacagggcgtcaagcccgtaaccgcgtttcagatggccacgctgaatacggcagagcgcttcggcgtggcacgggacatcggatcgatcattccgggtgcgattgccgacataattttgcttgatggccgattggccgaagtgaatgtgacggctaccatcgcagcgggccagctggtggccgagcacggtcaaatggtcgccgattgggacggcttcgtttatcctgcggaagtgatggacacggtccatctgggacgagaactgagtgctgcagattttcgcattgcggctccagtacaggaggggaatgtacctgtacgggtgattcgtgttacggaaaaccacgtggacacgaaggaagtgcgaatgatcgttccgatccgtaatggagaaatcacggcagatcctgcacaggatttgtgcaaaatagccgttttcgagcgccatcatgccagtggcagtcacgcggttgcacttgtgacaggtgtcggcttcaccgagccggctgcgattgccatgaccgtcgcgcatgatagccacaacctgctcgtcattggtaatgatgacgagctcatgacccaggcggcgaagcaggctgttgccctgcgtggcggcgtggtggtcgtatccgcctcgggtgagacgcgcttcccgctacctatcgccgggctgatgtccccagctccgtttgcagaggtagctgcgcagtccgaaagtatcagtcgggcgcttcagcagtccggctgcatgctgaacaacgcgctgatgacactgtcactgctcgcactggtcgttatccctgaaatccgtctgtcggatcaggggcttgtcgtgatcggagcggatggcatccgcaaggtatctctttttgtggaagaggatgctgcggaagtctgatagaacacgtcgctgggggttgtcctacaggtctgcccagacctgagggataacccctgtttttcatacacgaagtcaaaaaaatatcttcgattcctttataaaaatcaaggagcggtgggcagatgcattcctattatcgttcattagaaaaaatggctcatcatgcctcgattatagagcaggattggaacaggtttgtagagcaaacctgtgtgaagcatattcagcagggaacggttctcattgaaacgggtgagcctgtgaaacatgcctatttttgttcagagggattatttcgtttattttatacattagcagatggcagagaatataatgttggtttttcgccagaagatgattacgtaacctcttatggggctatgatccaaggagaactatccactttttcgattgaggccatggaagattcggttgtcattgaaattccatatcacgtattgaaggagcttatggatacaagccatatgtggaaagattcgtccgtaaaagtgtagaaagactttatattcgaaaagaggaacgggagcgcgaattattgtatctttccgctaaggagcgttatcatgcttttcttcacaaatatcccggattggacaaacgagttgcccaatatcatatagcttcgtacataggcgtctcccctgtatcacttagtcgtttgctgcgtagtgatccgcattaacctatgttaatgcgacgttgtagacaatcagcgtacaataacgatacatcattcaagcttcaccaaaaaaggagataaggcatatgcgttatatgatgattgtattattggagttctacccttcctggttggctctacctcgggaggaacgtcgaaaatatgcgggggccttgcaggctaccattcaaaaatatagcgaacatgttcaggttcgtttttttgatgcagaagcactgcctggaaaggactacactgatttcgtcgtatgcgaaacggaggacatgaagcaatatcactatatgtgggaagaaattcgcgattcggagccgtataccaaaggatacatgaagattaaagatgtagtgatgggtatggaaaatgcatttcagtcctatgagtcagaaatgttacagatggaaaaataaccgtcattccgctttctatgtaaaatgaagagttcatcttatatacggttaaaaaaggcgaattcctgtgctgcttatgttcagctgggaattcgccttttatcttttggagacgaaaaagtgtaataagaaaaaatcacattatacaactgtgttacttataatcatcaaaaaaccgttcttcccagcggtatccattaactgatttatgaattttcttgcggtatcgttaaacaaataccactcatttttcgatacgtcatgaatcaaaatctctggatattctgttgaaagttcagatggaacaggactaattaaagaataaatatcaaaacgagctaagcttttccctttttggcctaaaaaatcatattgtgcatttttataataagatccaggtgtgtcaatagtgaagctccaagagtagtttgcaggtgcttcaacctttttacctatgttttttgcgaaaatattataaatggtttcattatatgcattgccatgaacttgctgaactacgccgcccataaacatatggtattcctgttgaagtgcttttacttgtacaccgtttatgaacaatggtttagtatcaacagtcactgcaaagttgctgtaattgacattgcagccaaacgcctctgcaataaaacgaagtggaacatatatgcgattatttttcgtgtatggttttacatcgagcagtatctgttcaccatttttctccgctgtgcttctgtttattgctaaattcactttcattttgcttttagcgagaataacctcagaattggaccattcgacactagcccccaaactttcgcttataacacgtagaggtaccatagcgcgtttattcttcatttcgggtttcacatcggatgtaatagccacaccgtcaactttgatctgattttgtgctgcataagtagtggacgatgaaataaataaaaaaattgcaagaaaagccgcaaagaatgtttttttcataaatgattgctcctttttcggttaaatttgttgcgcagtaacttcccccatatgaagacgcaactggataaaaaaacgttgcgctgtcctgtccgttaacttaacgtaacaaccagtttgtactatttaattaccttccgatatttaccaactaaaaattgctaatcttcctggagaattatgtcgataacattgaatattattcataaaatttatcaaagtaaatccttagggggaaagttaatgagaaaacagctaaaagttgcgatttctctagtatgtttaatgatgtttataggttgttcagcttcaccagtatcacagcagacgaccaagattacacttttgaattccaaatctgaaataaaaacccaattagaagaagtagcaaaacaatacaatcaagagcaccctgaagtatctttggagattataaccgctcctgaggggacgtctgcatatcaaaagctgatgtcgatgtacggctcaggaagtccagcaacgatgtcgatgcttgacccgggcgacacgcagacattcctggataaagccgttgatttaagtaaagagaagtgggtagccgatacgatagaaaatggacttgatgcagttaagaaaaacgatgctgtgctgggattcccatttgcagtggaaggctacggattaatctataacaagaaagtattggacaaggcaacagggggttcttttgatccttcttcggtgaaaagtagaagcaacctgaactcattaatggctaagattcagaagacgggagtagcaccggtcatgctttcaccaatggactggtctctcggctctcatcttttagctctgtcttattctgttcaacctgtgggttttccagagtttgttaaaggtatgcaggataactccatagacatgtcccaaaataatgtaatgtctggatgggtacaaactttagatctgctcaagaataacagcatcaataagaattcgcctttggacagcacgtatgacgatggagccaaagcattaggagagggaaaagtggggctttggtttatgggaaactgggcttgggctgggataaagagcaatgatacagcaaatgaggaatacggttttttgcctcttccgttaagcgataatacggatgaccctaacaatgctaaaattacagtcggtgtaacaaagtatattttcattgactccacagctaccacacctcaggagcaagaggaagcaaagaagtttctgaactggctggtatacgacaagtccggacaagattttctggtaaacaaggctaatacggtacctgcgttcaaaaatattgatttagagcctgccgatcctttgggacgatcgatcaagtcgtatatctcgaccggaaagacactgccgtttatggcaacccttccacctgatcatgcggccatcacaggagcatctatccaaagctacctcagtggaaagatagataaggctgagctgttgcgccaaatacgcatatactggaaagctcagcagtgatgatacgagaccagttacgggaggaagataaagatgtttaaattaacgttaaagaaaaaaataattagcgcagcgctcatactggttatcgtactgtccctttcaagtgttataggcgtcattaagatgtcggaaatgggtgaggcttctgataaggtaaataacaggtctttacccgcggttattcttcttcaaggtatggataagcagattacagaaattgatagactcaccgttcgattgatacttgaagaggatgcggctgttcgcagcacttatcaagaagaattaaccaaagctacagcttcaatggataagagtgtaaatgaatatcaaagtttagcctcgacagtagaggaaaaagaactgttcaccaatttttatggtcagtgggcaatgtatcttcgccatctaaaggtggtttccgctgctatggaagaaaacgacaaagtgatggcctacatgatcattcatggaaattcttctatttataaggcagcattagacaatgtaaataaactgaagttacttaatgagcagtacgctactgatgccgctaatcaatcgagtcaatcttaccattcaggtagaattttgatgatttctctgactatcatatgtacgatcctaggaattatcggttcttttttactggctcaatcgttcactaagcccatattaaagattgcggaacagataaagctggtaacgaggggggacctgcaagtggagccccttagagtccagtcaaaagatgaggtcggggaactggcatccgattttaatgaaatgtgcgattcactgcgcaaccttttaaaggaagttgtggataattccttactggttgcctctacggctgaacagttaacggccagtgcggaacagacaagcatcgctaccgagcagatagctataagtgccacacaagtcgcagagggatctcagacacagcttgcagatatagctgaaacgctgaattacacggtagacgtttctaaaagtgtagacaacataaccaatcgctttgttcatgtggctaatctcacaacccaagcacaagaaaaagcaaacaacgggaaaacccaaatgtcttcgactgtcttccaaataagagatgtgcataccaaggtaactcaatccgctgaagtggtaaatattctaggcgaaaagtcggcggagattaaacagatcacagctatgatcagtgatatagcagcccgaaccaacttgctttcactaaatgcgagtatagaagctgcaagagcgggagagcagggaaaaggatttgcggttgtcgcttatgaagtacgcaatttatcggcacaagcaagtgaagcaacgggcaagatttcttcgctggtcaacgaaatcaccttaagaacagatgaagttgtggtttcaatgaatgaaggtgttcaatctctgaatgaaggcatgatgcttgtcgaaggtgtaggtaacgttttttctgagattgtgggtgccgttgaagaagtgggtagtgaggtggacacggcggctttagaagcaagatccgtaaatgaaggaaccgtttctatggttgaatcgatgaagaaaattgctgaaatctccgaacgtgctgcagattctactcaaacagtcgcaagcgtagtcgaggaaactaccgcatccatgcaggaagtgtctgcaggtgctaatatgcttgccaagagagcggaagagatgaatcaaacggtgtcggtattcaagatttaaataagcttcaaatcaagtggagttaagagcggcagccttggacgagaaaaaaagtcttagactgccgctgttttgttaagctcaaaccattagattacgaatgaacggcttcagcttttttggctgctcttttcagatcctgtttacgacgttcctccagataccgctccccattcttcttgtctgctgtcagtgtaaagcaggatatgatggtgaacaggcctgcaatggaacctagaattacataagttatcgggaaattcaatacttcatacatatgtcccacaatgggcgagaaaatggaaaccaccagggagcccataaataaatacagcaggtacatggtggaggacaagcgctggtcaaagttaacggtaatgtatttgaagatggcaaccagaataagcggtttctccagggagtgaatcatcttcattgcagctacccatatggaaccgaatggcaacgaagagccgataatacgcagagacataatcgacccggcaataactaatgcccatttggcggtcgttttgttcacaaaccaaggggtaacgaaaaggaacacaaattctaggaaaacctgcacagcgctcaaatcgccgaggaattgatttccttccgctttggaactgaactgtgatacgaagtatgtggcaaactgttggtcatatacctcatagatttgggtcacgccaaccatgaatagcataagaaaccagaactttttggtacgcacgagatgcagcacatcgattagcttcaacgactctgttttctgctgctcctgtccggacatttcgactttggtcaggaagatgcagatcatggcaacaacggcagataccgaggcaatccagaaggtcagatttacattgatattgatgacccgtcctgcaacaaaagtagccgccgcccacccaagtgaaccccacatacgaacccgcccgtattcaaagccatatttacgcgaaactttgtccatatacgaatcgacgaccccgttacctgcattaaataccaggccgataaatagcgcaccaacaatggcaccaatgacgaactgcgtttgaagtaatggaccgtacacatagataaaaaagggtccgacgagcaaaagaatcgtaaagagtatgtacagcagatgttttctcagacccagcttgtcggataagtaaccgaacaggggttgcataatcaaggccacgattgagttagccgcatatagaaatcccgtgtaggtttctgaaattcccaggctttgtcccagccaaatgacaaaaaaagacatggcggcagaccatgtaaacagataagcgaagttaaaaatactcagagaccaatagttgcgttttgccaaattcatcatgtttaagcaccccttcaaattgtagccgctcaatgtgttgccaacgtcaatatgtattgtctgtactattaattgtaaggattattcactcgcttccatagggcattttcccaagatttcctgtgcttatttcaatcagttgagaattcgcataaaacagcagatcctgatatggattaaatgggggctcaaactattttaaatatgttgaagaagaatagtactatatctacatcttgtgagaaataagtcctaagtgtaaaattctcttatagttcattaagctcactaaattcattctgcaagtacaaagttacttgaaatactgatcgtatatagagtattgtgtaacgatgagttaagacgaaacccactcatcctaaaggcatgggttatcactaggctctattaacatatattttataaattaaaaagaaaacgaataaaacaaaatgttgtgagttcgtagttggaggatttattatgtcgaaaagtgtttcttcgtcctttattatcattataggctcaatgctatttgccttattttttggtgcagggaatctaatctttccacctatgcttgggcaaatggctggaaagaatgtatgggtagccaatgcgggtttcttggttaccggagttggcttaccattactagccgtcacagcctttgttttttcgggcaaaagcaatttgcaaactttagcgagtcgtgtacatcctgtattcggccttgtctttacaacaattctttatctggccatcgggcctttatatgcaattcctagaaccggtagtgtgtcatttgaaattggagtaaagccttttttttctaacaatgcagatcatcctgtcgcacttgttgtatttactattcttttttttgcagttgcatgcttgttatcgcttaatcctacaaaaattattgatgttatcggaaagttcctaacacccattaaattgacattcattggattacttgtgattgtagctattattcacccaataggaaaattccaagaacctgcggaaggttatacatcgaatgtctttttcaaaggctttcaagagggttatttaacattggacgctcttgtagcctttatttttggaattattattgtgaatgcaattaaggatagaggggttactacaaaaaaagagttgatgatcatttgtgccaaagcgatagcaattgcggttatactcttagcttttatctatacgtctctttcatacatgggagcttctagcgttgaaaaattgggtgttttgggaaatggcgctgaggtgttagctaaggtttcctcctattattttggatcttatggttctattctattaggcttaatgattacagtagcgtgtttaacgacaagtgtggggcttatcacttcctgttcttccttttttcatggtttatttccaaaaatctcttataaaagagttgctctcatgttatctatatttagtgctcttgtagccaacataggtttaacacagcttattaaggtttcaacgccagtattaatggcaatatatcccattgctatttctcttatatttttaacttttttacatcccgtatttaaaggaaagccagaagtatatcaaggcagtttgatattaacctttatcgttagtttatttgatggcttgaatgctgctggaataaaaattaatgtaattaatgactttttcactcatcttcttccattatataatgtagggttagggtggttaattccctctgttttaggaggtgtagctggctacatatttactaaattaagaggaagaaaaataattttagtacttttgaagcccaaaaagaataaatgatttaccctatggcatattagtctgttatataagggacagcaagcgcctgatctgcttcgtgctgcttacggtactgcgaaggggtcaggccgttccattttttaaaggtcgcaataaaatagcttaaattgtcaaaaccaacatccagcgcaatatcaaccactttgcgatcactttgctccagcaacctgcaagccttctgaatccgatgatagttgatatattctaccgggcttttctgaaccatctgcttaaaaaaacggcaaaaatgcccctcactcattccaatctcatctgcgatctcccgtaaacgtataggttcatgagcatgactattgatatacgccagcgcttttttgatccgttcaactttgttgcgttgacccgccataatcacatcctctccgttagcaggggtcatgtgtggaaacaggcaggcaattatgctatagagctgcgccttggtcgccaattcacgggcagacgcattctgctcatggctggtgataatgtgtcgcaacgcaaccagcacctcctgctcccagggctgcacgcctcgaatgtgagggggagggacaagctttttactgataaatgggtcaataaactgcgtctgtaccgtatcctgcgtgcggctgtgcagcatgtctggatgaaacaccaccgcagaaaatatgcagcgagggcttttttgtaaataaccggcgtgaagctcgccgctgttgacaaaaagagcttcaccttcgttcacctccgtatagaccatatccgtctgaaaaatggcgcttccctgctccactacgataaactccatctcttcatgccaatgagactccagtatactatttccgttcaactgctctacgctcggatatacgctgactgggtacatgggattgccgtgaatgcggttttcccgcaacatttccctttgcatttcaacgactcctcttctgcaaactgatttatatagaaaacatcaaaatattgatacaatacgtcaaaataaacgaagtaaacccttacataaatcaatattattatagtaaggatttcgaaaaaatccaacaagcgatttgggttcaagaaataaagattgaagcggaggaagtaacagatgaaatttactgatggctattggatggttcgcaagggctatgaaatacaaaatcctgctgatatccgtgatattgtgacggacgatgcttccatgacggtatatgcagcgacccaccggattgagcacaaaggagatacactgaacggagcgttgctgaaagcgacctacagctcgcctatgccgaatgtcattcaggtgcgtctgaaccaccataagggacgggtgcatcaggggccgaattttgaaattcacaccttgccaacagaggtagatattacagtggatgaggacgcagcggtactgaaaagcggcgatctgagtgtgcgagtcggtcgtgggaagagctgggatgtaggcttttatgtcgaggatcgtaaagtcacaggcagcggacatcggggaccaggctatattacagacccgcaggatcagccttttttccgagaacagctggagctgggtatcggtgagtacgtatacggactcggagagcgtttcaccccgttcgtaaaaaatggccaagtggtcgatatctggaatgaagatggcgggactagcagtgagcaggcctataaaaacattccattttatctttcgaataaagggtatggtgtgttcgtcaaccatccggaaaaggtatcctatgagattgcatcggaaaatgtatcaaaggttcagtttagcgtctccggcgaatcgttagagtattttattattggtggagctaaccctaaagaggtactggacaattacaccaagctgacgggtaagcctgcattaccaccagcctggacctttggtctgtggctgaccacttcgttcacaacagattatgatgaagcgactgtgaaccattttgtggacgggatggctgagcgggatctaccactctcggtattccattttgactgcttctggatgaaggaataccaatggtgtgatttccagtgggatcaagatatgttcccagatccagaaggcatgctgcggagattaaaggccaagggtctcaaaatctgcgcatggatcaacccgtatattgcagaaaagtccattttgttcgatgaaggcatggagaatggctacttggtcaaaacagctgatggcagcgtttggcaatgggacctgtggcaggcagggatggggctggttgacttcacgaatccggctgctgtcgcatggtaccaggataagctgaaggtgctgatcgatcagggcgtggactgtttcaaaaccgactttggtgagcgtattccaacacatgtagtttatcatgatggctctgacccaatgaaaatgcataattattatacgcatttgtataacaaggcagtgtttgaagtgctggaggaaaagctgggtaaaaatgaagcagcgttatttgcacgttctgctacggccggggggcaacagttcccagttcactggggcggagactgctcgtcgacgtatgagtcgatggcagaatcattgcggggcggattatcacttggcttgagtgggtttggcttttggagccatgatattagcggctttgaactaacggctgcgccggacttatacaaacggtgggtgcagtttggacttttatcctcccatagtcgactacacggaaacgtgtcgtaccgtgttccttggctgtttgacgaagagtcagtcgacgtggtacgcagctttaccaaactcaaatgctcgctgatgccacacctgtatgcttctgctgtggaatcctcggtgaagggactgccgatgatgcgggctatggtgttggaattcccgcaggacccaacctgtgcaacgctcgatcgacaatacatgctaggagattccattttggtagctccgatctttaataaagaaggcagtgtacagtattatgtaccagagggtcagtggacgaatttacttacgaatgagagagtgtcaggtggtcgttgggttaacgagcatcatgattttgcaaccttgcctgtgctcgtgaagccgaacacactgttggcaattggtcatgaggacagtcgtccggattatgattatgctgatcaagtggcgcttcatttgtttgagcttgcagaggggcaacaagctcgaacggttatcgtgaatacgtcaggtgaagaagagctaacggttactgccagccgcaaggattctgttattacggtgaaggcagaaggtgctgttaaaccatggtcgatagttctgcgcggtatccacgaggctgttcaagtggaggaaggcagcagccagtcgggagaacagggtgtaatcattacaccagcttccagcggacagcaagagcttacgattcacgtgggctagataaggctctagaaagtggatgaagtatgtcataatgtagcgattatatgcaaaaaaagggcttgcctgatccaacaggcaggccctttttgatgcagatttttgctagagccagttgcaacttttagctcggtatctattccttatccattctactggagtagcagcggtacaatatactgccggaaaatatccacaggagcccgtttctttttgaatttatcagcggtaacgacaacaaccatgtcatacgacgggacgacaacaatgtattgcccaccgaagccgagagcgtaaaaatagtccctttcagttcctgtctctgtttcatctgaaaaggaagaagtccaccagtgccagccgtaaaatgccttttgtggtttggcagcaggaagaaacggacgggttgaatatcgaactgtctctgtttggatgatctgccgtccttcccagcctccttcgttcagataaagccgcccgaatttgagcatgtccatcgccctgagatgcagtccgaatccacccgtatgcgtgccctgaggatcggtctcccaacggtagctttcgataccgagcggttggaataattgctgctcggcaaattcagcaactgtttgtccagaaacattacgtagtatggtggccaaaagttgagaacagccagaactgtattccattcgcgtccctggcacatccgataatggctgtgaaagcacaaattgcacccagtctgacgttttgctcatggtaggaaaagaattttgcccgccaaattccgtccagttaaagcctgcagacatcgtcagcagatgttcaatcgtaatatcacgctttcgagaatcactatctgtgaccaactggggaaagaattcgaggatcggcgtctccggtttcggtccccgttgctggtccatagcgatactaactaatgcagaaatcacgcttttagtacaggaatttattttatagagttcgttagcaatttgaggttcacgataataattcatgatcatgttaccctgctgctcaataaggcagctgcgggtttccaactcgttaagcacgtgaataagtggtttgagttccagacttttcatgcagttcctccttgaggcttatggcataccaatacatagtatatcattttaatagtctataattcgaaggctacaaacggaaaacagttcatttacctaatttagaatttttttgttttttgatattaaaaaagatatatatgttcactgaatagacacaaatatatttaaaaatctatacactttttctgtttcattcaaaaaaactgtcgaataaaacgatatatagtaagttggacattttattcagaaataactgggggaccgattcatgaatttaaccattaaggccaaaatgattcttagcgcgatactgatcccgagtgtgattgcagccatgctgctgaccaattacattttaagcgtacatagtgagaatgagtacaaggacattatgaatcgtgaagaggctattgcgtataactcgaagtctcttcaatttttgttaaacggcatatctaatgatgagcgggcatatttgctaactcgtgacgaacagtacgggcgagagatcagaaacaagcagagtgaagttgcaaagttgctacaggagacagaagctttgcttagtacaggcaatgaggattctaagaaaaagatgactgatctcaagacggggattaatacctatatgaatcaagttcatcgcttactgactacagcgggatatcagagtacaagagatgatgctttcccgccattttctgatttgctcgatgattttgaaaacgaacgggtgttgcggaagcaactggataccaaggtagtagcctttgtcaaagctcaagaggatatggtgacggtgaaaatacagcaagcgcaccaaacgatgacgaatacatccttgattacgagtgttgtaggacttctagttatcatttacagtatttttcaatccatcgtgctgattcgttccattcgtccattacaccatatgaatgagcagctgttggaaatgtctgaaggtgggggagatttgcgtagccgactggatattacgtccaaagacgaaatcggtatgattgcaagctcctacaacaagcttattgagggattccgcagtattatagtggatgctcaagatacggcgcgtacattaaccgtaaccgcagagcgggttagcgtaagtacagaggaaatgaatcaggccaatcgtcatacttccggtgtaatggaagagctagcggctggtatggagcatcaggtcgatgatattacacaaactacagataccgtgaaagagctagcccacgaactggagcatattgcagctacgagccagcaggtgtacgagttatctgatacagccgctaaagatgcagaagcaggagaacaatctataggtcaggctatgcgtcagatggaaaaggtaagcgaaagtgtagacagctctgcacgtgctgtgcgttcacttagtgaacaggccgaacagattggcatgattggagctgtcattaccggaatagccaaacagacaggaatgctagcgctcaacgcgtcgattgaagcggcaagagccggagagcaggggaaaggatttgctgttgtagcctctgaggtaagaagattggccgagcaggtatcagtttcagcagcagaaattacacaatttgtgcaaaatattcaggagcatgttggaaatgtcgcttccagtatgcagacaggtacggttgaagtgcagtctggagtaagggtcatgcaatccgcagaaaccgcgtttcgtcagattgggagttccattcaacaggtcagcgaacagattcatagtgtaaatcggtctgtagaacaaatgtccggcggatccgagcgaatggtggaagcagtagaacgtattcgtgaagtagcagagcagtcggcagggggaacccagagtgtcagtgcggcggctgaagagcaactggcttccatggaggaaattgcgtcttccattcatacactggcggatatgtcgcaacttctgaatgcaagggtcggtggatttaaagtgtagccgcataaattgccaccaatgtaaacacaataacatctgttgaacgaatcagaacagctgtgttattactttgcaaaggtggtaacgggatgcaacaaaataaagggaatctgcttgcgttaggttccatcccgctgatgatgacgctgggtaattccatgctgattccagtcttaccggaaatcggacgtaagctacatgtaagctcttttcagattagcatgttgattacagtatatgcggtggtggccattttactgataccgattgcgggctatctttccgaccgatttggccgtaaggcggtgattgttccctgtctgattctgactgtgattggaggggggatttctgctgtgggagcatggctgcttcacgacttggcagcttactggaccattattgcaggccgtctacttcagggtgcgggagcggcaggggcttttcctatagtcattccacttgtgggtgatctgtacgaaaacgaggatgaggccagcaaaaacctaggggtagttgagacctacaacacatttggtaaagtgttaagtccgatactcggtgccgcgttaggagctgttctatggtttttgccattggcggtgattccggggctctgtctgatttcgcttattttagtgctttggctgatccatgtgcctaagcgtaagaagcaaccgattatgtttcgagaatttgtgggaaatgtgaagcaagtgcttgccgaaaaaggacgctggctctatgctatttttgcaatgggcggtatttgtatgtttgtcatttttggcgtcctgttttacttatctgacatactggaaagtcgttacaacctccatggagtgtggaaaggttttgtgttagccattccgctgatttccctctgtctgtgctcttatgtaggaggcaagatcatcggcaagcacaaaaagcgcatgaagtggatcggtttcagtggtttggccgtattgacgatcagctttgccattctcggatttttccaaaatatttatgcggtgatcggattgtttacgttagggggcggcgggattgggctcgcactgccttgtttggattccctcattacgaagggaattgaaaaagaggagcgcggaaccattacttcgttgtatagcagcatgcgctttgtcggggtatcgttaggccctccggttgtttcattgctgctgggtcgcagtggacatggtctgctttttggcgtgatggccgcagtgggaggcattgcagctatgctgatgctgtttgcggtcagacccaagcaggatgaacccacagatgacaaatccactgaccctatgaatgtggataaggggctaaccgatgtgtcccgagaaaagcctctttctcccaagctaagacgcaaagctcctgtgaaataagaaataacacccgttgtccatgaaattatggcaacgggtgtttttgaaaactgagcaagtataaactaatattcatttgtatatcatagacttacccttctagagggacatgtgtcttaggcttacggcttgtgacgatttgtatgacatagatcagtaagaacagtacaataaacagcgaggagagacggtacatccacgcataatcacttgctttggcgataatgccaagtataagcgctccggctgcaaccccaaaatcgagggaattgagaaacattccgtttgccatacccctctgtttaggagacacgacctgaatcatccaggtttgcagggtcggctgcatgacaccaaacccgataccgtagcaaagagcagacatatacatgaagacatcactgtgcgcgtaggatagcaggatcagaccgccaattaaaaacagggagccggggatgagcagtgcttttgccccctttttgtcataaatacggcccgagaagggacgcacgatcagcacggataccgcattaaacaggaaaaagtaggcaggatgcgccagatttgcttcatccccgtaaagcgccataaagccgagtaacccaccatatgtgatagacatcagcatgttcaacaaggcgggaatccacaatttacggttaaatgccggttttcgcccttcttccaaaggaaccataggtggttcgatgtgccccttaggtagtgtacgaatcagccagtaagccaacgggaatatcacaacaattacagctgctgtcgtataggcaagcaggttgaaactcccgtattgcagcatcgaaatgccgatggttggcccaattgacattgctaaactggtggaaagaccaaaaaaacccattccttcaccgagacgtttgggcgggatgacgtcagaggccatcgttggaaaggccgtactactcataccgaagccgattccaaacaacatccgcatgagcaggagcactgtaatcgtcggtgaaacgctgtatcccagtgttcctgctaatgcaaacagcagtccgatgaagatcagggtgctgcgatgtcctttttccagcatacgggctgaaaagagtcgtgctgcaatcgcacttaaagcgaataaggtggtaacgagactgacctgaacggaactggcgtggaatgcatttttcacataggaagggatagaagaaacgatcatttgtaattccagaaacaaaaataaattggaaaccgtaagaacgataaattccttggtccaaagaggttgcttgccttgttgcatattaatcgttctctccttgtttttctgattcggtcatgttggcgtgaatttgtaaaagagtctggcggaattgcttcagatcggccgaggaaattccttttacaaaatcgtgattggcatcacgttcgacaggaagagtctcctccacaagctgtcggcctgcttcagtcaaatgaagcaaataggcccgacgatcctgtgggctattgacacgccgtacccagcccttcttgtccaacaaatcaataattcgagtcgtggtaggctggtccttcacggccttagctgcaatttctttctgatttaaaccctcagcctgatagatttggtacagaaccgaccattgttctggggatatatcataaggtttgaggcgctgcaagagctgctgactcattttgcggtgagtaatcccgagtaacatcccaatggaacaatcggaaggcaagttattcatagatactcctttctgtttcccgtacataaattacttcgaaattaattagttgttataacaattatatgaacaacaagttattttgtcaaagaaagttgttcagcttttgggttctgccatcactaaagcaaaacaaaaaaaacagcccgtaaaatacgggctgtttgggttgatatagtatcgttttgccatgactggaaaattaagctttaggtacagtttcccagtccttcaggaagcgttcgataccgctgtctgtcagcgggtgtttccacagagaagggagcaaggaacctggaatggtggcaatatgtgcaccagacagagcagcatcttctacatgcttaatattacggatggatgcagcgatgatttcggatttcagaccatgaatgtccaaaatttgtctcagctcacgaatcagcttcataccatcaacagcaatatcatccagacgtcctacgaacgggctgataaaagtagcgccagctttggctgccatcaaaccttgagccgcggagaaaatcagtgttacattcgttttgattccgttcttggtcagctcgttacaagcgtacaagccgtcttcggtcatcggaagcttgataaccacgttgggtgcccacttggcgatatcataagcttctttgagcatatcttcagccttcagaccaataacctcagcacttacgggaccttcaacgatactgcaaatctcctgaatgacttccttgaacactcgaccttctttagcgatcagtgaagggttcgttgttacaccatcaaccagacccaaacgttcaatacgtttgatttcttcaatgttaccagtatccaagaaaaatttcatttgatttcctcctcaggtttatataatacataatacatatcacatgcgatgtacaatagttcatttaaatgtagcatattgcacacgttaaacttataattagtatgtattacattcttaattgtgacacattttaaattcgaaaacaagctgtgtatgattaaaatttgatgaattgtcggaagaagctgaaatttaccgatccatgctcgtctataatgtatactaccccactccataaggaggtaatcactattcaactgtctgaaagacagcgggaaattgttgaaattgtccggcgtctggcacctgttacgggggataaaattgctaaaacactgggactgacgcgtccgactctccgttctgaccttgctctgctcgttatgctcgggctggtggatgccaagccgaaggtaggctacctgccaggacgttatcctaaatatgatagtcatatcggcaacatgctcaaaaagctgactgtggcagatatacttagcgatccgattttgatttccggtgacacgaccgcctatgatgcggtgctgatgttgtttcagcaaaatacaggcacgctgatggtcacaggggaggagcaggagttcattgggattgttacccgcaaggatttgctgaaggtcatgctggggcataccgatcttcacaccgtcccggtgaccatggccatgacgcgccgggcccaaatgacgacgcttgctccagaagacactttactggaagcgatattgagactgattcggcatcaggtcaattgtcttccagttttggacgagcaatgtagctcctcaactccaattcgggggttggtaggacgggttacgaaaacggatatcatgaatgccattctgagcttgacagaagaaaaaacgtaaaacattgaataagggggccttgtatgtactggttggccatgctgacgatgctgattgaccatgtcggacttgtgttttttccgacggatccggcttggagaattgccggcaggcttgcttttccaatctacgcgtacgcgctgtatttgggatatactcatacccgagacatacggagctatatgctccgtctactcggactggctctgatatctcaagttccctatatgctagcgtttgatgtgcttagaccgaacgtaatctggacgctattggcctcattgttcgcgctggctgctgcatcccgcttgaagcactggacggctgtaatggttctgtacgtcctttcagctctggttatggagctcagccagatggattacggagcctatggactgctgttggttctcatttatcgatatacccgttcatatatgatgattgcagcccattttattttgaacgtagtgtatgatatagtgcatcacgcgaatctccaacactttagtctgctgtccagcattctgatcgtatgttttgcaactggagaaagcggattttataataaggtaccgcgctggttgtggcgtagcttttacccggtacatctggctgttatcgcggcaattcgtatctggccctaatctatatcttatacagcaaaagaacctttaaaaccacgacataaatggttttaaaggttcttttgttttcctttattaagctagccaacgtttaggataccttgttgggaccttgggcaaaaggaagtgggcgaaggggagcaccttccttcatgtattgcaccaacacttctggaatattatgtattccacctgcattgacgcgatagccgtttgtttgcccgggcgagttaatcccccgtttcaccgtgaacgtaacgtcaattcccaaggaacggcaaatttccagcgtctccttggtatacccaccataagggaaggcaagtacattctgatcattgtgtagatgcttgaatagcttcttgtcagccatgcccaagtcggtataaacccgctgtttgaactcattctcggtttccattcgccccagctttttcgaatacaccggacccatcagaagtggcttttgttgggtgcgcgttgtgttggagtatccgtaagcatgctggtcattggtatggttgtaaaaatcaataccctcggcatgcatctgatgaatttgatcccatgtcagcttaggaattccaatatgtttgggattgctgattgtggacgtgatgagaaaattggttgccggtacctggtactttttcaacacaggaaaagtgtccgtataaaaggactcatagccgtcgtcgaatgtcataagtactgcattatcaggaaccttggctttatgtaaaataaagtccgtatactctttcatcgtgatccagtggaagccgttagctttcatttcgtccaactgcctcgttaaattactaagtttgagagcgccgggatcaggtggagtcttggtcacctcatgatacatcaggacaattactttgttttggtaatatactttatctggtgtaggcgtcagtgagaacaaatggcgtaccaatcgatctgcatgagctgtacgtgtacgatgagtccctttaactgtgggtgtgtggtatatgctacgtgcttcatacaccaaaatccctaaaatagccaacaaacttatgattagcaacgttcttttaaaaaaagtgtgtttcattgaatgacatcccccgcatgcaaaaaaattctgaaagtatagaggtttatactaaatataaaactagcaaaatctagtctatcataccgaaaacatgcgggggaaatatcacaactttgttacctctgtgttgcttttacagataccgatggagaggtcgggaagtaaccgatctcgacggcatgctggatcatgttccgaataaagttaaggtcggttgccgggcattgaacgccagcttgttccagcagagctgcggttacagagcatccgtaacggtaagctgaatccttggctccgtcaccttccagttgtcccatagcaaggtgaagggcatcctcctgaatgccggaagacggattcagcagccaagcgctgtaatcgtcaaaaggcagggtttctactgcgtaaccgagttggtttaccatagcgatcagttcatcatatggcagtgggttcggattgcagatatggaaaatgcggtttgcgcttttttgatgaacggacagctctacgatagcacggctggcgtaatcaatcggtgtgaagtccgtatgccaatcggcttgtggcgctttgcccagcaccagcatcgctttcatcatacgataataagcattgctgtcgatatttcgctggaagcgtccgttggccgaatgggctgtcaaattgcctgcgcgatagatcgagacaggcgtacccgtttgagctgcttggaacaacagtttctccgccgcgagtttactgttcgtgtacaggttgtccacgttcagttcttctgggaaggcagaaagctccaatgccgactcccattttccttcgttagcaagatcctccggtattcccatagtagagacatgatggaaggatactcctggcttggcttgagcgattttcagcagttccagtgttccggttacattcgtgcgatcgaaggctgccgaatcaccaaaatggcgaacgtcagcggcgctgtgaatgatgccgtcgatttggtgctccagcatatggcggtcgacggaagagagacccagatcagcttgctccagatccccatagacagcttttacccgtccttcaatcaagctggagatatcttgtccaaaatatcccgtcaatacggactgaatacgctcgataccggatggaccgtcctgagaagggcgtaccatcgcgtatactttggcttctgtccgttgaagtaggtcatacagaatgtgcgagcccagatagcctgtagcaccggttaacaaaatcacgtgcaagtcgcggacttcagctaagtcagaagcaccagacaactcaataggatgctcattcaagtccattttttcttgagaaatcgcgagtggcttgcgttgcggcgtttgttccgtacctaattgttccacgtattcagcaagctcgcgaacggttttgtagcggaaaaaatctccgatgcgcagcgcgccataacgcggctttagaatagccagcacatgaatgacacgaagcgaatcgcccccgatcaggaagaaatcatcggtagcgccaatgttatttttaccaagcacttgagtccatgcttcggcaatgagtgtttcggttccttctcggagaggttccccgccaaatgaaagatcagacgcttcgggaagtggtcgcagggccagctttttgcgatcgatcttaccagttggtgaaattggcatggcttctagctgaacgacatggcttggtacaaaataagaaggcagcttgcccccaatataagactgaataacgtcttgtggaatggattgtccatccgaagtggtaaaatagccaactaacatgttctgatctgtgtgatctttgacggctactacagcgacgtcctgaacacctggatgtttggaaaaatggtcttcaatttctccaatttcaatccgattcccccgaattttgagctgtgaatccttgcggcttacgtattcaatcgtaccgtctggcagcagcttggcgatatcacccgagcggtacattttttcacccggaacaaaaggattgtccacgaacgattgggctgtacgttctggctgatggagatagccatgggccaacgcaggcgtagcaatgcatacttcgcccggaatattgacagggcaaagcttgttatcatcgttaacgatatacactttgtaattgtaaatcggcttgccgatcggaatattgacgacatgctcaggcacggcaccacggactcgatgggtcgtcgtcgctacggtgcattcggtcggtccgtatacgtttacgatgtcggtatctgtaccgaatttgctttggaacgctcgaacttgtgagccgtacagcgcttcgcctgccacggtaacgatccgtaccttagcgagtttgcgatagccttcgtctgacaagtacgtagatagctgattaaagaatacggtcggcaaaatggtaataatcgtcgtgcctgtacgtgcaatggcttcagcgaattcttcaacagatacacgttcttcggaagacagcaagtacaattttgcaccgtaaaacaaggctccaattgtatcccaaacggatgcatcgaagctgtaggttgcaaattgggtcaatacatcctgaggtgtaatgtcgcaatcgcgttgcacgacagctcctaggttaacgacaccgcggtgagcgatcagggcacctttcggtttgcctgtagagccggatgtatagatgacataagctagatcatccggacttacattaacgtttggattgcttgcagcatagcctgccagtggtccgttaattgctaaaatttcttttaccgtctcaatggaaccgcacagttcagtcgcttgttccatgagtgcggaagttgttaagacaaaaggagaacgcgtgtcttcgacaatgtagctgctccggtcggcggggtgggcgggatcaacaggcacatacacgcccccggctttcaggatacccagaagggaaataacggtctccaagcttcgttccatgaagatagtcacgaattcacctttggtaagacctttagataacaagacacgtgcgacttggttagcacgttcgttcaactcacggtacgtgtactctccagtgtgggaagcaatagccggacgatcagggtattgtgaagcagcctcctcaaacattccatgaatagtttgatgctcaggatatttcacgactgtattatttaaagcttcgtgagcagctcgatctgcatctgataatatatcaatggagttcacaagtgcatggctgttggttagcgcgccgcgcaaaagagtttcaaagtattctgcgtatcggacaaccgttgtttccagcaagagtgattgatcatatcggatctgtatttgataagtgccattgtgttcactaacagcccagtccataatacgggattctactccgctgtccgtaggcagatttgccgaaaatgaagtatcggcttgtggttctgcaaggtatgcattaggctcacggagcatctcctgaaataagtctgctagttcatgaaaagtcgtttccttttcaactgtcagcgaagctgtaagcagaccggtttgtggcacaaatgtagaaaaagaaacttcttcttctgcggataggcgatatacccatgcagtatatgctgataggagcaacgcttgtttgtcttccgcagttttttgctgatttaattgttccgagatggacgcttctaactctacttgataagtagaggatgtatgcgtgcgttgtatacgtgcacaatccaagggaactaggaatggggatggggttgtctgtgtgctgttttgtagtaatgaagccattacgctaacctcctgaatgtatgatgtcttaatataaatggtaaactcagtaaatgcctccgatcccttcaaatgcatgaacaggagggaggcattaccgaatgatttacttataaatgttggagcggataaatggttattatgatttggtacggttggtgtctgcaattttgaaataagatgtaatttcttgaagctcttcagacatggacgtcaatttatgggatgaatcaatgatcgaatccaaagaagctttttgctcctccaccgtttgcacaatgtgaacactgttattggctgttttggttacagtggaagaaagatcgtctgctgtcgcggtcatttcctgtgtacccgcagatatttgctcagtagcgctggaaacttcttggatttgccatgctacatttttagttgcttgaagaatatcattgaacagcacgcctgcttgtccggcaacgacgattccgttttgaacttcaacgtttccttgctccatcgacttcacagcttgtccgatttcactttgaatttcttcaatcagggacgtgatttgtttggttgcatccgcagattgttctgccagcttacgtacttcactggcaacaacggcaaagcctttaccttcttcaccaacgcgcgcagcttcaatagaagcgttcaaagcgagcaggttggtttgactggagatgcctgaaatggtactgatgatattgccaatttcctgcgaacgactgtccagcaacttgatgatacgggaagtattggtgactgtatcggtaatcaagtgcatttgagatgataccttgcttacaatctcattgccttcgttagaacgtttttctaccgaattggcttcttccgcaacattggaagaactcgtggcaatattttgaattaccgaagccatttcagccatggcacgtgcactatcgcctgttgctttttcctgcgaacggatattctccgtaatttcactgatgttttgattgatgatgttggagttgattccgttttgttcgcagattgcgagtagttccttggcagattcattaacttcatcagttgtctgcttcactttggtcataatgctgttaatatgacttaccatatcgttgaaattctgatttacgagccccaaatcatcatgacctgcatgaatttgaacatccagatttcctctgcttacttcactgataccgtacatcagttgcttaatcggggacagcgtgcgcttcacaacccaatattgaagcgccaggcagattagtaggaaaatcactaaaatggtagcgccgctaatgagcagcttggttaagccggcaggtacggcgccagcatctgcatcgactgcaaaatatgcaaagattttgccacttgaatctttaatcggagtcatcaaagtcgtccatgtaccaaaagaatcatcgtagaagctggtaaatgttggtttgccactgtccagcataccggttacgccgactgccacgacattgggttgctcgtacatagagccaacgagcagcttatctttttcaaatgcttctctgagatccgttggcatcgccacaatagaagttagattgccattttcgagctccgtcccgaatatataggcatgagagatattcggattggtcgccatgatgttatctaggtacgtgcggagtttggtttgaacgggtccatcatagtttttctcttgaaccgcttgggttacttcatcggaattaatgccctgggcccacttcaatgtgattttttccacttgcccatgcaattggtctatcaaaatcgtacgttggatcaaatagctagacacaataaggactagcccaatcaatacgatgttgaagaaggataataataagtttttggtgaagaatgataagctactccactttttcaaaatgttccactccctggttgtatttttgtatatggtgttgaaccgcttatcgaatgagataatcaagttccccttacaaacataataatcgagataatagacccttgaattttatgtaataggtcttaagtccttttgcagacaagtatgatatccctatatatatgtcgtacgaaaagcccttgaaatgaataccttacacaataaaaaattaatttttaataggtaaacgctgtctgtgattcagtatattccaatttatacttctacttgaaattcgacttcattacagtccataagcaactattcaacagaaaccatcatactttataatagagtcaaatgcacttatcaatttgggacatttttcatatttaacgttggaaatgcttgatttatcgcggtttttgtaaattgtttgcgaaatgagtccttatatctatgcaaagagaagagggataagaagaatgtccaagcttacgattttaaaggttgagagtcatcacgaggatttgcatgagttgattcaaaggctggatgaggacttgctggaaaggtatcctgccgacgaaatttacttggtcgattttaccaatccgaaagttaaagaaatggttttcgctgttgtgtatgtggacgaaaaaccggtggcttgtggagggcttaggcctatagatgcggaagaaatggagctcaaaagattttatgtcgattcctcttatcgcagacaaggaattgcggtgagcctattatcttttttggaagaggaagccagcaaacggggagttgtaaggattaaactggagaccggagcggctcaacctgaagcgattgctctctataccaagcggggatacgaacctattgaacgatttggggagtatgaacacgatgaaaacagcctgtgttatggtaaaaagctgtctctgttattataaagcgttctcttataaaatggatgatgatcaatactagcctatatagcgggagagatgataatgaatttgaagcaaaaagcagccgaaaaagcagttgaggcgattcaggacggcatgaaagtaggacttggtacaggctcgacagccttttgggctattcaaaaaattggtgagcgtgtagcgcaaggattacatatacaggctgtagctacatcccaagcttcggaggatcaggccagggagctgggaattcccatcattccgtttgatcagattggaaggcttgacgttaccatcgacggtgcagacgaggtgaacgagcagctggtgctggtgaaaggtggaggcggagccttactgagagagaaaattgtggaaagcaatagcgaccgattaattattattgtcgatgagtccaaggatgtgaaggtactgggtgcatttcctttacccgttgaggtcgtaccctttgccagtgaatggacgttggaggctttgcggcagacgggctgtaaagcggagtggcgtatgaaagacggcgagcgcttccttacggataacggtaattatattgctgattgtcgctatggtacgattgagaatccgcaggagttggaaagccgcttgaatcaaattccgggtgtagtcgataacggactgttcattaatatggcggaccaagttattatcgcacgggccaatggacagatcgacgtccgtaacaagtaatgtttaggacccgcctgcttcatcatgtggcgttgatgttattgattttatatacagggcttctattatattggatgtttctcggttttggtcgtacattacggccaggacccccgtattcgtataatattgttccgtttgatacgatcaggcaatactggcgggcaatggagtcgtttccttttcgggtatggggtgttaatttgctcggcaatattggcgtattcattcccttcggtattcttgtgcctatcatttgggtgtccatgcgaagtataggcagtctgttgttaacgatagtgatcgcactggtcattctagaggtgtcccaaatgctgctgggcgcaggtacaatggatgtagatgacatcatattgaacgttctgggagtattatgcggccgtgttgcctacgtgtttttacgtaagaagttagggattacaacataatcgtcctgctctctggatcagtgcattaagactgactgagagcgggctttttttacataatgaactgtaaccttcacataatagacggtaattcctccatttataggccgtaggagcaggggaaggaacgcttaaacttgacaaaagtgcacaattaagatatcttggaataaagatatgagtaacggaggctgttaatatgtctgtaaaaccagatgatcaggacttagcgcttaatttgttcgttgttctggctcgtgcttataattcggtcacgtcccgtacgaatcgggacattcatagtcatggtttaaatacaacagaatttggagtgcttgatctgctgtattatcggggaccacagcctttgcagaagattggagaaaaggtactaatctctagtgggaatattacgtacgtggtagataaacttcagaaaaaaaacttgcttacccgtcgtgcatcacaagatgatcggcgtgtgatttatgcagaattgactgatgatggacgccatttctttgagcaaatattcccgcagcatcatcgtgtcattatggagaccgtagatggcttatctgtggaagagaaggagcaggctattcatctgttaaaaaagcttggactcacggctgagggacagaagagtaacggatcataaattgtgcgtgtgcaggttaaatctgctttagataaaataccgacttctcggtattttatttttttgtcgtattttgggggagtagggttaatgtagaggcgtaaatcaggtataattatctaatagtcacgtccggaacaaattcctagtacctgtttcgaatacaaaaccttgtcggggaaggagctgtacatgagtatacagcaatataccgcaggtgaatcgctattgatgcaagcaggagctttggctgaattagttacccataagcaatacgaattacagcccgatcttttgcagcgttttggggataacggtaaaataaagacaaaacaggattctatatatagtttgaactatttagctgaaagtgtaatcatgaacagccctattttatttacacagtatgtttcttggttaaaaaagcttctggagggtttcggcataacccaagaagacttgagcatcaatttcagattaatccaggagacgttggtagagcacttcgatcatacagataaagctatggtgctggagcatctggatttggggatacagcaaatagggaagaaagaggagtatgcctcttttattacagatgataatccctatgctgctgacgtggctcaatatttggaacatttactctcaggtaatcgcagacaggctttggattggatcgtccgtttgctggatgagggtatctctattcaacatacgtataaatatatttttcaaatttcgcaatatgaaataggtcgtctatggcatgaaggcaaaatcaccgttggtcaagagcatttttgcactgctgtgactcaatttattatttccagcctgtacccccaatggatgggaaatggaaataaggaacgctgcctcgtggcggcgtgtgtaggcagcgagcagcatgaaattggtctgcgtatgctggctgatatatttgaaatggatggttgggatacgtattatttaggcgccaatgtacctaatcggagtctgcttcaggccattgtgagttacgaggcggatgtggtggctatctcagctaccatggcttaccatgtccatctagtgaaagagttgattgctctcattcggcaagacccaacgactagccatgtgaaaattatggtcggaggcttgccttttaatctcgattcccacttgtggcaggaagtaggggcggacggatacgcaccaggtgcagaggaagcgctggaggttgcaggggacttactttcgctcaggaaataaggttagttatgtgaacctgtagtcattttgtaaagggggccttttaatatgaaggaaccgacagcagaaatggctgtcctgcggaaaacggtcgaacaattaacggatgagattgtgaaaagcaaggccgaggaagaaaagttgctgaatgaattttcatcaatgaacaacgagctggtcaatctgcagcgtcaacttgccaaaagcaatgcggaattaacacggacgaaggaagaagcggtacgggctaatgacctaaagagcacttttctggctgtggttagtcatgaatttagaacgccaatgaacggaatacttggaatgattgaaatgttaggttcatccaaactttccccagatcaacggcaggccatcgatgtcatacgtgagtcagcctctctgttgttgaacatgattaataatctgctcgatatatctaaagtggaagcaggacagatggaactggagatcggaaacgtcagagttcaggcgattatgagccacgttgctcagttgttggagccacaaatctatcagatgggtaaccgtttgagtatagagaccgattccggtgtggcagagcatttggagggagattcggcaaggatcatgcagatcttgctcaatctgttgaacaatgcgaataaatttaccagtgaaggattgctcatcattcgaacaaaattggtggaggaaacaaaagattcccaacgtgttcggtttgaggtgcaggattcgggtattggtatttcaccggaggatcagaataagctgtttcagccttatgtacaagccggtgaaggcagcgcctcccaatatggaggaacgggtttagggctatggatatgcagttcatttgtggaactcatgcagggaaaaattggggtcgtcagtaaagaaggccaaggctctacgttctggtttgaaattcccctcatgaaaggatcggagcaagcagacgaaatggagaagcatgaaaatggtgatttgaaggcatttagcgagttgctgcgtgagcatagtcattctcaaactattttggtagctgaggataatcgggtgaatcggcaggtggtgcaattacagcttaaccacctgggattccagcatattgattttgctgaggatggacaagctgctgtaagagcggcctccgaacgatcctacgcttgtattctaatggatcatcatatgcctctgctgaatggtcatgatgcggcaaaagcgatccgccagcgggaagcagaaaaccagcaaccccctgtaccgatcatttctttgaccggaaatgtatccgaggaggatcaggcacggagccaggaggttggagtgaacgattacttgatgaagccagtaacgattgaaaagctctctgaaaagcttgtaaaatggcttccaaagccggaaaccgagccgattttggatgaggaagttatacgtgaaattatgctgctggacgaggatggcagcacgggactactggagtcattggtcgaaatgtatacgagtgatacacctgccaaaatcaataagttaaatgaactggctgctgcgggcgaagttacaaaagtagtagaggctgctcatgagttgaaatcaggcagcgtgagtctgggtgtcggacgtttgtcctcgttgctgtccgatattgaacagcttgcacgggagaaccgactcgagaatgcgaaagcgaagttgtctgcgctccaatctgtctatcaagcaacgtgttcagaactggaacgttatattcaccagtgctagccaggtttcccccttgttagacttgcatacggaaggaggacgtaagagacatatatgaaagaacagttgcgttctattcacccgctggcctggacgattattgtcggtactatttttgggcggatggcgacatccatgagtatcccgtttttgtctatttaccttaccacccgtttaggggtgtccccctttcatacgggggtgatcgtatcggtcagctcgttggtcggcatttttgccagtttttacggtggatatatttcagatcgaatcggacggcgtaaggtgatgctggtgtccattgcgagctgggcgcttgtattcgttgcttttgcgttggcggaagcggcctgggccttttttgtcattaatgctctgaatggcctgtgcagatccttgttcgagccaacctcacgggcgctgttatcagatgtaaccctgaaggagaaaagactgcttatctacaatatgagatatgcggccattaatgttggggtggtggcagggccgttgcttggtttaatgctaggatctgcatccacgggtacgccgtttatggtagctgctggtgtgtacgcattgtacggggtactgttgttgatccaatttgcccggtatgcatcggatctgcatataggtacaacagcgggagaggctccactgcgaatgggtgaggcattccgtacagccagccgtgacccggtgtttatgccaattttgctgggaacggtattttgtgtgatgggctatgcgcattccaattccacaatgcctcaattcttgtccttatccttcgcagaaggaacccgatggtttacatacatgctgacggtcaacgcggtttgtgtattggcatttcaatatccgctggtgcgactggcaagccgattttccccggtgaattccttgattgcagggaatatatgtattgcggtcagcctgttgctgtgcggtatgctaaactcaggctggatgtttatactggatatggtgctgtttacggttggtgaagtgttattgttcacgatgctggacgtattgattgaccaaattgcagatgctcaatataaagggacctacttcggtacaatcggctttaataatttgggaagcgtgctggctcctttatttggtggctggttgctggatatctatggtcaaacggcgccgcttgccgtttttgttccggttgccctgtcggttgtgattggtattccattccttctggtcgcacgccgccgtctggtgcagcgtacagcacggatcgcggctcagggaggaaaatcggtgcagcaactgtcatcataaaaagggagttgagtgcaggatgaagtcggaagaaaatgcgctacgaatcatacaatatatgaatgatccgcaggtactgcaagacttgcgctatgtgcgagagctgaagttgccacaaggatgtattgccgcaggctatgtacgtaaccgggtttgggacaagctccatggctatacaactgctacacctttaaacgatattgatgttatttattttgacccgaaaaatacgctagaggaacgagatgagtatctagaattgtccttgaaccgtaagcaggctggacgtaactggtctgtcaaaaatcaggctcggatgcatattcgcaacggtgaggctccgtattcctcggtagaggatgcgatgagccgctggccagagacggcaacggctgtggcggttagaatgaatgacaaggatcaaatagaggtcatttgtccgcatggattggaagatttactggatatgcgggtacggcaaagccctttgtttcgtcacacaacggcttttcgtcagcgtgtatttgagaagcaatggcttgataactggccgttgcttattatggagaattagagtgtaatcctaatttcaggatattaaggagagacgacaaacaatgtttaaaaatataaaaacagattcagatcgtgaggaggttctggagctgttaacctacgctgtgctggatcaccctgaacgcggagaagcagctttacgtacctatcaagcctcggatgactggaagctgttcggtgtagaagatgaaggacttattgtaggtattgtcggctttgaggagcaggaggatgggacaaccgtaattcgtcatctggccgtgttgcctgaaaaccgtcatagaggatatgccagaggtatgctgcttacgctcattcaggagcgtaatccgaaacggcttactgtggacacggatgcggagggggcagatttcttccgcaacgtgggctttgccgtctatggatcagaggatttgccagagggtgggcaattccattgtgtatatgaaatagacgaagaataagcgaatctccgggtcccgcgtccctttttctacataagatatgttatgtagaaagagggaggtgagtttcattggcgtaccattacacagcgattggagattctttaacaacaggtgcagggacgttgctgagcggcggatttgtacctatctatcggcgaatgacagaaagacatctccgtacgccagtcagttacgagaatctgggaatcaatgggctgacatcgcaggagttgctgtcaatggtccgcaacaatccgctttttcggtcggcgctcagccgggctgaacttataaccgtaacgatcggcggaaatgatctgcgcccatacatcagcgcccttgctggaggttccggcttgtcgggttcttccattccgcaagcgttgaatcacacaaaagaacatgtgcgccaaattgtacatgccctgtatcagataaagtccggtcagcgtgagccatttatcatccgaatggtgggattatataatccttttccaggggtgagggaggcgggagtatatgtgcgccagtataactcgtttctctatacattgggcggaccaaattaccgggtggcgaacatttatcccgcatttgagggctatgaacgggcactgctttcgttagatcgggtgcatccgaacagtcgtggttatcgcgtgattgcggaagagctgaatcggcttggttatgcgccgttacggtgagcgtgagaggatgctttggatcggacaaagtatattaaagaaagaggttcatgatggcagtagcaactgaccatcatgaacctctttttctgcatttcggcgtgctaaacttccaatatagccttcagcttggtgcagtcttccagtaactcgggcagctgacccaaaaatagaaggagggctttcacgtgagctatttccacgttttcttccgagagttcaccctttaatctgcttaggatttgcacatattcattccggggagcttcatttaatttagtttgtttcagaaccgtatccatacgttgcagtgcataggagatttgttttcccttggtccagatttgatcagaatcttcatggaatacggaatcgcggccccacatgatttgatgttgaacatcagggctcagcattccttgtgccagcatatccgtaatgctgagcataaattcagccagtgtttgctgctccgtccaggacagctctgaatcgctcaatcggagggaattgacaatcatgcttttgacgacaaactcaatatcatacgcatagttttttatggattgtccataagcatcaattaagaaatcaaccatcacgttagacaaataaagttcaacacgatcaatggcttgtgcgattttttcttccttagaaccgattaaagggacggagtataccagcaaatgaactttattcttataaatccggcccagcgcaatcaaatacagttgtctcaacttttcacgggaaggtagctggtgcttcaaataaagttctttaatatctgcatcaagaagcttttcaatcaggacgattgtccccagcagcaactcttctttactttgaaagtatttataaaaggaagccttcaccatcccgctttcgcgggcaatttcatccaccgaggtggcatcgtaccctttttcagaaaacagggaaagggcggcatagataatatcttcactcgttatttttttcattgtacccccaattttttgctctgtctctttaatttccagcgggcaataaccatatacagggacggaaccacaaacatcgtaagaatggtcgagtacatcaatccaaacataatggtatacgccagaggtctaaacataagttccccaataagcgcaatcggaatcagaccgacaatggctgtcagtgaagtaagcaatatggggcggaaacgcgctttggtcgctgcaacaacagcctccttcagttcgatcccttcacgtcttgcatcctcaataaactcaatcagcacaatgccgttacgtacgacaatacctgccaaggtcattaagcccaacacgcccataaaactaaccggcgtatttagaatgaacaagccaagaaatccgcctgctgctgccatatacacggtagtcaatatgatgagtggagtcgagaaagaataaaattgcaaaaagatcagcatgaagattaatagtatgacgacaacatataaccatcctatttctgataaaatgtcatcttgtcctgaaatctcgcccccaatttcccaagtgtagcctggaggaaatttaatatcctgcaatttaagcttgacatccttcatgacttcggaagctgtacgcccgtgaacttcagcttcaacagtaatcgaacgttttaaattataatggttaattttttgtgttgcaaaggatggtttcaactcagccaattgagataaagggatttgaataccattggcattggtcacattcaattgctgaaacaaaatttcaggattttgatcggtttggcttagcttcagcttaatattgatcaaatctttccccgtatcaaatcggctaaagctcacgccattacccattaacaagagtgtacgtgtcagatcattattgcttacctgatattgatccatcgcttgtttgttgatttggaaatctaacgtatatccttcattttccatattatcttgtatgtcctgtgttcctctggtagccataatgccttcttttaactgctgtgacaacgaacgcaactgatctacatcattgcctaaaatccgaatggagatcggcttaccgagaggcacccctactttggctattttcaaggaaatagattgacccggataacgatcctttaagatggagggccatttgtctgccatttcatcgggatcaaatgcaccttcttccccaataatagcaatttgacccacggttgtgcctgttttggcgtcagcggtcatatcttgaaacaaccggggagcgtcgccgccagccgcataactgatcgtctccacatgaggttgctgcttcacccatttggcaatatcctcggtgacccgcttggtttcttctatagaagtacctgtaggcatacgcacattaatgcttaattccggatcgttggttctggggaacaggtcgatcggaatcagagcaagtatgccgtacagcgtggtactgatcaataatcctaatgcagcatataatccaggttgcttaatgactctcggaatcagcttgctggtatatacgttacgaagagcatcaatttgttttcccagcagtcccgacggcttcatggtggagttgggcgttttttgatttcgttgtccataccattctctaaagattgggatgacggtaaaggacataagcatggaagccaataacgtaaagataacagcaaacggtagtggtttgataagggagcctgcatcgcctgataaaaagaacagcggggcaaaggaggctacagttgccagggttgcggtcaaaatggaaatggaaacttctttcgttccatttaatgctgctatcttgggactctcgcccaaggtcatcattctgcgttcaatattatcattaaccaccacagcatcatcgactagaatccccattacaataattaagccaatgaccgtaacctgattcaatgttattccgagcatagggagaataatgagacctatggcgattgaaataggaatagccagtgccacaaaagaggatgtaatcagattcaagcccaatgtacatacgatcacaaccgccgcaatggcaaacagcaattcacgggtcaagccatgaaaaatatgatcaatccgctcggtctgtgaaaataacgtattcagttgaaacgtattaggcagatctggttttaacaactgcatttctatatttactttgctataaatcgtgtctacgtcagagccggtattaccgttaatcgtcagcgtaatagctggtttaccgttaaaaaaggccatatagctgctggtgttatgtgtaagcaatacggtgcccacatcactgagatacacaggagcaccgctgtctgttctggaaataatgactttactcaaatcctgagcatccttggattgctttacattcaagcgataggtacgttcattgtaatccagattgcctatcggatattgctcattttccttctgcactgcactcatgagctgttcccaactgatatggtactgttggagcttttgagcatcaatctgaatctgaacctcttgatccggtaatcccttgattgttacttccgatacaccgggaatggtttttaattgatccttccatgatatcaccatatcatttagttgatacaattgctccacagagtcccccgtgatggcgtaggaatggataaatactttattcaaatcatcgttaacgacaggcttttgagcatctgtgggcagaaaagattgggcatcgttcatttttttgcgtaatgtatcccagacttctgcggcattggcgttgccttctgtctcaatgataatcgtcgaaagtccattttcggatgtagaagaaatctttttaatatgattgatttctttcattttttgttccagaggcttcgtgaccgtttgttctaccttttggggggtagctccagggtagagggtcgtgaccacagcggttttcttgataatatccggcgtttcctgccggggaagttgagagacactatatagcccggcaacaatcgccatgataaaaataaagagggtcagttttttctttttgataaaatatgcaatcatttgctcgttccccccatgatctgaacgagcagcccatcgtagatcaggtttactccggtggtaacgatacgatccccgacattcagccccttggtaatttcaagcttattgttggacatctgaccgacattcacgaccgtcttgaccgctttgttgttcaccactttatagacaaaagtatctgtaccgttattaatgacagctttggctgggagcaaaatttgctcactctgagtcagttggcggcctgcctttatgacttgtcccggagcccaatcatgctgggtgttaggaacaatcacttccacgttgatactgcccgtattggtgttggtggccggataaattttactgaccgttccttctctgttctcatcgtacagttgaagctggactgtctgaccttgcttccagttcgtgatttcatgatcgggaacagggagcagcaccttgagcttatcgatttgtccgatacgatataccggctgtccagcgctcgccaattgtcccaccgttgcttttttctccagaataacgccggaaatgggggcttttaaagctgtcttggagagggaaagttcggcttgctttttggcaatgaccgcttgctgatatgccgcagttgagttatctcgggaggctccagcctgttccttcgcagcgatagcagcttctttcccagcttgggcttgctgtaggctggattctgccgattgccgatcttccaatgttgccccctcctggattaaggagagggcttcttgtgtatcctccaggtccttggtggcattggtcaaagcgagctgcgcattttcataatcgtttttggttgcagctccctgatcatataaaagcttggtgcgttcagcggtagcctgtgctttagtcaaagcggactgtgctctttgcactttggtacggacctgtgccctttcctgctcacgggcacccttgttcactttgttaactccagcttgagctgctgccttttgcgcgtcggcggattgaatggaggcatctgcacttgaaatggcagctgtagcatttttgatacctgcctgtgcttcaagaatagctgtactagcctgctccagttgtagctggtagctggatgaatcaagcatcgtcaagatctgcccctgggatacggagtctcccacattgactactgtgtcgcgaatcagtccggataactcaaaagatacggaggtatcctcatagggctgtagtgtgcctgaaaggtcaaaagaagcagacagcggttcttttttaacaaccatcgcttccaccttttgcttttgttgttctgctgcttcattattactcgatcctgtagatgagcaagctgaggtgaacagaagaatgaatatagcagatatgtagagactgggttttaacaagatgatcatcctttctgtctttttgtactttgaagtttatttataaactaattagttcataagcggattatatgacctgatttgtggcatgtcaacaactgattacaaaaaaatgtcccaaattcaggatgcgaaagggagcagattcaggtccgtggaagtacatggtagacaaacgtaaaaacgacctttctcaaaagaagagaaaggtcgttaagaaaataaatatagctgtttagccgactaatttacggaataagctgcgtacagcccacttgcgctcacttcgtttacggtatttgggcagagagcgatagacggcaatggactggttaaaggctacagtggcttcatccttgcgtcccagcatacggtacatcaggcctgtcagataatagctctcactggaggaaaactgaatttcctgaaattgctgcagataatgaagtgacttatttacgtcgcgttctttgaaagcagcggctaaatgcaaataaggctcaccgtattgcacccgcgggttaatatccagtgctttcagtaaatcctgttctccatcctccagatggtttgtgtgtacttcagccgttccccgtgcgttccaatagtctgctgattcttcataacgggattgaatttccaataacagctccaaagcctgaggatatttcttgctttcgatccagatacgagccaaatcgaacttggcagccacatcgttggcgtttagcgtaatctgttggcgcaatcgagcggcattgcgtcttcttttccatggtttgctgatgctgggcaatacaccgacaaagctgcgatccaatatatagatcacgattaggagtacgagcattgccaaaaacgggttgccgagcaaactccatagtagagagaaaattaaaaatttcccaatcattttgctccaatcctcctgtgcatgtaacaatccatactttccacattatagcatagtgttactttaagggtcattagcatgatgagatttggaaggatggtagaggggcgagaagaaacatacttatttgtgatgctcgatgtatagttttacgagaaaaggaacctttttttattcccgccaaaaggttgaacagtctgccttatccaaaatattaaactcgatcattttctcaagtaatgagaaatcaactggactatcccactggatacgtaccaactgcttggtgtgatcatagccagcctgcacaattaactcagaaaaatgattaatccctgccttttcaggggcaacggccaaatgatgtttggctacgctaaagccaataataaatgtgccgtgatccgtaaacataggctgactccacgcaatttttgccattaaatttggaaacttcttggttacccaagccaaaacctcttgcgttcgagcccgatgttgggggttatcaatatgcgctaaatattctgcaaaagcttccatgttgttccctccttaattaaaaattatatcgttcagaaaagtccctcaaacctatttgtcgttaaaactcctcacagaatggctcagacagattcttaacaacacctatttccaactatatatattttcaaactaaatagtcaaaatggtttaactatcattttatcgcagcaacatgtttcttaaggagtaattgtctgttgaaaaaatataaaaatatatttagatataaaaaaataccttttatggcctgttatattcctcagcaagaatagagtacaaatatgaatcatgaaacttgcctttgtagtaccagtgttcacgcatcaaaccttcacgttgcattccgatctgttgcataaccttctcagaagccttgttttctggacgacatgttgcataaatacggtggacagcaagtgtgctaaatccaaagtctagtaacgctcgtgctgcctctgctacataacccttcccttgataatctggattcaaaacgtaacccatttctgcattagtatctttgacatgaataccaacaccgccgatcagggttccattgtctttcagacaaacggctagttcatagtcttgtcgtggctgttcctgctgtgaagctagaacttgttctatatatgcctttgtatcttcttctgtatttggtccccaggccgtatatctagtaacttcaggcaatgacgtgtaggtatgtatactttcccaatcggatctgccaatatcacgaatgatgagccgatttgtctcaaattgcataacgattcctcctgtctataatcaacagactctacttagtattttaaaacgattaacatctcaatccaatcttttatgcgttcgtagcctttaaacgtgagacctccatttaacaatgaacctagaccttttgccgcctgaacgcaaaccgcaagggaggcgtccggcaaaaggcaatcagaagatattgaatgtggtactggaatcctcctgttattggctatctgattcgtcctaaaacagcctgcacgctgtgacgaaacgtttctgccatttatcatcaaacgtgtcaaaatgaacgccgcgttctttggagaaggtatgcagcaatgtgttgttccctgcatagatcgccacatggccgatctccaggccgcgtgcgctgaagaacagcagatcgcctttgcgcagctcgttcagcccgaccttccggccttttttagcctgatcgtaagagacacgggggaggtcgatagagagcgtatgccggaacacttcctccacaaatgaagaacaatcaaaggtcgatgtctggccgcttgctgctccgaattcataaggagtaccaaggaatttctctccgtaggcgatcagttcatctccttgtcgttccaccagggatgggctggtataatcgctgtatttgggtttagccgatatgtatccggtcaggttgtctttagtgcgcacttccagccagagagcattgacctcgcgaatgacatgaaccttttcgtcggctggaataagccgtagggaagaggaagctatcgatgaatccggtttgctgcgcaggttgaccccgaaaagaaccgttgtgaaaaaatcgtccctggaggcaattcggatggtccgggtcaaggcctcccactttactgtgctcccaagtgcttcgcttacaaaacgcagtggaatcatcgtgttgccctcaacaatccgtcctggaacattcagggacagcgtatcgccgtttaaggtggcagcgagttccccgatgcgataggtcagcaccgtgtcgtttttggttgccgttacggttttgccggatccatcccaggaaagcctggctccttgcgcctcaaacaactggcgcatggggatgagcgttgtcccgtctagcagcagcggctggacggcaagctgaagcgggcggtcatctacataaacgattgtcaccggagtcgtccgtaccgactttgcatacgacgggtttgcctggagcagtgataccgctagcagagctagcaatactttcttgttgattgtcatgctgttatcacctcattgtgaatatgttcatctaagttgtacgagactgcatccgattagttgtgtactaaatattgggttcatttaataaaacaaaacaaacaaacataaaacaaaataatatctgtgttttattattgacatcaaaacaaagtaaagataaaattatatgtgtgaaatatttcactttatagattgattccctatttagcgaggcattaagaagtgaattcttaggaggccgattttttatgagtgcacatgtattttttgtaccatctatcaatcttatgggaacagggtgtttgcatgaagttgggccgtatataaaagaactgaatttaaacaaagctctagtcgttacggataaatttttgatgaagaatggcattgcaggcaaggttacatctttgctggatgatattggattgaactatgcggtatacgatgaagtaaaaccaaatccgacctgtaaaaatgtacatgatggtgttcagtttctgcaagaaaacggatgtgactttttaatttcgattggcggaggatcaccacaggatacggctaagggaatcggcattattgctaccaatgggggacatataaccgagtatgagggcgttcataaatccacgcataaatcgcttcctattgtggctattaataccacagcaggaacatcggctgaaatcacgattaattatgtcattacggacgaagagcgcaaggtcaagatggttatggtggataagaatagtgtagctacgatttcggtcaacgaccctgaactgatggtagataaacccgccgcattaacggcagctacaggactagatgctttgactcacgctattgaagctttggttacgccaggctcctatcctgtaacggatgcgactgcgttggcagcagtagagattatttttaatcatttggctcgtacggtaagcaacggtcatgatatagaagcacgagagcaaatggtatacgctattttcttgggaggacttgcatttaataatgctggattgggttacgttcatgcaatggcgcatcagcttggcggcgtatacgatttgcctcatggtgtttgcaatgccatgctgctgccaattgtggaggaggagaacgccaagcatgtaccagagaaatttcgtgccatcgctaaggtcatcggttttgaagataaggggaaaacggataaggaatgcgcagactatgtaatccaaagaatcaaagacctgtcgaaggaagttgggattccttccaaactttctgaactgggtgtaaatgaagtggatttggaactgcttgccgagaactcaatgaaggatgcttgcgctccgggcaatccgttcatacctagcaaagaacaagttatcgagatgtttaagaaaattctttaaataaaaggtacaattattttactaaatactttaagggctgtcccaggaaatgatcgaagaatactaggaacggccctttttatttgcattttctactaagagatttgtgagactagagataagacaaccccattgaagattaatggcacagctctttcggctaaagctataggagactctttttttccttccgcattccaacgaaaggtaacaccataaatggaccagcttaatatgttcgcggcaagttctaacgttctttggtctgtattattggcttctcttgttatgagttgaagtatgaagtgctctaattgattcttaatatgttcttccaggatcggtgccactgaattatatttatgaacgcattggttacttgagtcgtgatagtcacataacgaaagaataagtttctgaatggtctcctccgacaaacgtgcctcagcatcaatccttttgataacatactccaaaaatgcgtctgacaaaagggtttcaagcagtgcatatttatcttgaaaatgtgcatagaacgtggcacggttaatggtggctttttgggtaatgtcattgatcgtaatcgtgtagaagtctttcttatttaattggtcaacgaatgcgtcgagaattaatctacgtgttcgaatgacgcgcggatcatttgggttgggtgaagttacaccaggcatctcaagacactcctttcaggtaaatcaaatgatttccccattataaacatgtgttgttttatcaacaagtgaatttagatatacaacaatttcataacccttttggttaagcaacagaaagaacattttgtcggttgaatgataaattaaacattgctaacattttacttgcaccccgtttgatgatgcacgagccttctatataatccttttaaaacgataaaagaaaatgaggaggtacaagccttgagtaatcaaccgcaaaatgtccattcaacagaagctttatttcaaccttataccattcataatctgaccttacagtctcgtattgtaatgccggcaatgggccgcgctttttcacccaatggtgtgccaggaccggatgtagccgcttattatcgccgtcgcgcagagaataatgtaggtcttattattactgaaggcgcagtgattgaccatccggctggaacaagtgagccgaggatacctaatttttatggggaagcggctttaaacggttgggctgaagtggtcagacaggttcatgaagctggtagtaaaattttcccacagctttggcatatgggaatggctcgtcctttgggatctcagccgaatccggaagcactatcgattggtccatcggggctggatctggatggtaataaagtgaccgagccgatgacagaagaagaaatcgccaaggtcattggcgcctatgtcgatgcagcggcgaatgcaaaacgactgggctttgacggcgttgaaattcacggagcacacggttatctggttgatcaattcttttgggagagaacgaaccaacgtacggatcgctatggtggcgatatcataaaacgtgtacaattcgccattgagcttgtggaagctattcgtgctgaggttggccctgactaccctattgccatgcgtctatcccaatggaaaatgaatgattacaacgcaaagccgttcgatacaccggataaactggggcagctactgaatgtgttagtacaagcgggcgtggacatcttccattgctcgacacgtcgcttttgggtacctgaatttgaaggctccgatttgagctttgccggatgggtgaagaagctgactggaaaaaccacgattacggttggttctgtaggtctggatgaggattttgtaagttatacggaagggaaaggggcagggcaccaagatattaatgaacttctggaacggctggacaacaatgaatttgacttggtagctgttgggcgtgcgcttctgggagatcctacttgggctacgaaaatacgtgaaggccgaattcatgatcttcaaacctttacacctgaggtacttcaaacgctcaactaaaacatatcatactttgaacaccacttcatttcataaataaacactgtaagccaaaatactcaaagtgaggtaaggaactttggtattttggcttttttatgcgtctgcgatagtagtccatcatgaaccattttagattaagtcatatttgctttaaagttttcttttcttgggtaatttagatttcattataacagacttaatcctagttctttgaaatcattcatatactaaaaccagatcagactgacaccaatacttgatatatatatatgtctatgtaataatgcttgtatgttaaaaaataatgcagctgcactgataggaaccattagagacttgatcaataaattgattgtgtctgagcttgaagcgaatggaattgaagggattgttcctactcatggtggaattctaatgttcctttatcaaaaggatgggctttccattaaggaattgacgcaaaaaatttctcggcagcaacccactgtcactgttttgatcgacaagctagtgaagttgggatatgtcgaaagaaaaaaagaaagggaggatagtcgagttaccctgatatttctgaccgataagggaagagagatagagcctatatttgagatgatctccaacagattacaagaaacgatctatggtggtcttaaagatgaagaaaaagaacagctggaatatttgctggagcatgtcaaaaacagattataaatttttttaagtaaatgtatagatatctatattaatatcaaaataacaataaaacatcgggaggttattaaaatgaaacatcttatcatctatgctcactctaacgcagaaagctttaatcatgcgatactcgaaacggttgtaaataccttgaaagaaaaaggtgacgaagtcgttgtacgcgatctatatgcccttgattttcaacctgtattaaaacctgaggatactgccgctatgagagcagggcaaaccccagctgatatcaaagtcgagcaggaatacatctcacaatcggatacgattacttttatttctcccatctggtggacaggtcttccggctatcctgaaaggttacgttgaccgtgtatttgcatacggctttgcatatacggctggtgcagaagggattaataagctgcttagaggtaaaaaaaggttttatcgtaaatacacatggcactcccaacgcgatctacgatgaaatcggtatgaccgcaggattgaagatcacatcagatacgggaatttttgatttcgttggaattgaatccgtcggtcacttactgcttggaagtattggttaccttgatgaagatggctataaaggactgctgaagcaagtccaagatacggttaaaacggtgctgtaaagtcagtttatgttctcttagaaacgtaagacattctttaaatgatgaggtcaacccgtatttagtggttggccttttcttatagtgcttatatatcttcaacatcccggttcatagatctttgaatttgtaatagcatcttggggcagatataactggaaattcaagggtgtgttgaagcatgactctatgatctttcgacggttttggtgaagagtaaaccgtttcatgttatataaacaactcctttaccgtaaactggcaagaggtgatcaagcgtattttttcttattcgacgctgagctcattaacccttgtattaaaattcacaaatatttcattgttattatcgtgggcaattcattatagtacatagtattaatagttaactgtatgtattatgtgtgttgcggaggttcactatgaaagattatgaactaagggacgaattgagagaatccgttaaccggatttatggcatggaattattcagtagcctgacggagcttgttcagggggaaaaccatgtgcttcaatatttagttcagcatcgagatgatgaaattaatccttccttgctcagcgatcatctgcatgtatccagatcaagaattacggcagcgcttacgggattaaggaaaaaaggctatgtgactatggaaatgtctgagcatgacagacgacgaatgtgtgtaaggctcacagtagatggtgaatccttgatcaaacagaagcaagagagaattgaaggttattttgaagcgcttgtagtaggtttgggtgagaagaatgtgaaggaatttatacggttaattgagctttctttgagtattatgaatgcgcgttctattgaaaaataacataatgtgagggtgtaccgggtgagatataaaataatagcggatagctgctgtgatttaacgagagagcttagagaagagatgcaagttactacgattccgttgaatatgacgctgggagataaatgctttgtagatgatgacacattggacttgcctcagtttatggaagaaatgaaagcctgtacaaccaaaattggatccgcatcaccgtcacctatgctgtataaggaagcctttcaaggtgcgcatacttcttttgccattacattatccagcaacctgtccagttcgtattccagtgcattggtaggaaaagatatggcggaagaagaaggggcggatgttcatgtgtttgattcgaaaagcgcttcggctggacagctcttgttagctctaaaactacgcaagttgattgacgagggatatcataaaagcgaaattatttcttccttggagagctttataagcaagatgaaaacctactttgttttagaaaatctggataatttggttaagaacggacgaatgaataaaatcactggaaagatactttcactcttgcatatcaggcctattttaggctcggatggtgacgggaatatcgcattttttactcaagcacgcggtcagaatcaaattatcgaaaagctggcagatactattgaaaaaagtggccgggctaccgaaggagaaagcatcgtcattactcactgcaataatcctgggctggcggaaaaattaatgaatgcgctgaagaaacgctatcaatttaaagatattcatattgtgtccaccagagggattagttcaatgtacgccaatgacaaagggatcattatggccttttaaaaatattcagggtttatcctcgctgtatggataaaccctttttagtacacggagactttgcgggagttcaagcctatcccaattttctaatgaggacagaagcgtttatgctggcttgagttcctccggcttgtgtttgcagggtaacagcagtagtagagctatggtttcgcaaagtaaggacgtcaccgcatgccagagcgaggatggcttgccctgtgttctgttgtgtcccggctcctgagccgtatacagttccctcagccagtgcgccattaataaagagggcgaattggttaggttccacaccggacaccgaaaagtgaacttcatattttccagcatcggatacagcaatctgtgtagttcctggaacatgagcaattccaggtgtaagtataccgtttgtatccaaaatgacatccccttcaatcggaacaacttggggcttcacattataaatataaccgaactgcgctaaatcacctatggttccagaatccccttcaggccctaaagcgccatgattaatattcacacttacaagttgttttttgacgatgatatcttttccaaaccctttccgtttcgagcggccttttctctttgggggcttctcctcaaactttttttctaacttatcaaaccaggcacggacaaaaacattttttttacggcctttttttcgttttaattcagcatgacccaatacaaacacctccatatggtttgttgtatactactccattcatctagaggaggcatggatatctgtcctgtgatccataggaaacgatctattttgactaaaaacaggctactgtacaaggtacattcgtctagtatgtaaaaaagcacctttgaatgtgcacttggatgataaccaaggaacagacaaaggcgccagtagagacgtgtatcatgatgaagcggtttgaagccgctttttgcgcacatatagggcgtacaagatgcccccaagcagacacaggatgcaggcgaagcctgccagcaaccacgccgatgagactgctccaccacgatccatgctatttccgagccataaaggcagcagagctcctccaactccacctgcacctataagcaggctggtggtggattcttcggtgcctggcatcattttgctggcaaaaacaagtgcgatggagaagatcccggacatgcccagccccagcagtacaataaggataaaggcgccggcagtgcctttgatcagcgggaacacgcatagcagcaaggtcgctgccagcgagctcagggcgacaaagacaccgtagccgtatcgatcggcgatgtagcctgtgaataaccggccggtagccattgctaaccagaagcaggtgacactaagtgctgcttcggcttgtgtgagacccaaacgttcgatgaacatggagggcaggaaattagccaggctcatctctgttcctacatagataaagaaaaagacgataaatagtgcaagtagcttccaattgcctatagggctacctttagaagcctccaccgtgggggatttgggtgagttggtggaacgcgcatggttgtcacctcggtgttcctgttggtctaatacagcgtccagcgtgccgaatgacccacgcagccaagctatgacggtcacggctgcaaacatggaaatgatgggaaaggccaatcgccaccaaccgagagcaatgagctggctggcgatagcgggcatagccaaagcgccgatcccaaaaaagacttccagacggctcatcgccgcgcccgttccttgagtaataccgctgataataatagtgccaataagtgtttctaccatgccgaagccaaacccggctgctgccccgacggcatatagccaaccccaaggcagcagcaatgagtacagcacttcagccgcgcacagcaggagcagggcgaatactagacttcggcgtttgccgaaacgccgggcaagccacggcgacagcaggactccagccagaaaaccggaaaattgagcgaagattaggcttccgccgtccgtatagtttctaccgtaatgctctaacaacacaggcattagggagcctacaaccacgtgtgccaggccgattaaaaaataagacaagctgccgatccatagcagtcgtttcatgatgaactcctttgatacctagatttgaatcatgcaacaaactgaactgcatgattcaaatctgagtgattatgatagctccagtacttgaaagccgtagccttcaatagaaatatctccttccagatatttaccgctgatcagctcattccctttctgatcatccagatgatattgctgcgtctgggcgttatgattcagaacgaatagatacgattttccatctttgatccgtacagtggcttctacacccgcaggagcgcgcagcagggatggaatccctttttgctcacaaatgtagcccagcaggccatcaaggaaagtctcttcaggatctgaagcaacgtaccatgcctcaccttgaccgaaacgattgcgtgtcagcactggcatgccctgatagaaatcatcgccgtattcggctagcacttcagcgccttcgctatgcaacaagtcgcagagcagaccgcatttatattcaccttgtaatacgcccaccttttctttcaatacaatgcgattgtgtgattccggcagaagcgcgtctatttcttccacccagatcccaagcaagttacgcagtttaccaggatatcctccggttgtgaccagatcattttcatttacaatgccactgaaaaaggtcgttacgaaggtgccaccatgctctgtgaattgttccagcttctcggcggtacccggcttgaccatgtagagtacaggcgcgataatgagatcatatttctggaaatctgcatcaacagaaaccaggtctacctgtacattccgccggaagaggggagcataatacttatgcacctgatccacatatttcaaggcgacagaagggccgcttgatttttccaaagcccaccaattatcccaatcgaataaaatggctactttggcattaacggtcgcgtcaagtagcgtgttgcctaatgcgccaagctcactgccaagctgtgccacctcgcgaaatacacgtgtgttctcatgcccggcatgttcaatgacggccccgtggaatttctcacaggcgccgatcgagcggcgaagctggaagaacatgaccgtgtccgcgccatgcgcgactgcctgataactccataaccgcataacgccaggccgtttaagcgaattatacgcctgccagttctgctggctcggtgtttgctccatcagcataaagggtttcccatccttcaagccgcgcatcagatcgtgcgccatcgccgtatagcttatcggagtattggccccgggatagctgtcccaagatacaatatccatgtgcttagcccatttaaaatagtccagttgtttaaaaaagcccatcagattggtcgttatcacggcatcgggaacatgttttttaatcgcgttatactccagcagataacaatcaagcatactgtctgaattaaagcgtgcataatcgagggatatgccctgaaaggtcgagtgattttctccccaatgctcgctcagattatttggtggtacaatttcatcccaatcatagaaggtgtgaccccagaaggaagtattccacacccggtttagttcttccagtgatccgtatttttgcttgagccacacccgaaatgcggccgcacagttatcacaatagcaatcccctccgtactcattggacacgtgccacacgaggatcgcaggatggtttttgtatcgttctgcaagtcgatcagccatctgctccgcatattttcggtaagttgggctattcggacaagagttgtggcggccgccgaatttccgcttacgcccgtcagcatcgactcgtagaatgtcgggataacgcgtagccatccaggctggatgcgctgccgtgcttgtagctaaacaaacgaagatatcgctttcataaagactgtcaatcaattgatccagccattcaaaataatatgtgatttcgtcggattgaattttggcccatgagaatacgttgaccgtggcgatatcaatccctgcctgcctgaacatccgcaaatcttcctgatgcgtggcctcatcccattgctcaggattataatctccaccgtaaaatactttaggaagtttactgcttatcatgccaatcacctctgtatataagaataatcctatcttataatacaaataactgcttttaaatataataaaatgaacgtgtatataacaatatggatctacatgtgaaatacatacccgcatacgccggaggtgctgtttatgattttaactccccatcatttaagatttttcctgactacgcgcgagcattctttacccctttttattgaaagtatcggatttaacagcaggcaggaagatgtgtcccgtccagagggttatccgtgctttcactggattcagacggtgtctggtgaagggatgttttcatttaaaggggggagtttccgtctgggagagcagtccggggttctgctgctgcccggggaatcccatgcatacagacgggcgaccaaggtatggcgaacgttatacattacatttgacggccccatcgccgctgctgtattgactgcactgggattgaagcatacgcgtgggtatcattgggacccggatagcgagctacacagctttggggaaactatgctccattccatggttagtgaacgtgatttgtctggattagatgcttcggccaatatgtatcgttttctgactttactgcgtaaacatggacaacatagctcgatgccttccctatcccataatgtagaacgtttaacccctgtactagcctttatggagcaaaattatgccagtcccgatgtgggcctaggtgatatggcagttatgatgaatgtcagctcccgtcatttaaatacattatttaagcaagcgtttggtgtgacttcttatgcttatctgattgtaattcggctgcggaaggccaaggaaatgatgacggaatatccgcaattaacagtaaaggagatttcggagcgagtaggattccgagatgccagtcattttgtggcaacttttcgccgagctgaaggaattacgcctgaaaggttcaaattactgtatacataagggtattttatcgaaatactctttcttactcgggaatgctcattttagggagcattccttattgtttttttcaggatgagggagtataaaataatagttcatttgtttcatcaatctgatgttcaggtgacataataaaaataaacataagatccatagttcttttgcaaaaccctcatccaaagaaggagtcaacgaaatgctgagtaaagtcaaaagattattaatcggtcgtccacgaaagtcgacggcccttgaagatgagaaactgaataagctcaaggcactggccattctgtcctcagatgccttgtcctctgtagcttacggaacggagcaaattctgctggttttaattacagccggcttcgctgccctatggtattccattcctatatccattgcggtattgggattgctgatcattctgatcctgtcctatagacagaccatattttcctatcctggtggcgggggagcatacattgttgcacaggacaatttggggaaaagtccgagtctgattgcaggcggatctctgctggtcgattatattctgacggtagcagttagctcatcagcaggtacagatgccattacatcggcgttcccatcgttacatgatcatcggatcgccattgctctgattatgattatctttttgactattatgaacttgcgcggggtgacagaatctgcctcggtgctggctgtaccgatttacttatttgttgttgccatttttgttttgattataagcggtatcattcattacgtggcagggggagctcatgctgcagcaccgcaatttggagctacggtatccaacgtcagtctgttcctgttactgaaggcgttcagctcgggttgctcggcgttaactggggtagaagctgtctcgaatgccattccgaacttccgcaagcctgctgccaaaaatgcagcaactacactaatgatgatgggtttgattctcgggtgtatgtttatcggaattagtttgctggcttattggtacggtgttcgtcctaatccgcatgaaacggtcatctcgcaaattgcgaacgccactttcgggcgcggtgtgatgtattacatcattcaaggcgtaacggcgctcatcttgtttttggcggcgaatacagcctattcggcctttccgttgcttgcttttatgctggcgaaggacaaatacatgccgcacatgttcatggtccgtggagatcggctcggatactctaatggtatcctgtttctgagtatcttctcggcattgctggtcatcgtatttggcggtaacacagaaaatctgattccgctttatgcggtaggggtatttattccgtttaccctttcacagcttggtatgatgattcgctggatcaagctcaaaccgccaggctggatcgttaaacttgctattaatacggttgggatgctgaccacgctgtcgattacgcttatctttatcttcaccaagtttagccaggtgtgggtaatctttatcttcctgcctttggttttgtatttctttatgaagatcaataggcattacaaaaatacggctgaacaactgcgcattgatattaccaaggataaacctatggtgaaaggcaatacgattattattccggtggcaggtattacgcgagtcgttatgaatacgatcagctatgccaaaaccttgtcggacaatgtggttgccgtatatgtgggtgtagatgatgaagcgattcgcaaaatggaacagaaatgggaagagtgggatgtcggtatacgtttggtggtactgaaatcccgttatcgcagcattattaatccgcttcgcaagttcatcgatacagtagagtggaaaaaagcagacgaggaccatatcactgttctcattccacaattcatcaccaagcactggtgggaaaatattctacacaatcagaccagcttactgatgagagcttatttgattaattataaagacgtgatcgtaacgaccgttccttttcatttaaacaaataaagtcactgccaattgtagggtacagctgaatatagcatgaccaaaatgaacatcttttggccgcatttctttgcggtcggagggtgttttttgcataacggagatatttactttggtgatacattttgtgtattatagatacgaaatgtatcatttaagactgttatggagggatacgatgcccgaagccacggggaaaatggaagatgacaagctgcaatttgtagatacgctgagggcgctggctattattggagttttacttgtgcatgtcagccagcatgtagacggattaaacggatggttgcaaaaaggcttgagtataggagctaaaggagtcgctttattttatatggccagcgcttttacactatttctgtccttgagcaaacgttcgggtgacaagagggaaagaatttcagcttacctgttgcgtcgtttttttcggattgctcctttgtattacgtgatgttaggaatctatttggttgtgaacgggacaggtccaagattttggcttggagatcaggagggagtcactgccgccaatatcgctgctcatgtcctgtttttgaatggtctgaatccgtactggatcaacagcattattggtgtagaatggtccattgcggtggaatgtatgttttatctgtttatccccctattatttaagctgatccgatcagtccgccatgcgacctggtttgttgtgatggcgcttgtggtaagctttgggctaaatacggtatttgctcaatatccatggattagtaatcactctttatggggtcactatctgtatttatggtttccgaatcaattgcctgtctttgggctaggtatattgttgtttttcatttggaaagacgagcggcattggaaaagtatagaccgagtcagtggaggtatgttacttgtttctgtgctatttgcattttttggaggcatgaccgattatctcataggtttcgggttgctactgggagcgtatgctttgtatcactggcagccaatatggctgcttaatcggttatggtcatggatcggccgccttagctacagcatgtatttgacgcatatgctggctctggaactaatcgtacaggttaaaataccttttgctcccctagtcagcctcacacttatgtttatcatgacgttgctagtcaccatcggactatcttggtttacctactcgtggattgaacagcccggcatccgttgggggaaaaagcttatatcacgtatgaagcctgtgcgcaagcagggagattcggtcaaagaaagtgttgcctaagctacaacttgaagcagcatccgataacatttggttgaagtgcttgaataaatctatgaaataattgaaaagacctcttgaaaagtagctcttagccctttatattcgatgtacatccaagtttttgaatacaccgatgaggttggttggaattgtaaaggagatgcacgcatgcttttgaagccaatcggctttttgcttttctccacgcttgagggagtagctgtttttgcgctgattttgagtatttttaaagttaaaatgaccccttatctttggcaggccatttttgttaacctgattatgaatatgcaaagttatatgctccgagaggagttttccctttcgtatttggtgcctgtcgtaaatatgctactttttatttttttactcgctacggtcgtgaagattccgattgtgtggtccggtattatgacggttacaggttattttgcatatgccgttgttcagtcggtattcttaaaagttatgttcggcaaccttccggtttctgagctgcaggatgggtccttgaagggctatctgctacaagtggtaagcgcggcagtaggtctgcttatttcattgatgttgtatcgaaaagggatcggcttttcccctaatttcaagaagcttaagttcaaagaggaatatggcattgtcatcacactgattatcctgtccctcatttcaacttctattgtgctctactataacgaggtatggttaagtatgatattttttgcactggtttcgggatttttcatctattatgcaatcggaaaggaataccgggatgattgaagcgatggctttcaaacttgctaaccagattaaacgtactgtgcctgatcatccagcctctgtcgcagtacttaaatacgcacttgctctcattctgaatgcgtcaatgatcatcgtgttaacactattcgcctcaatcttcacgggacggatggtagaagctgtatcgattcttgtcgctttcgccctactgcgccaaatatcaggaggcattcatttgaaaacgggcatggcatgtgtgttggtgacctcagcagcttttacttacatatcctgcattgccttaaatagttggtggacaaacctgtttaccggaatagctctcattctcgttttatgttttgccccgtccagaattgaaaagcagtcgcgcattccagtacgtttttatcccctcttgcgactgttatcctccttgcttgtatgtactaattttgtaatcggttcctctgtagtggctgttgcttttttggtccaaagtctaacattgatccgaggaaggaggtgagtggaatgatgaggaaaatggtatatggattagccacatcgttgtctatgtttgcaacatttgctgtatcagtggcgagttatgtgtatgtttatcaaggggatacacccgaggaacttctgaaataaacaaaatgccgaaatagaaaaatgatacatagagctgctattaagcagcttcagagtgtcgagaaagtctagaggacttttcgacacttctatttttatatggggagacgcatcttttaaaacaaaaatcgatttaaaacgatctgaggaccctagtttttagaccactaagacagttttaaaccccctgcaaaaaaacagggggtttctcgacagcttttttatgttcatttt

SEQ ID NO: 16 - DNA, 7773 bp, Unknown
  Kingdom: Bacteria, Phylum: Actinobacteria, Class: Actinobacteria, Order: Streptomycetales, Family: Streptomycetaceae, Genus: Streptomyces
  misc_feature (7568)..(7569): n is a, c, g, or t
aatgcttccccgtgatcggggcgacaccacgagagcggaaccaggagaaggaatgttctcccggttcacagcgtcctcgctgtgttttttcaaaggaacctcgaccatcggaacagtgtccgacggacggggtatcaacatatctggcgttgacttttggcacgctgttgagttctcaaggaacggacgcttcctttgtactcaccctctcgggctttcctccgggcgcttcccttcggtcttgcgtttccgactctatcagatctttccgatccgatttcctcggtgctttccaggttcccgctccgctttcgcttcgcgtttccctttccggcggttccgactctatcagaagttctgagccggtctgaccgggcttcgttttccgattcatcgggtggcttcttcgaaatcgaagacgattccggaagcaagtagatgttcaccgttgcccatctggctgatgtccagctccaggcaactgttcaaatctacctccccacccgcgccgtgtcaacggctccggtggggcgaagaggacactagcagctcagcgggccgaaacgcacatcaggcggccgtcggcaccgtggcgcttcgctcggtcggcgtcacgtcacccgtggctccggcgcgcacggcacggccgccgaggacgtagacgtacgtcaggaaggccagttccaccgcgatgccgatgccgatgcgggcccaggtgggcaggcccgacggggtgacgaagccttcgatggcaccggagacgaacaggaccagggccagtccgatggccatgcccactgctgcccgcccctcctcggccagagcggtgcgccgcgagcgcgggccggggtcgatgagggtccagccgagacgcagacccgtaccggcggccacgaacaccgcggtcagttcgagcagaccgtgcggcaggaccaggccgagaaacgtgtccagtcggccggccgaggacatcagcccgatgccgacccccaggttgagcacgttctcgaagaggatccacaggacgggcagccccaggaagacgcccaggaccaggcacatggcggcggcctgcgcgttgttcgtccacacctgggccgcgaaagccgtcgccggatggtccgagtagtaggtctcgtactcgccgccggggcgggtgagctgccgtagctcactgggagccgcgatggtcgcctgtactgccgggtgtgtgccgatccaccagcccaggagggcggcgacggcggtggagagaagtgccgtgggcacccaccagcgacgcgtccggtagaccgccgccgggaaaccctccagcaggaagcggacgacgtcgcgccatgaggcccgacgggttccggtcaccgccccgcgcgcgcgggcgaccagttggctgaggtggccggtcagcagtggatcgggggcgctcgaccggatcagggacaggtgagtggccgcacgctggtagaggacgatcagttcgtcggcctccgtgccggtgaggcggcgtcggcggcccagcagggcttcgaggcggtcccactcggctcggtgggcggagacgaagacgtccaggtccatcgtgtctgcctgctcctcggctggttgctcgactgtccgtcggatgtgtcagcttgtcctactgcgacgcggcggccctcagcttggcagactgacggtcttcggggcaggccaggaaagggcggcggggcgtgagtgagctggtgacgggtgaggcggtggcgctggagctgcgtccggcgaggcttcccagcagggcgctggccgtactgctcgacctcgtcgtggccctggccgtctatgtcgcggtgagcgtagggctgctggccgccacggcctcgctggacgaggcggtcggcgtcgccgtgtcgatcgcggccttcctgctcgtgctggtgggcgggccgatcgcggtcgagacgctcagtcacggacgctccctcgggaagctggcatgcggactgcgcgtcgtccgggacgacggtgggccgatccgcttccggcacgcgctggtgcgcggagcgatcggcgtggtggagatcctgatgacgttcggcgtcgtcgcctgcatcgcttcgctggtgtcggcgcgggggcggcggctgggcgacgtgttcgcgggaacgctcgtcgtgcgggaacggattccggccggaccggctgcttccgtgccaccgccacctccgtggctggccggacggttctcggcactcgacctgtcggcggtgcccgacgggctgtggctggcggtgcgccagtacctgacgcggatgcagcagctggacgcgcaggtcggctggggcatcgcgcagcgccttgccgccgacctcgcggaccgtactggtgttcccgcaccgaccgaggttccgccggcgatgtatctggcggcggtgttgcaggagcggcaggtccgagaggctcagcgggcgttcggcggctcttccggtggtcctgccgggaccccggccgccgggagcggcccggacgtccgtgcggtcccgtctgccgacgtgccttcggcgggcttcccggcagccgcctcaccctcggccggcttccctccgtcgcaggtgccgcaggtgccgcaagtgccgctggcaccgccgtcgccttcggtcccgcctcggaagccgggcgcgggggagccaccggccaccgggttcgtgcctcccgcttagccggtcagggttcgaagacggtcggcggtgactggaggtcctccagctcgatgccgggggcggccaggacgacatcgcccgcgaggtgcacggtgtcccgttctcctgtgtccagggctgtgacctggtattcgtccacggtcagggggccgttgtcagtggcgtgtgcttgtctttccaccagggcccaggactggtccacggtgcggggggcgaggaccggatccgtgaaggtgacgaggcgtacgcgggtggcggaggccgagggggtgaggcgcaggagacgggcggtggcgacgaggaacgcgggggacgtgccggtgaaggcgtgggcgcgcacattgccttcggtggcatgggttccggtggggtcggtgcggacccaggtgacgccgtcgagggcggcgccgcgcacctgccagccgcccgcatggagttcgaggcggatagggcggccgagtgcgtcgagtgcgaggtcgaccgagccgcggtgatcgcccgagggggtggtgacctgggagacgtagcgccagcccgaggggcccggcgcgcactggaagtgttcttccgcgaagggggtgtgatcgtgcggatcgtaaagcgaataacggccgcggggcatggggttcctggggcttgacgggccggcccggtaacggggcaggcccccggcacgggggtgcgggggcctgcctcggaggaccggggaaccggtggaccggtggaccggacgagtctcgggtgcggctcgcgggtcggtccgtggggtcggtcggtagtcggtcagtagcggtagtggtccgccttgtacgggccctcgacctcgacaccgatgtacgcggcctgctccggacggagcgtcgtgagcttcacgccgagcgcgtccaggtggaggcgggcgaccttctcgtcgaggtgcttgggcagcacgtagacgccggtcgggtactcgtcgggcttggtgaacagctcgatctgggccagcgtctggtccgcgaacgagttggacatcacgaacgacgggtgaccggtggcgttgcccaggttgagcagacggccctcggacagcacgatgatcaccttgccgtccgggaacgtccacgtgtggacctgcggcttgacctcgtccttcgcgatgccgggaatcttcgccaggccggccatgtcgatctcgttgtcgaagtggccgatgttgccgacgatcgcctggtgcttcatcctcgccatgtccgaggcgaggatgatgtccttgttgccggtcgtggtgacgaagatgtcggcgctctccacgacctcgtccagcgtggtcacctggtagccgtccatcgccgcctgcagcgcgcagatcgggtcgatctccgtgacgatcacccgggcgccctgaccacgcagcgactccgcacagcccttgcccacatcgccgtaaccgcacacgacagcggtcttgccgccgatcaggacgtccgtggcacggttgatgccgtccaccagcgagtgccggcagccgtacttgttgtcgaacttcgacttcgtcaccgcgtcgttgacattgatcgccgggaacagaagggtgccgtcgcgctgcatctcgtacagccggtgcacaccggtcgtggtctcctccgtcacaccgcggatctccgaggacagctgggtccacttctgggggttctcgcccagggtgcgggtcagcagctggaggatgacgcggtgctcgtcggactcggcggtgtcgaccgaggggaccttgccgtccttctcgtactcgacgcccttgtggaccaggagggtggcgtcgccgccgtcgtccaggatcatgttcgggccgccggtggcggcgtcgggccaggtcagcgcctgctccgtgcaccaccagtactcctcgagggtctcgcccttccaggcgaagaccgggatgccctgggggttctccggggtgccgtggggaccgaccgcgatggccgcggcggcgtggtcctgggtggagaagatgttgcaggacgcccagcggacgcgggcgcccagggccacgagggtctcgatgaggacggcggtctgcacggtcatgtgcagggagccggtgatgcgggcgcccgccagcggctgggcgtcggcgtactccttgcggatcgccatcaggccgggcatctcgtgctcggcgagggtgatctccttgcggccgaactcggccagggacaggtcggcgaccttgaagtcctgtcggctgtcgacagtcgtcattacgggctgctcctcgggatcgggtcgaggtgggtacggctgacctgcgcggcggcggacacaggagtgcccgaagaggacacaggcatgcccgcgtgcgcgcagcgcagtccgtcggaggccctctctccctcggccgacccgtcctcgggccgcccgaccgccatcagcagcgacgtctggctccgtcccaagctacaccgcgggcccgggctgccccagtccgcatccgcaaggatcgggccgttcgcggggtcagtgccctgcgccggggtgcgggttcggtccgcccggggtggcctccgggtccgcgcccttggcagcctcggcctcgctgtagatgtcgggttcgaggtagatgacgcgggcgatggggacggcggtgcggatacgggcctcggcggcgtcgatggcggtggcgacctcggtggcggtgtcgtcgtgccgtacggcgatcttggcggcgacgaggagttcctcggggccgaggtggagggtgcgcatgtggatgatgccggtgacggtgtcgccgtcgacggtggcggccttgatcttctcgacgacgtcggcaccggcggcctcgccgagcagcagggacttggtctcggcggccagcacgagggcgatcaggacgagcagcacaccgatgcagaccgtgccgatgccgtcccagacgccgttgccggtgagcagggcgagtccgacgccggcgagggcgaggacgaggccgatcagggcgccgaagtcctccaggaggacgacgggcagctcgggcgccttggcgcggcggatgaactgcgcccaggagagcttgccgcgcagctcgttcgactccttgatggccgtgcggaaggagaagccctcggcgcagatggcgaaggcgaggacggccaccggccagtaccagttcttcagttcgtgcgggtggctgatcttctcgtagccctcgtagatggcgaacatgccaccgatggagaacagcacgatggagaccaggaaggcgtagatgtagcgctcgcggccgtagccgaaggggtgctgttcggtcgcctcgcgctgggccttcttgccgccgatcagcagcaggaactggttgcccgagtcggcgaccgagtgcacgccctcggcgagcatcgacgaggaaccgctgaaggcgaaggccacgaacttcgataccgcgatcgcgaggttggcgccgagtgccgccacgatcgccctggtgccgcctgacgcgctcatgtgttcgcgttgtcccttcgccttcgtacgtggccgtgccgcacgcatccgtgccggccgcgggcctttgcccgccctttgccggtgggtcattgttgcagccccgtccggcaggggtgagggcggtcaggtggcgcggctcgcacgacggccgcggctcacacgacgaccgtggcccggaagaccgtaccggcgccggagacctcggccttctcgcccgccgggacgaacacggaccggccgggggtgagttcgtgctcgcccgcccggacggaaccggccgtgcagagcaggatctgcggggtgcgcagggtgaggtcgtgggccggtgcgccctccgggaggacgtagcgggacagccggaactcgtcgatgggggtctcgtagacctcctcgccgtccggggcggcctcggggcgcagtacgccggcgtcgcccgcctcgaagcggacgatgcgcaggagttcggggacgtcgacgtgcttgggggtcagaccgcagcgcaggacgttgtcggagttggccatgatctccacgcccaggccgctgaggtaggcgtgcgggatgccggcgccgaggaagagtgcctctccgggctggaggcggacgtggttgaggagcatcgcggccaggacgccggggtcgcccgggtagtggtgggcgatgcccgcgtacggggcgtggtcgccgccgaggcgggcgcaggcggtggcggcctcggtgaccgtgtgggccatctcctcgcggtcggcggtgaggatcgcggtgagcacctcgcgcagggccgcctcttcggggtgggcgcgcagcaggtcgacgtagggcttgagggagtccacgtcgagggcggcgagcaggcgggctgcctcctcgggtgcgcggaaaccgcacaggccgtcgaactcggtgagcgcgcagatcagttccggcttgtggttggcgtccttgtagttgcgctgcggggcgtcgacggggacgccgcggcgctcctcttcggcgtaaccctccttggcctggcggaggtcggggtggacctggagggacagcggggctccggcggcgaggatcttgagcaggaacggcaggcgggggccgaacttcgcgacggcctcggcgcccagttcccgctccgggtcggtgccgatgacctcgacgagggtgccgcgcgcggtgcgcgagggtgcgcccgggtgggcgcccatccacatctccgcctgcggttcgccgctcggctcgacgccgaggaggtgcgggatggcggtggtggaaccccaggcgtaggggcggatggtgttgtcgaggcggtccatgcgcttctctctgcagttctggtcagggcaccgcacctcgtcgtacggctctggtcagggcaccgcacctcgtcgtacggcnngcggtgaagtccgtgacggcgatgagttcggcgaggctctcgatctcgccgccgggctcgggttccagttcgctgatcggcgtgtcgtggctgagggccaggtcacgggcggctggggcggcggtgaggccgccgagcgggcggtcgcgcagcagcaccacgcgcgcgtgcagggcgggtggctcgtcgacgcggtcgcggaag

SEQ ID NO: 17 - DNA, 6835 bp, Unknown
  Kingdom: Bacteria, Phylum: Firmicutes, Class: Bacilli, Order: Bacillales, Family: Paenibacillaceae, Genus: Paenibacillus
ctgggtctgttccgttgcaccgatggagaccatttgttgatagcgattcaccattttgtggtcgatggcgtgtcttggcgtattttgctggaggatttggcatccggctatgagcaggctttacggggcgagtctgtccgtttgcctaataagacggattccttccgtctttgggctgatcagctgtcgacatatgcgaacagttcggctttggagaaggagcgtgcgtactggcaacagctggagcaagcggcagctacacaagcagctttgcctaaagattacacccgtaaatctcaggccaagccacagcttcgcgatgatcggacactgaccgtggtatggacggtcgaagaaacagaacaatttttgaagcaggcacaccgggcctacaatacggaagcgaacgacctattgctgacagctctgggcaccgcaattcaggagtgggcaggcatccgtcaggtgcttgtaaatctggagggtcacggacgggaagccattttgccggatgtggatattacgcgtacggtcggttggtttaccagccaattcccggttgtgctcgatatgggcgagaaacagaatgtgggacggcgtgtcaagagcgtcaaggaagggctacgtcgtttgccgcataaaggaattggatacgggattttgagatatctttctgcgcctagggaaggggaagccgcttttgtcgccgagccggaaatcagctttaactatctcggacaattcgatcaggatttaaagaaaaatgcctttcgcatgtctccttattccatcggagcttccattagtgacacgttaactaagcggtatgctctggatatcaacggcatgatcacggacggtgcactggaactgacgatcagctacagcaggaaaacattcatgaaaaaatcaattcaaagactggctggtctgcttcaggagagcttgcgtgaggtattggctcactgtgtggaaaaagagttgccagagctgacgccaagcgacttgtccttccaaggactgacggctggagagctggatcatattgtagagcagacggctgctgcgggagaactagaaaatatttattcgctcacacccatgcaaaaaggcatcctgttccacggcctaatggagccaaaatccggggcgtactttgagcaggcgacatttgatctgcaaggtagctttcaagtggaggcttttgctgaaagcttaaatcaactggtggatcgccatcaaatattcagaacgaatttttatagcggatggaatgagcagcctttacaggtggtgtaccgtcacaaacatgccgggttccgttttgaagatgtgcgctcaatgggacaaggagagcaggacgcatacattgctggttttgctgagcatgacaaagccgaaggctttaatttcagctcaggcgagctgatgcgggtgtctgttttgcgtacaggcgaggaatcgtaccgttttgtgtggagcttccaccatattttgatggacggctggtgcttgttcctaattgtaggagaggcatttaatacgtactttgccatcctcgaagaccgcaagccggagcttgtcccagtaacgccatacagtgaatatattgaatggctggatcggcaggacaacatggaggctgagcggttctggagtgactactttgcgggttttgagcagcagacggtattgccgcaggcaaaacagctggacggtcacgctaaagaatatgaagcggacaagctttcgtttacactggaccgcgaagtgacggaacggatgaacaagctggttaagcagaagcaagtgacggtcaatacactgctgcaagcagcgtggggcgttgtgctgcaacggtataacaacagtcgggatgttgtatttggcagtgttgtatccggcagatcagcggatattccgggcatcgataaaatgattggtttgttcattaacacggttcctgtacggattcacagtgagaaagatatgacgtttgctgcgttaatgaagcagatacaggagcaggcactggcttcccgtacctttgaaacctatccgttatatgaaattcaggccctgacagagcaaaaacaggacctggtgaaccatattatggtgtttgaaaactacccagtggaacagcgcatggagaacatgggcagccgtgacacgaacggttttacgattgccaatgcttcaatgtcagagcaaacgaactatgatttcaacattacggttgtgccgggggatgaaattcatgtccatttggagtacaacgcgcgagtattggaacgtacagctgtagagcaaatccgtgagcatttgctgcatatgattgaagaagcgattaacagaccagatgcgctggtagatgagctggagctagtgactgtttcggaaaaagcgaaaatcatcgacggttttggatcagtaggcgtatctgcatggagtgatgaaaagcaatcagaagggttgttccacgcctatgtggaagaacaagcgcagcttgtgccggatcacgtggcagttgtatacgaggagcggcagcttacataccgtgagctgaacgagcgtgggaaccaacttgctcgtagattgcggaatgaaggcattgggcgcgaatccattgttggtattttgagcgagcgctcggtggacatgctggtcggcgtattggcagtatggaaagccggcggggcatatgtaccgttagatgcggattatccgtccgaacgtatccgctttatgctggaggacagcggtgcgacagtgctactgacgcaaacaggtttgcaggagcgtgcccaagcatggctggaggaaagccgatgggctttggccgaaggaaaggctgagggcgagctggaaacggcggttagcattgaaacgatggaaagagacagccttaatgagggattaagcttgaaatcagattcgtcatctgatagcgaagcagcatccgaatccgcagcaaacttgcgtctgcacaccgtactggcgctggacgatgagtcgctgtacaccggggatgccacggatgtggaacctatcaatgagccgcaggatctggcgtatatgatctatacgtccggtacaacgggacgcccgaaaggggtcatgatcgagcatcacagtttggtaaacacagccgcggcctaccgccgggattaccgtctgaaccagttcccggtacgattgctgcaactggcaagtttctccttcgacgtgttcgtcggcgatattgcgcgggcgctctataacggcggcacgatggtcatctgcccgaaagacgaccggattgacccaagccgtctgtacggctggattcacgactatcagattacggtgttcgaatccacaccggctttaattgtaccgttcatgcagcatgtacatgaacagggactggacatgagcagtctggaactgctgatcaccagctcggacagctgcagcgtgacggattatcgggtgctgcaggaacggtttggcgcagatatccgcattatgaacagctacggcgtcacggaagcggcgattgattccagcttctacgacgaagagctgtcgaagctgccaagtagcggcaatgtaccgattggtcaggcgtggctgaacgcccggttttacatcttggacagccagctgaatccggtgccgatcggcgtactgggcgagctgtgtattggcggagccggggtagcacgtgggtacttgaaccgtgcggacctgacggcggaaaaattcgtagcgaacccatacgtaccgggtgaacgactgtatcgcacaggcgatttggcgcggtggatgccagacggcaatgtggactttatcggccggatggactatcaggtcaaaatccgcggataccggattgagctgggcgagattgaaacggcgatccagcgggtgcccggtgtgcgtcaagccgtagtcatcgaccggacggacgagcgtgggcacaagtatttgtgcggatacatcacgggagaaaccgagctgcagatcgaggaagtacaagcagcactggaagcagcactgccagcacatatggtacctgcacgcttgatgcgtctggagaccttaccattgaccagcaacggcaaaatcgaccgcaaggccttaccggaaccggaaggaagcattcataccggtgcagcttatgtggcaccgcgaactacggtggaacaagtattagcttcggtgtgggctggggtgctgggcgcagaagccgtaggtacgcaggataacttctttgaactgggcggcgattcgatcaaagcgctgcaagtatcctcccgattgctgcaagcagggtatcgactggacatgaaagacctcttcagcaatccgacggtagcgtcactcagtcctttacttcgtacagatggcaagatggccagtcaggaagaggccgtaggtaaggtagatctgacacccattcagcggtggttcttcgagcagcagccggttgatctgcaccacagcaaccaggcgatgatgctgtatcgagctggtcgctttgacgtcgacgcgctgcgccgtacgatggaacgtattgtccagcatcatgacgcattgcgcacggtattccgtgagacggagcaggattatgtcgcttggaaccgcagtgtggaggaaggcgagctatacacgctggacattgtagattttagaggaattgaggacgaatctgccgctgtagaagccaaggcgagtgaaattcaagccggcattcatttgagcgagggtccgcttgtgaagctcggtctgttccattgcgctgagggcgatcatttgctaatcgtgattcatcatttggttgtggacggtgtttcgtggcgtattttgctggaggatttggcatccggttatgagcaggctgttgcaggtaaaataggcacagctattcgactgccgcataaaacagattcattccaggtatgggctaaacagctgtcagcctatgcgaatcgtgcgacgatgggacgggagctagcctactggcagcatatcgaacaagcagaagccagccttgtgaagtctttgccgaaggatttcacgaatgacaatgcacggctcggagacagtgaggttgtgactgtccgctggacgaagcaggaaaccgagcagttgctcaaacaagctcatcgcgcatacagcacggaaatgaatgacctgttgctggctgcgctcggaaaagctgtctatgactggtctggttccgaacgggtgttggtcaacctggagggccatggacgggaagctattgtaccggatgtggatattacgcggacggtcggttggtttacgagccaattcccggttgtactggatggaagtctggcacaagggggaaataccgctcgtctgatcaaacgggtcaaggaagacctgcgtcatatcccgcaaaaaggtattggctacggtattttgcgatacctgtcagatatgaatgttttggagaaagcaggcgtgcagttaaagactcagcctgagatcagttttaactatttgggccaattcgatcaggattataaaggcaacgatctggagccttcctcctattccattggtgcacctgtcagcacgaacgcggctatggattttgcactagatatcaatggattaatcgaggatggcgagttgattttcactattcgctacggcacaacgcagttccgtcatgacacgatttcacggctgggagagctgctagcatccggcttgcgtgaagtcattcatcattgtgtagcccaagagagaacggtgttgaccccaagtgatgtcttgttaaaacatgtaacgctggacgagctggagcaattggtgaaagatacacaagatatgggtgaactagaaaatgtgtatgctttgacgccgatgcaaaaaggtatgctcttcttcagtctaatggatgagagttcggcagcttattttgagcaggccacctttgaattgaatggacggtttgatgtggttactttcagcaaaagctttgatctgctcgtacagcgtcatgaggcattgcggacgaactttatcaactcctggaaggatgagcctgtacaggtcgtcttccgtaatcgtagcgggcaattatattatgaagacttgcgcggactagaaaaagaggaacgagaagctcgtgttgaagcttttgtcatcgaggataaagcgaaaggattcaatctcacagaggatgcactcattcgtatttcgatcctgcaaaccggggatgaaacgtaccactttgtttggagcttccatcatattttgatggatggctggtgcctttcctttatgacacaggaggtattcggcagctatctggcactgcgtgcgggtcataagcccgtactggagcctgttacgccgttcagtcgatttattgaatggctggaacgtcaggaccgtgaggcagccctgcaatactggcgtgggtatctggcggactacgagcagcaaattacgctcccgcagcaaaaaatacagcctaaatcgatgcacaccggggaatatgttgctgaagatctggattgcgaattccagccggagctggttgcccagatcgaacaagtggcgaagcaaaatcaggtgacgatcaatacgctgattcagacggtatggggcgtcttgttgcaaaaatataataacagttcggatgttgtgttcggcagcgttgtgtccggtcgcccaggggatattccaggtgtggagcacatgattgggctattcattaacacgattccagtgcgcgtgcagtctgaacaaggtgaaacctttgtcgagctgatgaaacgaacacaacggcaggcgctggcttccaatg

SEQ ID NO: 18 - DNA, 1627 bp, Unknown
  Kingdom: Bacteria, Phylum: Actinobacteria, Class: Actinobacteria, Order: Streptomycetales, Family: Streptomycetaceae, Genus: Streptomyces
tcctggagctgggcagcaatctgctccgctgccgggccggggtgtcggccgccgagcaggtctccgaggtggaggtgcgcggctgggacgtccgggcgaagcagccgctggtgggccgggccccggcgggctcgtccccgacgctggagctgggggtgacggcggcggaggtgtcggccccgttcggcgaggcccggttcgtggtgaccgacgcggcgtacggggcacaggcccaggtcgaccaggcggcgaaggcgctggcggaacggatcgccgggtcgttcgccgagctggaggcggtgatccgggggaatccggaggtgcgggcgggcacggcggtggcgctgaacgcggtgggcgcgccgttcgagggccggtacacggtgacgacctcgcgccatgtcttcgacgccgtacgcgggtacgagacctggatcaccgtgtcggggcagcaggagcggtcgctcttcgggctgacgggcggctccccggccgcgggtggtccgcggtgcgcgggactggtcagcgggacggtgacggacacgcaggatccggagggatcggggcgggtcaaggtgcggttcccgtggctctccgacgagtacgcgagcgactgggcgcgcacggcgcagtccggcggtacggggggcggcgaggcgttcatcccggaggtgggcgacgaggtgctggtcggcttcgagcacgggcatctggaccggccgtacgtcctggcgggtctgtacaacgggcaggaccggccggggggtggaggcgggggaccgtctgccggtgcgcccggtgcgcccggtgcatcaagtgcttccggcacccctggtgctcccggtgcttctggaggtacaggaggcgcgggaggcgctggaggtacaggcgcggaaggcggggatgaactcgtcgatcccaccaccggtgcggtgaaccgccgcgccttcgcgtcgaagagcggaaaccggctggagctgctggacgcggcgaacggcccgcagggcgtccggctccgtaccggcgacggcaagctcacgatcgacctcgaccacaagggcaccgccatcgtcatcggcagcgacggcagcgtgaccatcgaggccaaggagaaggtctccatccggtcggccgacggcgccaccctggacgcggggcgcggcgcgctcgaactgaccggcgagagcgtgacgttgaccgcgcggaaaggcgtgtccgtggatggcggcaccgggaaggtcggcatcgcggcgcagggctcggtggaggtgcggggtggtgaggtcacggtcgacggaagccgccgcacggagatcaggagcgggggatcggtcaacgtcaacgcacccatggtcaagctcaactgacgtcacgtcatccagcacgtgcggagggagtgcacagcatgtccgacgcaacagccgctccggcagcccgggtcggcgaccccaccggccaccccggcacggtcgggccgcccggcgtcctgtccgtgctcatcggcggcaagcccgccgccaccgtcgggaccgcccacctgtgctcctcgcccgccgcccatcccccgaccgtcctcgcgccgcccggcagctcgacgcgggtcatcggcgggcgaggagcacaggtg

SEQ ID NO: 19 - DNA, 2574 bp, Unknown
  Kingdom: Bacteria, Phylum: Firmicutes, Class: Bacilli, Order: Bacillales, Family: Paenibacillaceae, Genus: Paenibacillus
ctacggattcaatacaaagactatgccgtatggcagcaaagtgaagcgcaaaaggattggatgaaacgtcaggaagcatattggctcgacaccttccggggcggagtgcctgtgctggatctggcaaccgactttgcccgtccggcagtgcaaagtgcggcaggggatacgatcgaatttggactggagcgtgaagttagcgaacgcctgaaagaactggcttcgcaaacaggttcaaccttgtatatggtgctgctggcggcgtacactacgctcttgcataaatacacaggccaagaagatatcgtagttggaacgccgtttgctggaagaccgcatgcggaactggagagcctggtaggtgtcttcatcaacacgctggcgatccgcaattatccgtctggcgacaaatcgttcctggattatctgcaagaggtgaaggagcatgcgctcagtgcttatgagcatcaggactatccttttgaagagctggttgaaaagctgaatttaacacgggatacgagccggaatgcgctgtttgacacgatgtttgagttgaaaacattggagcagcaggagttcgagttggaaggtctgaccttgaattcgtacccgttaggaaatactacggccaaattggatctgtccttggagaccatggagcagccggaggggattgtgtgcagtctggaatacagcacggcgctctataagccggagactatcgcccgaatggcgcagcattttacggagatcgtccgagctattgcgtatcatccgcagcagtcactggcaactttgaatatggtaaccgtcgaggaaaaagaacaactcatctacggttttggagaagtgggagtaagagatgttgctgcagttgaagcaggagccctgttccataccttcgtagaagaacaggctcagcttgtaccggatcatatggcggtggtgtatgaggagcagcagttgacgtaccgcatactgaacgagcgtgcgaaccaattggctcggagattgcggaatgaaggcgttggacgcgagtcaattgtcggcattttgagtgaacgctccatggatatgctggtcggcgtattggcggtgtggaaggctggcggcgcatatgtgccactggatgcggattatccgtccgaacgcattcgtttcatgctggagaatagtggtgcgacggtactgttaacacaaacgggattgcaggagcaagcacaggcatggctggaggaaagcaagcagtccttgaccaggggtaagactgagggtgagttggaaacagcgactggcgccgaaacgatggaatcaggtgctcttcatggaactgtgaatggagcagcagattcgccaactgacagcgaagcagcatcccaatccgtagcaaacttacgtttgcacaccgtactagcattggacgacgaatcactgtacaccggggatgccacgaatatcgagccgatcaatgagccgcaggatctggcgtatgtaatctatacgtccggtacgacgggacgtccgaagggcgtcatgatcgaacatcgcagcttggtgaatacagctgcggcgtatcgtcgggattatcgcctgaaccaattcccagtccgactcctgcaactggcaagcttctccttcgacgtattcgtcggggatatcgcgcggacgctttataacggcggcacgatggtcatttgtccgaaagacgaccggattgatttcagccgtctgtatggctggattcgcgattgccagattacggtgttcgaatccacaccggccctgatcgtaccgtttatgcagcatgtgcatgaacaggagctgaacatgagcagtctggagctgctgatcacgagctcggatagttgcagcgtgacggactaccgagtgctgcaagaacggtttggtgcagatatccgcatcattaatagttatggcgtaacagaagcggcgattgactccagcttctacgacgaagaattgttgaagctgccaagcagcggccatgtgccgattgggcaggcgtggctgaacgcacgcttctacattgtggacagccagctgaatccggtgccgatcggtgtactgggcgagctgtgcattggcggagccggggtggcacggggatatctgaatcgtgcagacctgacggccgagaaattcgtagcgaacccgtacgtgccgggtgaacgactgtaccgcaccggcgatttggcgcggtggatgccggacggccatgtggactttatcggccggatggatgatcaggttaaaatccggggcttccggattgaactcggcgaggtagaagcgcagctgctgactgtggatggcattcagaaagcgatagtcaccgcctgggaaaacgaaaacggagacaaggatttgtgtgcatatgtcgtagcttccgaggcgctgaatttgccggagctgcgcagcatactccagccaaaactgccgggctatatgatcccgacatatgtcgtacaactggatcgtttcccgctgacaccgaatggcaaaatcgaccgcaaagcattgccagcattggaagataatctgcaaagcaga

SEQ ID NO: 20 - DNA, 20007 bp, Unknown
  Kingdom: Bacteria, Phylum: Firmicutes, Class: Bacilli, Order: Bacillales, Family: Paenibacillaceae, Genus: Paenibacillus
acgattgaacggctgggagaactactggtatccggtttgcgtgaggtgattagccattgcgttgcgcaggaaagaacggtgttgaccccaagtgatgtcttgttaaaacatgtaacgctggacgagctggagcaattggtgaaagatacacaagatatgggtgaactagaaaatgtgtatgctttgacgccgatgcaaaagggtatgctcttcttcagtctaatggatgagagttcggcagcttattttgagcaggccacctttgaatggaatggacggtttgatgtggttgctttcagcaaaagctttgatctgctcgtacaacgtcatgaggcgttacggacgaactttatcagttcatggaaggatgagcctgtacaggtcgttttccgcaatcgcagcggagagttgtactatgaagacctgcgcggactggaaaaagaagaacgagcagcgcgtgttgaggcttttacccttgccgataaagcgaaaggattcaatctcgcagaggatgcactcattcgtatttcgatcctgcaaaccggggatgaaacatatcactttatctggagcttccatcatattttgatggatggctggtgcttgtcctttatgacacaggaggtattcggcagctatctggcactgcgcgcgggtcataagcccgtactggagcctgttacgccgttcagtcgatttattgaatggctggaacgtcaggaccgtgaggcggccctgcagtactggagcagatatctggaagattatgagcagcaaattacgctcccgcagcaaaaaatacagcctaaatcgatgcacaccggggaatatgttgctgaagatctggattgcgaattccagccagagctggttgcccagatcgaacaagtggcgaagcaaaatcaggtgacgattaatacgctgattcagacggtatggggcgtcttgttgcaaaaatataataatagttcggatgttgtgttcggcagcgttgtgtccggtcgcccaggggatattccaggtgtggagcacatgattgggctattcattaacacgattccagtgcgcgtgcagtctgaacaaggtgaaacctttgtcgagctgatgaaacgaacacagcggcaggcgctggcttccaatggttatgatgcgttcccgctgtatgaaattcaagcactgaccgagcagaagcaggatttaatcaatcatattatgatatttgaaaattatccggtggagcagcaggtagagcagttgggcagtgatgggcaggataaatttacgatttcgaacgtggtgtctacagaggaaaccaactatgatctgaacgtcgtcgttatgccaggtgaaggcatcaagattcgttttatgtataacacgctcagctttgatcaagcaggtattgagcgtctgtatgggcattttgcacgcctgctggagcaaatttcgctcaatccgcatgttcgtgttgaagaactggaactactcacagcggcggaaaagcagcagattacagcggcatttaatgataccgcttgtgcattcccatgcaaacagacgatccatcagctgttcgaggagcaggtagaatatacgccagatcaggtggcattggtgtttggacatcagagtctgacttatcgggaactgaatgaacgggcgaattcattggcccgaatgcttcaagcacaaggagtaggacctgacaaactggtcggactgatggtacagcgttcagtggaaatgatcgtaggccttctagccgttctcaaagcaggtggtgcttatgtgccgattgatcccgaatttccgtcctctcgtattgcatacatgctggaagatagcgaggccacagtgcttctgaccagtcgtgatctggcagaagagcaccattgccaagccaataccctgtttcttgaggatgcagcattgtatcagggagagagcggcaacctggagacgattgcccggccagagcatttggcttatgtcatctatacgtctggttcgactggaaatccgaaaggagttatgctccagcatcgctcggtcctcaactttattaccgggatgcgcgaagtcattgactttgaagcgagccaaaccattttgtcactgacgaccatttcattcgatattttcgtcttggagaccatcttgcctctgttgggtggaatgacggtggtgcttggcgacagccagcatcaggtcaatcctcaggcactgggtgaattgattactcatcatcatattgagatgttgcaaatgacaccatcccggctacaaatgctgctgggtcatgaagcaggttcccgcgcgctgcaaggcgtgaaggccattatggtcgggggtgaagcacttccgtccaagctgctcgcagcactgcaagaaataaacggtcctcgcatttataacatgtacggacctacagaaacgacggtgtggtcgaccgtgcaggaactgacccatgcggagcacattaatattggacgtcctattgcgaatacccaaatctatatcatgaatacgaatggggaattgcagcccgtcggcgtaccgggtgagttatgtattgcaggggaaggattggcccgtgggtattggaaacgtgaagaactaacggccgagaaatttgtgaataatccgtttgctgatgacaagtcagaccatgagcgggtgtatcgtacaggcgatttggcaagatggatgccggacggcaacattgaatatttgggtcggatggaccatcaggtgaaaatccggggttaccggatcgaactgggcgagatcgaatcgcagctgctgcaggtggaatcggtacaagaagcggtcatcatggcacgcacggacgaaacgggccaaacacagctcgtggcgtactacgtggcgagtcaagagcttggagcgggtgagctgagacaggagctgggacaagagctgccaagctatatggtgccgtcgtatttcatctggttggagcagatgccgctgacaccgaatggtaaaatcgaccgcaagtccctgccagcaccagaaggcggtttgcacagcggagcggattatgcagcgccacgcactgtaacagaacgaacactcgtagcgatctggcagtccgtcctgggcgtgccaatcgtcggtattttagacaatttctttgatctgggcggcgattcgatcaaggcgattcaaatcgtgtcccgtgcgttccaggcaggctacaagctggacatgaaggatttgttccgctatcccatcgtcgcaacgctggcaccgcatatgcacgaggtcagtcgtatggcagatcagggagaagtgagcggagaaacggtgttgcttccgatccagcatgggttctttgcgcaggcccaagtggatgcgcatcactttaatcaggccgttatccttcaccgggagcagggctttgacgaagctgctctgcgtcaggcacttggcaaactagcagagcaccatgatgcactgcagatggtgttcagcaagaccgagcaaggctataaagcatggaaccgcggaatacaggaaggcgagctgtatcatctggacgtgctggactttagggatttgacggatgaagccatgctcagcgcggcaattgaagtgaaagccagtgaaatccaaagcagtattcagctgcatgaagggccgttgttgaaggcgggcttgttccactgtgcagatggagatcatcttctgatggcgattcaccatttggtcgtggacggggtatcctggcgcattttgtttgaggatttggctactgcctatgaacaggccgttcatcaggaagtgcttcagctgccggacaaaacggattcattccgttcttggtcacaaaaactttccacctatgcgaatagcgcagcaatggacagtgaacacgcctattgggagcaatggaacgcagccgcttgggctgaccaagtacgtttgcctgaggatcaagcgcaggctgagccctttaccttggctgacacggatacagtggccttccagcttacggaagaagagactgaacggctgttgaagcaagcacaccgcgcatataacacggaagtgaacgatctgcttctgacggcactgggcatgatgctatacacgtggacgggtcatgaacgcagcctgattagtttagagggacacggacgtgaaaacattttgccggatacggacatttctcgtacggtaggctggtttacgagtccatatccagtattgctggacatcggtcgcaatcacgcttggtcggaacgcatcaaacgggtcaaagagagtctgcgccttattccgcataaaggaatgggctacggaatctggagatatttgagtgaatccggccaagtcgccagtcagcaagcaaatacactgaaccctggtcaacagcaagcttttgccgagccgcaggtgagctttaactatctcggacagctggatcaggacttgccaaacagtgatatgcgtaggtctccttactcaattggatcggtcgctagtgaccggacgaagatgaaatatgcgctcgatgtgagcgggatcgtaacgaacggcatcctggaactggacattcggtataacggcaaagccttccgtaaggacaccgtccacatgctagccaatctgctgaaatccaatctgcttgagatgatcgagcattgtgttacacgggagcggaccgaattgactccaagtgatgtgctgttcaaaggtctgaccctggagcaattagatacgattaaggagcagaccaagacggttggggaattggaaaatgtgtacccgttgacccctatgcaaaaggggatgctgttccatagtttgatgaatgcagaaacaggcgtgtattttgaacaggcgacctttgatctggaggggtactttgaaccatccctattcgaggaaagtctgaagctgttggttagccgacatgctatattacggacgaatttctacagcggctggtatggtcaaccgttgcagattgtctatcgtcataaaaatccgagcttccgttatgaggatgtcagagggcgcgaacacgctgtagctgaatttgtggcccaggataaagctcgaggctttgatctaagcaaggatgcgcttatgcgcgtagccgtcttccgcacgggtgaaagctcataccgttttgtatggagcttccatcatattgtgatggacggatggtgcctgtccctgatgacggacgaagtgtttggtgcatatgttgccttgctggagcacaagcagccagagctggcacctgtcaagccctatagtgattatatcgaatggttggaacatcaggatgcacaggaagcgacccgttattggagtgactatttggcaggttttgagcagcaaaccttgttgcctggtgagaacgcacaagcttctgtagtcgcacgcaatgaagaatcagacggaagcggtgcgggttcccattccagctatgtttcggaaaagctgccctttaggttgggtaaagaacggactgcggcattaaaccaaatggccaagcaacaacatgtcacgattaacacattgttgcaaagtgtgtggggcgttattttacagcaatacaataataatcaggatgttgtgtttggtggtgtggtatccggtcgtccggcagacattccgggtgtggagaacatgatcggactgtttatcaataccataccggtgcggattcaaagtgaatggaatgctacatttgctgaaatattgcagcgtacgcaggaacaggctttggcctccagtatgtatgacacgttcccgttgtacgatattcaggcactgactgaacaaaaacaagacctgattcatcacatcatggtctttgaaaactacccgatcgggcaacagatgaagcagatgggcggttccggcgagacaaaggcacaaacaggcttctcgattgccaatgtggcacttgccgagcaaaccaactacgattttaacctgattgtcgtgcctgatgaggatatctctatcctgcttgaatacaatgcgctcgtgtatagccggtctgccatggagcgtatccagggccatatcgaccatgtcatcggacaaattgtggacaatccgaatatccgagtgaatgagctggaattggtaacaccggaagaacaggcacagatcgttcaggtctggggggatacggcggcagcttatccgcaggatcaaacgctaagtgcactgttcgagcagcaggcagcgaaaacaccggatcaggtggcagtgttgtgcggagcggagtcgttgacctacgctgagctgaatgagcgtgccaaccgtctcggacgtactttgcgtgccgcaggtgttgaaccggatcagcccgtgggcattttggttcaccgttcgctggacatgatcgtaggcatctacgcgatcctcaaagcaggcggagcctacgtgcccatcgatccagaatatccggcggaccgcatccgctttatgctggaggattcgggtgcgaagctgatactgacgcaatcgcatttggcggagcaagcctcacggagtttcgacggccaggtgctggtgctggatcgttatgagcaggatggccaagacatttaccacaaagacggttcgaatctggagccactggctggcccgcaccatgtagcctatgtcatctacacctccggctccacgggaaaaccgaagggcgtgatggtggagcatcattccgtgctgaaccggattttgtggatgcatgatcgatacggtttgagtgcggaagatacgatcctgcaaaagacggccttcacgttcgacgtgtcggtgtgggagctgttctggtggtcgctggtcggctcgaaggtgagcttgttgcccgtgggcggggaaaagaacccggaagacatcgtcgacacgattgcccgcgatggcgtgagcacaatgcactttgttcccgccatgctgcatgcgtttctggagtacgtggagcagcagccacgggaagtgatgcaaacgaagctggcaacgttgcggcatgtgtttgccagtggtgaagcattgccgccacagcatgtggcccggttccagcggctcgtgtcgaacctggtcggagcgaaactgatcaacctgtatggaccaaccgaagcgacggtggacgtatcgtacttcgattgcgagcctaatgaaacctattcggtcattccaatcggaaaaccgatccaaaatattcgtctgtacatcgtgaaggaaggtacggagcaattgcagccgatcggggttgcgggtgaactgtgcatcggcggtgtaggtgtagcccgcggttatctgaatcgtccagagctgacggccgagaaattcgtagccgacccgtttgcaggcggggaagccggctatgaacggatgtaccgcacaggcgatttggcgagatggatgccggacgggaacattgaatatctgggccggatcgaccatcaggtgaaaatccgggggtaccggattgagctgggcgaggtcgaatcgcagctgctccaagtggaatcagtacgagaagccgtggtcacggcgcgtgcggatgagacgggacaaaaacaaatggtggcgtactatgtcgccgggcaagaaatgggtgccagtgagctgagaagtgagctgggccaggagctaccaagctacatggtgccgtcgtactttgtacagctggagcagatgccgctgagtccaaatggcaaaattgaccgcaaagccctgccaggaccggaaggcagcctacaaaccggaacggattatgcagagccgcgtactgctcaagaacgcgctctagtagcggtctggcagtcggtactgggactgcagactgtcggtattttggacaatttcttcgatctgggcggcgattcgatcaaggccatccaaatcgcatcgcgtgcgttccaggctggctataagctggacatgaaggatttattccagtatccaacggtcaaagcgctggcaccgcatatgcatgaggtcagtcgtatggcagatcaaggagaagtaagcgggaaaaccgctttgcttccgatccagcattggttctttgcgcaggagcgcgagcgtccgcagcactttaatcaggcagttatgctctatcgtgccgagggctttgatgagacggcggtttgccaagtcatggatcacatcgtgaagcatcatgatgcgcttcgtacggttttccatcaggattcctctggttatatggcttggacacgtagtgtagatgaaggcgcgttgtatacgctggaaaccgtggactaccgtgaacaggaaacctatgcggaagcgctggaagcgaaggcaaatgaaattcaaagcagcattcacctgtccgaagggcctctggtcaagctgggattgttccgcacagccgagggcgatcatttgctcatagccattcaccatttggtggtggacggggtatcgtggcgaattctgtttgaagatttctcgacaggttacgagcaggcgatcaagggcgagcctgtacgattgccctataaaacggattccttccaaacatgggcacgggagttgtcgtcttacgccaaccgtcctgaggctacatcggatgaagcctactggcagcagctggaacaggccaaagcggaagctgcgccgctgcctaaggattttgcctacgagggctccttgaatgctgacagcgaagtgctgacggtggagtggaccgaagctgaaacccagcagctgttaaagcaggcccatcgcgcttataacaccgaggtcaatgatttgctattgaccgcgttaggattggcgatgcacaactggacaggcgccggacaggtgctggttaatctggagggacatggccgggaagcaatcctgccagaggtggatattacacgtacagtaggctggtttacgagcttgtatccggtgctgctggaaatgggcaagggaatgacactggcacagcacatcaaagaaacgaaggaaggtctgcgccgcattccacataaagggctgacctatggcacatggcgctacttatctcctgcgtctgcatcaggtgaagcgcatgcgattgcagcagaaccggaaatcagctttaactatttggggcaggtcgatcaggatgtgcaaaacagtggaatcacatggtcatcctatagtgcaggggagacagaggatgcacattcaccgctgcaatatacgctggatttgaacgcgatgatctcggaaggcacgctgcgcttgacgatcgcttacagccgtaagcagtatcgccaagaaacgctggaacgtgtggcgagactgctgcaatccgctttgcaagaggtgattacgcattgtgtcgttcaggaacagccggagctgacgccgagtgatgtgtccttcaaaggtctgacgactagagaactggaacaaattgccgaacaggcggcacataccggtgagctggaaaatgtatacgcgctgacgccgatgcaaaagggcatgctcttttacaatctgatggattcgcaatcaggagcttattttgaacaggcctcctttgatctgcgaggacattttaatattgatgcgtttgcggcaagtttggatatattggtgcagcggcatacggtactgcgcacgaacttttacagtggctggaaagatgaaccacttcaggtcgtgtatcggaataagcgcagcgaactgtatgtagaggatttgcgggatatggagcaagagaagcaaaacgagtacatcctcgaatatacgcgtaaagacaagcaaagaggctttgatctggcgcaagatgctttgatgcgtgtggccgttttgcgcacaggtgaggatgcgtaccgttttgtatggagcttccatcatatcgtgatggacggctggtgcttgtcgctggtgacaggcgaagtgtttgcgagttattttgcgatactggctcataagcagcctgaactggcccctgtaacgccgtacagtcaatatatcgaatggctggaacagcaggatcgtcaggctgcatcaggttactggagcaaggttctggaaggatatgaggaacagtcccgcctgccgcaggctaaaattcaaggcaaaacggaatatcaggcggagcgtctggattttgacttgggcgcggatctaacggcaggcattcagcgcgtagccaagcgttatcaggtaacgatcaatacgttgatgcagaccgtttggggccttttgctgcaaaagtataatggtacagatgatgtggtgtttggcagcgtggtatctggacgtccggcagacattccgaatgtggagcacatcattggtctgtttatcaataccattcctgtacgcatccgcagtcaagtggacagcttattctcagacgtgatgaagcaaacccaagagcaatcgattgcttcccatgcctatgatacgtacccgttgtatgaaattcaggggctatcggagcttaagcaggatttgatcaatcatattcttatttttgagaattatccggtagaggaacaattggagcaattaggcaacggtgatgagtccagcttcagcatcaccggagccgagtctgtcgagcagaccaactatgactttaacctggtggtactgccggggaacaccattcatatgagctttgggtataatgcgctggcctttgaaagggaaagtgtagagcaaattcgaggtcatctagtgcagctgctggagcaggtgacagcgaagccggacattcgcgtgcatgagctggatatggtaaccacgcgggaacgtgagcaaatcgttgaggcttggggtaatactgcggcagcatatccaagcgagcaaacgatccatggcttgttcgaggcgcaaaccgcgcggacgccggagcagacagcactgttcttcgaaggagagcagttgacctatcgtgagctgaatgcacgcgccaatcgtttggctcgtaccttgcgcagtcaaggcgtgacgaaagatcgtttggtgggtctgatgaccgaacgttcggtggacatgatcgtggggatcttcgggattttgaaggccgggggcgcgtatgttcctattgatccgacgtatccagaggagcgtatccgctatatgctggacgactcgggtgcgaagctgctgttgacgcaaagccatctggtggacaaagccgctatcgacggtcatgtgctggtgttggatggggagcaaacggtgtaccacgaggatggttccaatctggagccgtggtccggtccgaacgatctagcctatgtgatttatacgtcagggaccacggggcagccgaagggcgtgatgctggagcatcacgggctgtgcaatctgaaaacgtattttgatcagacgcttcggatgagcacgtcggatcatgcattgctgttcgccagctattcgtttgatgcggcttgctgggaaatcttccaggcgctgttctgcggagccacgttatatgtgccaacgacagaaacgattttgaactacgagcggtttgagcaatatatggcggatcaccaaatcacggtagcagctttgccgccgacctatgcggtgtatctgagcccagaccggatgccaaacctgcgtattttgtttacggcgggttcagcatcttcaacagaactggtatacaagtggaaggatcaagtggcgtactacaacggctatggtccaaccgaaaactcggtggcgacatccatctggccggtatccgaggatgaaagggcaggacaactgatttccatcggatgccctgtgccgaatcatcgggtatacatggtggatgtgcatggacatttggctccggtaggcgtagcgggtgaactgtgcgtgtccggtccgggtctggctcggggttatctggatcgtccagagctgacggctgagaaatttgtattgaacccgtttgcggctggcgaagccggctatgaacgaatgtaccgtacgggtgatttggcgagatggatgccagacggcaacatcgaatatttgggccggatcgaccatcaggtgaaaatccggggctaccggatcgagcttggcgaggttgaggcacaaattttgaaagtggaggacgtacaagaggtcatcgtactggcccaggcggacgagcagggacaaaaccaactggtggcgtactatgttgctgaacgggaagtaagcgctggtgagctacgcagcttactgggcgaggagctaccaaactacatggtgccttcgtatttcatccagctagaacaaatgccactgacgccgaacggtaaaatcgaccgcaaggccctgccggcaccagaaggcagcctgcaaagcggagcggattatgtagagccgcgcacagcgctggagcagacgttagtgtccatttggcaggctgtattaggagcaaagagagtcggaattttggataatttctttgatctgggcggcgattcgatcaaggcaatccaggtatcctcccgtttgctgcaagcgggctacaagctggacatgaaggatttgttccaatatccttccatttcgctgctgaacggtcatgtacacaaggtcagccgtacagccgatcagcgggtggtttcgggggcagttagattgaccccgattcagcaatggttctttggacaatactcagcagagccacattatttcaaccagtcggtgatgctgtatagggcgcaaggcttcgatgtagacgcattgcatcaaacggtgaccaaagtgactgagcatcatgatgctttgcgtatggtcttccgtcagaccgaacagggctatgaagcgtggaatcgcggtttgaacgaaggcgagctgtatcgtctggacgttgttgatctgacggatgtgcaaaacattacagatgttgcatcagccattgaaatgaaagccaatgccatccaaagttccattcgtctggacgaaggaccgctggtgaagctgggacttttccgctgcatggatggggatcatctactgattgcgattcaccatttggtcgtagacgggatttcatggcggattgtgtttgaggattttgccacgggatatgagcaggccgtgcggggagaagcgattcgcctgccttataaaacggacgttttctctgcttgggcagagcgcttatcacaatatgcgaatagtccgaccatcgaaaatgaacgtgaatattggcagcatctcgctcaaatggaagtcgcatcgttgcctaaggatcaagagagagcggagggacaacattctctaatcagagacactgcgacggtgagcgtagcttggagtgaacaggaaacacgactgctgcttcaggaagcacaccgtgcgtaccacaccgaggtcaatgatctgttgttaaccgcactcggcacagcggtatataactggagcggtcaggagcgtgtgctggtcaatctggagggacatggccgggaagccattgttccagatatcgacatcacccgtaccgtgggctggtttacgagccaatatccggtgctgctggatgtggacggaaaggcagcagtcggacagcgaatcaagcgggtgaaggaagacctgcgtcatgtaccgcataagggcattggctacggcattttgaaatatatgtctcagcatgatgcccatccttcctggaccttgcagcccgaaattagctttaactatttaggacaatttgatcaggacttggaaaatggggatatcacgctgtcttcacatccaggtggagagccgatgagtgaccataccgttctggagcatccgctgaatgtgaacggaatgattacagcgggcgcgctgacactggacattcgctatgacagtaaggtatatcatcagcaaaatgtagaaaactttgcgcagttgctgcaggaaagcttgcaggaagtgatcgttcattgtgcctccaaagagcggagtgagctaacaccaagtgatgtattgttcaaaggcttgacgcttgggcagctggaacagttgacagagcaaacagcttctgtaggcgagctggagaatgtatatgctctttcgcctatgcagaaggggatgctgttccataatctgatggagccggactcaggcgcctacttccagcaagcgtcgtttgatcaaaaaggcagctttgatgttgaaattttccgcaagagtctggatgtactgacacagcgtcatgaagcgctgcgaacgaatttccatatgtttgagacaggacacagtcaggagccattgcagatcgtgttccgtcataaagatagcgacctttccttccaggatatacgggaaatgcaggaagcggagcaacaggcgtatatccaggcgtttaagctagaggaccaagctaggggctttaatcttggtacggatgcactcatgcgcgtacaggtattgcagacccatgaagaaacgtatcatttggtatggagcttccatcatattgtcatggatggctggtgcttatcgctcgttacgggtgaagtgtttggtacgtactttgcgctgctggagcagaagcaaccggagtttgcagcgattacaccgtatggccaatatatcgaatggctagagcgtcaggatgaacgtgcggcaaaagagtactggagcagctatttggcgggctttgaacagcagacgttgttacctggatcggatactttatcgaaagaccaagcggctaatacggtatccactacagcaagtgaaaccagcgagtatgtttctgaaaaaataacggtagatctggacccagcgtggagcgaagccatacaccggatcgcgaagcagcaacaggtcacgattaatacgctgatgcagagcgtgtggggccttattttgcagaaatataacaacaacgaggatgttattttcggtagtgtcgtatctggacgtccgacggatattgctggcgtagagcatatgattggtttgttcattaatacgatcccggtgcggattcaaagtgaacggaatgccacttttgtggaagtgatgcggaaaacgcaggaacaggcactggcctcgggagcctatgacagcttcccgctgtatgaaattcaggcattgaccgagcagaaacagaacttgattaaccacattatggtatttgagaattatccggtagaggagcaagttgagcagcttagtgaagttcgtccgtccgcttttgaaattacgaatgtagaggttgtcgagcaaacgaattatgatctggacttgattgtgatgccagacgaaaccttccgcatcatgttcagatacaacgccaatgtatacgatcggtctacgatagagcgaatgcagggacatgtactgcatgtcatcgagcaaatcgtgaataatccgtatatccgtgtgaatgaactggaattggtaacaccagaagaacaaacacagatcgttcaggtctggggggatacggcggcagcttatccgcaggagcagacgttaagtgcgctgttcgagaagcaggtagcggaaacaccagatcaagtggcagtgctgtacggatcggaatcgttgacctacgcggagttgaatgagcgcgcgaaccgtttggctcggacgctgcgtgccgcaggtgttgaaccggatcagcccgtgggcattttggttcaccgttcgctggacatgatcgtcggcatttatgcgatcctcaaagcaggcggagcctacgtacccatcgatccagaatatccggcggatcgcatccgctttatgctggaggattcgggtgcgaagttggtactgacgcagtcgcatctggcagagcaagcgtcacggagttttcacggtcaggtgctggtgctggatcgtcatgaacaggatggccaagacatttaccacgaagacggttcgaatctggagccactggctggcccgcaccatgtagcctatgtcatctatacctctggctccacggggaaaccgaagggcgtgatggtggagcaccattccgcgctgaaccggattttgtggatgcatgatcggtacggcttgagtgcggaagatacgatcttgcaaaagaccgccttcacgttcgacgtgtcggtgtgggagctgttctggtggtcgctggtcggctcgaaggtgagcttgctgtcggtaggcggggaaaagaacccggaagacatcgtcgacacgattgcccgcgatggcgtgagcacgatgcactttgtacctgccatgctgcatgcgttcctggagtacgtggagcagcagccacgggaagtgatgcaagcgaagctggcaacgctgcgccatgtgtttgccagtggtgaagccttgccgccacagcatgcggcgcgattccaacggcttgtgtcgagcctgactggagcgaaactggtcaacctgtatggaccaaccgaagcgacggtggacgtatcgtacttcgattgcgagcctaatgaaacctattcggtcattctaatcggaaaaccgatccaaaatatccgtctgtacatcgtgaaggaaggtacggagcaattgcagccgatcggggttgcgggtgagctgtgcatcggcggtgtcggcgtagcccgcggttacctgaaccgtccagagctgacggcggagaaattcgtagccgacccgtttgctggcggggaagcagggtatgaacggatgtaccgcacaggcgatttggcgagatggatggcagacggcaacattgaatatttgggccggatcgaccatcaggtgaaaatccgggggtaccggattgagctgggcgaggtcgaatcgcagctgctccaagtggaatcggtacgcgaagcggtggtcatggctcgtgcagacgagacgggacaaaaacaaatggtggcctactatgtcgccggacaagagctcggcgccagcgagctgagaagtgagctgggccgagaactgccaagctacatggtgccatcgtactttgtacagctggagcagatgccactgagtccaaatggcaaaattgaccgcaaagccctgccagcaccggaaggcagcctgcaaagcggagccgattatgtcgcaccgcggacgtgggtggaagtgaaactggcgcacatttggcaggatgtgctgggtctcacgcaggttggtgtgaaggaaaacttcttcgagattggcggacactcgctgcgggcgacgacactggcctcgaaaattcacaaggagctgaacaagccgcttccactacgtagtatttttgaagcaccaacgattgagcaactggcaacggtgttagaaagtctggatcaagtaacctatgcgtccattccagtaacggaagaacgcagcttctacccgttatcttcggcgcaaaaacgactgtatgtgctgcatcagtttgatccaagtgatgtgaattacaacatgccgtcggtgctgcaagtgagtggtccgctggacgtaaaacgagtagaagacgtgttccgtcaactgatcgatcgccatgcaaccttgcgtacccgctttgaactggtggacaatgagccgatgcaatgggttgaggacaccgtgccgttcaaagtggaatatacgaaggtacaagcagagcgtgcaactacggatacagatcaggacacagctacagctacggacacgacggtcagccaggaagcacaagaacgggtacgacagtttgtgcgtccgttcgatctgaaagctgcaccgctgctgcgggtgggcttggtggatctagacgtacaaggagcagagcaggaatcccagcatttactcatgctcgatatgcaccatatcgtttcggatggtgtgtcgatggaggtgctgaccgatgaatttgtccgcttgtatggcggtgaagagctaccggcattgcggattcagtacaaagactatgcggtatggcagcaaagccaagcccatcaggagtggatgcagcgtcaggaagcgtactggctgggtaccttccggggcggcgtgcctgtgctggatctatcaaccgactttgcccgtccggcggtgcagagtacggcaggggatacgatcgaattcggactggagcgtgaagttagcgaacgcctgaaagaactggcttctcaaacaggttcaaccttgtatatggtgctgctggcggcgtacactacgctcttgcataaatacacaggccaagaagatatcgtagtgggaacgccgattgctggaagaccgcatgcggaactggagagtctggtaggtgtcttcatcaacacgctggcaatccgcaattatccgtctagcgaccaatcgttcctggattatctgcaagaggtgaaggagcatgcgctcagtgcttatgagcatcaggactatccttttgaagagctggttgaaaagctgaatttgacgcgggatacgagccggaatgcgctgtttgacacgatgtttgagttgaaaacattggagcagcaggagttccagctggaaggtctgaccttgaattcatatccgctggaaaataatacggccaaatttgatctgagcttggatgcaatagagcagccagaaggcattctgtgccgtctggaatacagcacggtgctgtataagcctgagacgattgcgcgattggcgcagcattttaccgaactcgtacgtgcaattacactgcatccacaacagccactggcagctttggatatggtacctgccgaggaaaaagcacaaatcatctatggttttggaaatgtgggggtaacggattgtgctgctgctgaagcaggagccttcttccacacctatgtggaagaacaggcacagcttgtgccggatcgcgtggcggtggtgtacgaggagcagcaacttacgtaccggaaactgaacgagcgcgcgaaccaattggcgcggagattgcggaatgaaggtatcggacgcgaatcgatggttggcatcttgagtgaacgctcggtggatatgttgatcggcgtactggcggtgtggaaggccggcggtgcgtacgtgccgctggatgcagactatccgtcagaacgtattcgttttatgctggaggacagcggtgcgacggtactgttgacccagacgggtttgcaggaccgtgcgcaggcatggctggaggaaagccgacaggccttggccggagggcgatctgaagccgagttggaaacaacggctggcgctgaaacgatggaatcaggtactctccatggaactctgaatggaacaacagattcgccacctgacagcaaaactacatccgaatccgcaacaggcttgcgtctgcataccgtattggcgttggacgatgagtcgctgtataccggggatgccacggatatcgagcacatcaacgaaccgcaggatctggcgtatgtcatttacacctccggtacaacaggacgtccgaaaggggtcatgatcgagcatcacagtttggtgaatacggctgcggcgtatcgccgagattaccgtctgagcgagttcccggtacgactgctgcagctggcgagcttctccttcgacgtcttcgtcggggatatcgcgcggacgctctataacggcggcacgatggttatttgtccgaaagacgaccggattgattttagccgtttgtatgactggattcgcgattaccagattaccgtgttcgaatcgaccccggccctgatcgtaccgtttatgcagcatgtgcatgaacacggactggacatgagtagtctggaactgctgattaccagctcggatagctgcagcgtgacggattaccgggtgctgcaagaacggtttggcgcggatatccgcattatgaacagctacggcgtcacagaagcagcaatcgactccagtttctacgacgaagaattgtcgaagctgccaagcagcggcaatgtgccgattggccaggcgtggctgaacgcccgcttctacatcgtggacagccagctgaatccggtgccgatcggcgtactgggtgaactgtgcattggcggagccggggtagcacgaggctacctgaaccgtgcagacctgatcgccgagaaattcgtagcgaatccgtatataccgggtgaacgattgtac

SEQ ID NO: 21 - DNA, 20004 bp, Unknown
  Kingdom: Bacteria, Phylum: Firmicutes, Class: Bacilli, Order: Bacillales, Family: Paenibacillaceae, Genus: Paenibacillus
acgattgaacggctgggagagctgctagcatccggcttgagtgaagtcattcatcattgtgtagcccaagagagaacggtgttgaccccaagtgatgtcttgttaaaacatgtaacgctggacgagctggagcaattggtgaaagatacacaagatatgggtgaactagaaaatgtgtatgctttgacgccgatgcaaaagggtatgctcttcttcagtctaatggatgagagttcggcagcttattttgagcaggcctcctttgaatggaatggacggtttgatgtggttgctttcagcaaaagctttgatctgctcgtacagcgtcatgaggcattgcggacgaactttatcaactcctggaaggatgagcctgtgcaggtcgttttccgcaatcgcagcggagagttgtactatgaagacctgcgcggactggaaaaagaagaacgagcagcgcgtgttgaggcttttacccttgccgataaagcgaaaggattcaatctcgcagaggatgcactcattcgtatttcgatcctgcaaaccggggatgaaacatatcactttatctggagcttccatcatattttgatggatggctggtgcttgtcctttatgacacaggaggtattcggcagctatctggcactgcgtgcgggtcataagcccgtactggagcctgttacgccgttcagtcgatttattgaatggctggaacgtcaggaccgtgaggcggccctgcagtactggagcagatatctggaagattatgagcagcaaattacgctcccgcagcaaaaaatacagcctaaatcgatgcacaccggggaatatgttgctgaagatctggattgcgaattccagccggagctggttgcccagatcgaacaagtggcgaagcaaaatcaggtgacgatcaatacgctgattcagacggtatggggcgtcttgttgcaaaaatataataacagttcggatgttgtgttcggcagcgttgtgtccggtcgcccaggggatattccaggtgtggagcacatgattgggctattcattaacacgattccagtgcgcgtgcagtctgaacaaggtgaaacctttgtcgagctgatgaaacgaacacaacggcaggcgctggcttccaatgcctacgatgcgttcccgctgtatgaaattcaagcactgaccgagcagaaacaggatttaatcaatcatattatgatatttgaaaattatccggtggagcagcaggtagagcagttgggcagtgatggacaggaaaaatttacgatttcgaacgtggtgtctacagaggcaaccaactatgatctgaacgtcgtcgttatgccgggtgaaggcatcaagattcgttttatgtataacacgctcagctttgatcaagcaggtattgagcgtctgtatgggcattttgcacgcctgctggagcaaatttcgctcaatccgcatgtttgtgttgaagagctggaactactcacagccgcggaaaagcagcagattacagcggcatttaatgacaccgcttgtgcttttccgtctcatcagacgatccatcagctgttcgaggagcaggtagaatatacgccagatcaggtggcattggtgtttggacatcagagtctgacttatcgagaactgaatgaacgggcgaattcattggcccgaatgcttcaagcacaaggagtaggacctgacaagctggtcggactgatggtacagcgctccgtggaaatgattgtaggtctcctggctgttctcaaagcaggtggtgcttatgtgccgattgatcccgaatttccgtcctctcgtattgcatacatgctggaagacagcgaggccgcagtgcttctgaccagtcgtgatctgttggaagagcatcattgccatgccaataccctatttcttgaggatgcagccttgtatcagggagagagcggcaacctggagacgattgcccgcccagagcatttggcttatgtcatctatacgtcgggttcgactggaaatccgaaaggagttatgctccagcatcgctcggtcctcaactttattacagggatgcgcgaagtcattgactttgaagcgagccaaacgattttgtcactcacgaccatttcattcgatattttcgtcttggaaaccatcttgcccctgttgggtggaatgacggtggtgcttggcgacagccagcatcaggtcaatcctcaggcactgggtgaattgattactcatcatcatattgagatgttgcaaatgaccccatcccggttacaaatgctgttgggtcatgaagcaggttcccgcgcgttgcaaagcgtgaaggccattatggtcgggggcgaagcccttccgtccaagctgctcgtagcactgcaagaaataaacggtcctcgcatttataacatgtacggacctacagaaacgacggtgtggtcgaccgtgcaggaactgacccatgcggagcacattaatattggacgtcctattgcgaatacccaaatctatatcatgaatacgaatggggaattgcagcccgtcggcgtaccgggtgagttatgtattgcaggggaaggattggcccgtgggtattggaaacgtgaagaactgacggccgagaaatttgtgaaaaatccgtttgctgatgacaagtcagaccatgagcggatgtatcgtacaggcgatttggcaagatggatgccggacggcaacattgaatatttgggtcggatggaccatcaggtgaaaatcagaggttaccggatcgaactgggcgagatcgaatcgcagctgctgcaggtggagtcggtacaagaagcggtcattatggcacgtacggacgaaacgggccaaacacagctcgtggcgtactacgtggcgagtcaagagctgggagcgggtgagctgagacaggagctgggacaagagctgccaagctatatgatgccgtcgtatttcatctggttggagcagatgccgctgacaccgaatggtaaaatcgaccgcaagtccctgccagcaccagaaggcggtttgcaaagcggagcggattatgcagcgccacgcactgtaacagaacgaacactcgtagcgatatggcagtccgtcctgggcgtgccaatcgttggtattttagacaatttctttgacctgggcggcgattcgatcaaggcgattcaaatcgtgtcccgtgcgttccaggcaggctacaagctggacatgaaggatttgttccgctatcccatcgtcgcaaccctggcaccgcatatgcacgaggtcagtcgtatggcagatcagggagaagtgagcggagaaacggcgttgcttccgatccagcatgggttctttgcgcaagcccaagtggatgcgcatcactttaatcaggccgttatgctgcaccgggagcagggctttgacgaagctgctctgcgtcaggcacttggcaaactagcagagcaccatgatgctctgcggatggtgttcagcaaaaccgagcaaggctataaagcatggaaccgcggaatacaggaaggcgagttgtatcatctggacgtgctggactttagggatttgacggataaagccatactcagcgcggcaattgaggcgaaagccaatgaaattcaaagcagtatccagctgcaagaaggaccgctgttaaaggtgggtttgttccactgtgcagatggggaccatctcctgatggcgattcaccatttggtggtggatggggtatcctggcgcattttgtttgaggatttggctactgcctatgaacaggctgttcatcaggaagtgcttcagctgccggacaaaacggattcattccgttcctggtcacaaaaactttccacctatgcgaatagcacagccatggaaagtgaacacgcctactgggagcaatggaacgcagcggctttgtctgaccaagtacgtttgcctgaggatcaagcgcaggctgagccctttaccttggctgacaccgatgcagtggtcgtccagcttacggaggaagagacatcaaaattattgaagcaagcacaccgcgcatataacacggaagtgaacgatctgcttctgacggcactgggcatgatgctgtacacgtggacgggtcatgaacgcagcctgattagtttagagggacacgggcgtgagaacattttgccggatacggacatttctcgtacggtaggctggtttacgagtccatatccggtattgctggacatcggtcgcaatcacgcttggtcggaacgcatcaaacaggtcaaagagagcctgcgccttattccgaataaaggaatgggctacggaatttggagatatttgagtgaaaccggtcaagcggttggtcagcaagcaggtgtgctgagcctaggtcaatatcaagcttttgccgagccacaagtaagctttaactatctcggacagctggatcaggacttacaaaacagcggtatgaataggtctccttactcaattggatcgatcgctagtgaccggacgaagatgaaatatgcgctcgatgtgagcggaatcgtaacgaacggcattctggaactcgacattcggtataacggcaaagccttccgtaaggacaccgtccacatgctagccaatctgctgaaatccaatttgcttgaaatgatcgagcattgtgtcacacgggagcggaccgaattgactccaagtgatgtgctgtttaaaggtctgacaatggagcaattagatacgattaaggagcagaccaagacggttggggaattggaaaatgtgtacccgttgacccctatgcaaaaggggatgctgttccatagtttgatgaatgcagaaacaggcgtgtattttgagcaggcaacctttgatctagagggccactttgaaccatccctattcgaggaaagtctgaagctgctggttagccggcatgctatattacggacgaatttctacagcggctggtatggtcaaccgttgcagattgtctatcgtcataaaaatccgagcttccgttatgaggatgtcagagggcgcgaacacgctgtagctgaatttgtggcccaggataaagctcgaggctttgatctaagcaaggatgcgctcatgcgcgtagccgtcttccgcacgggtgatcgctcctaccgttttgtatggagcttccatcatattgtgatggacggctggtgcctgtccctgatgacggacgaagtgtttggggcatatgttgccttgctggagcacaaacagccagagctcgcacctgtcaagccgtatagtgattatatcgaatggctggaacaacaggatgcgcaggaagcaacccgttattggagtgactatttggcaggttttgagcagcaaaccttgttgcctggtgagaacgcacaagcttctgtcgtcgcacgggatgaagaatcagacggaagcgatgaaagttcaaatgccggctatgtttcggaaaagctgccctttaggttgggtaaagaacggactgcggcattaaaccaaatggccaagcaacaacatgtcacgattaacacattgctgcaaagtgtgtggggtgttattttacagcaatacaataataatcaggatgttgtgtttggtggtgtggtatccggtcgtccggcagaccttccaggcgtggagaacatgatcggattgtttatcaacacgattccagtacgcatttgcagtgcaccggatgctacatttgctgaagtattgcagcgcacccaggaacagtctttggcctccagtgtctatgatacgttcccgctatacgatatccaggcactaactgaacaaaaacaagacctgattcatcacatcatggtctttgaaaactacccgatcgggcaacagatgaagcagatgggcggttccggcgagacaaaggcacaaacaggcttctcgattgccaatgtggcacttgccgagcaaaccaactacgattttaacctgattgtcgtgcctgatgaggatatctctatcctgcttgaatacaatgcgctcgtgtatagccggtctgccatgcagcgtatccggggccatatcgaccatgtcatcggacaaattgtggacaatccgaatatccgagtgaatgagctggaattggtaacaccggaagaacaggcacagctcgttcaggtctggggggatacggcggcagcctatccgcaggatcaaacgctaagtgcactgttcgagcagcaggcagcgaaaacaccggatcaggtggcagtgttgtgcggagcggaatcgttgacctacgcggagttgaatgagcgcgcgaaccgtttggctcgaacactgcgtgccgcaggtgttgaaccggatcagcccgtgggcattttggttcaacgttcgctggacatgatcgtaggcatttatgcgatcctcaagtcaggcggagcttatgtacccatcgatccagaatatccggcggatcgtatccgctttatgctggaggattcgggtgcgaagctggtactgacgcaatcgcatttggcggagcaagcgtcactgagttttgacggccaggtgttggtgctggatcgtcatgagcaggatggccaagacatttaccacgaagacgattcgaatctggagccactggctgggccacaccatgtagcctatgtcatctacacctccggctccaccgggaaaccgaagggcgtgatggtggagcaccattccgtgctgaaccggattttgtggatgcatgatcgatacggcttgagtgcagaagatacgatcctgcaaaagaccgccttcacgttcgacgtgtcggtgtgggagctgttctggtggtcgctggtcggctcgaaggtgagcttgctgcccgtgggcggggaaaagaacccggaagacatcgtcgacacgattgcccgcgatggcgtgagcacaatgcactttgttcccgccatgctgcatgcgttcctagaatatgtggagcagcagccacaggaagtgatgcaagcgaagctgggcacgctgcgccatgtctttgccagcggcgaagcgttgccgccacagcatgtggcgcgattccagcggctggtgtcgagcctggctggagcgaagctggtcaatctctacggaccaaccgaagcgacggtggacgtatcgtacttcgattgcgagcctaatgaaacctattcggtcattccaatcgggaaaccgattcaaaacattcgtctgtacatcgtgaaggaaggtacggagcaattgcagccgatcggggttgcaggagaactgtgcatcggcggtgtcggcgtagcccgaggctatctgaaccgtccagagctgatggccgagaaatttgtgaaagacccgtttgcaggcggggaagcaggctatgaacggatgtaccgcacaggcgatttggcgagatggatgccggacgggaacattgaatatctgggccggatcgaccatcaggtgaaaatccgggggtaccggattgagctgggcgaggtcgaatcgcagctgctccaagtggaatcggtacgcgaagccgtggtcacggcgcgtgcggatgagacgggacaaaaacaaatggtggcgtactatgtcgccggacaagagcttggcgccagtgagctgagaagtgagctgggccgggagctgccaagctacatggtaccgtcgtactttgtacagctggagcagttgccgctgagtccaaatggaaaaattgaccgcaaggctctaccagcaccagaaggcagcctacaaaccggaacggattatgcagagccgcgtactgctcaagaacgcgctctagtagcggtctggcagtcggtactgggactacagactgtgggtatcttggacaatttcttcgatctgggcggcgattcgatcaaggcgatccaaatcgcatcccgtgcgttccaggctggctataagctggacatgaaggatttgttccagtatccaacggtggaagcactggcaccgcatatgtatgaggtcagtcgtatggcagatcaaggagaagtgagcggggaaaccgctttgcttccgatccagcattggttctttgcgcaggagcgcgagcgtccgcagcactttaatcaggcagttatgctctatcgtgccgagggctttaatgagatagcggttcgtcaggtgatggatcacatcgtgaagcatcatgatgcgcttcgtacggttttccatcagaattcctctggttatatggcttggacacgtagtgtagatgaaggcgcgttgtatacgctggaaacgatggattaccgtaaacaggaaacctatgcggaagcgctggaagcgaaggcaaatgaaattcaaagcagcattcacctgtccgaaggacctctggtcaagctgggattgttccgcacagccgagggcgatcatttgctcatagccattcaccatttggtgatagatggggtatcgtggcggattctgtttgaagatttctctactggctacgaacaggcgatcaagggcgagcctgtacgattgccctttaaaaccgattccttccaaacatgggcacgggagttgtcgtcttacgccaaccgtccagaggctgcatcggatgaagcctactggcagcagctggaacaggccaaagcgaaagcggcaccgctacctaaggatttcgcctacgagggttccttgaatgcagacagcgaagtgctgacggtggagtggaccgaggctgaaacggagcaactgctaaagcaggcccatcgcgcttataacaccgaggtcaatgatttgctgttgaccgcgttaggattggcgatgcacaactggacaggcgccggacaggtgctggtgaatctggagggacatggccgggaagcaattctgtcagaggtggatattacacgtacagtaggctggtttacgagcttgtatccggtgctgctggacacagatgtcaacctgacgctggcccagcggattaaagaaacgaaggaaggtctgcgccgcattccgcataaagggctgacctatggcacatggcgctacttatctcctgcgtctgcatcggatgaagcgcaggcgattggagcagaaccggaaatcagctttaactacttggggcaggtcgatcaggatgtgcaaaacagtggaatcacatggtcatcctatagcgcaggggagacagaggatgcccattcaccgctgcaatatacgctggatttgaatgcaatgatctcggaaggcacgctgcgcttgacgatcgcttacagccgtaagcagtatcgccaagaaacgctggaacgtgtggcaggactgctacaatccgctttgcaagaggtgattacgcattgtgtcgctcgggagcatccggaactgactccaagtgatgtgtccttccagggtctgacgactggagaactggagcacatggcagcgcaggctggacatataggtgagctggaaaatgtatacgcactgacgccgatgcaaaagggcatgctcttttacaatctgatggactcacaatcaggagcatattttgagcaggcatcttttgatctacagggacattttaatatcgctgcatttgcggcaagtttggatgtattggtgcagcggcatacggtactacgcacgaacttctacagcggctggaaagatgaaccacttcaggttgtgtatcggaataagcgcagcgaactgtatgtagaggatttgcgggatatggagcaagagcggcaaaacgagtacatcctcgaatatacgcgcaaagacaagcaaagaggctttgatctggcgcaagatgctttgatgcgtgtggctgttttgcgcacaggtgaggatgcgtaccgttttgtatggagcttccaccatatcgtgatggacggctggtgcttgtcgctggtgacaggcgaagtgtttgcgagttattttgcaatactgactcataagcaacctgaactggcccctgtaacgccgtacagtcaatatattgaatggctggaacagcaggatcgtcaggccgcatcaggttactggagcaaggttctggaaggatatgaggaacagtcccgcctgccacaggctaaaatccagggcaaaacggaatatcaggcggagcgtctggattttgacttgggcgcggatctaacggcaggtattcagcgcatagccaagcgttatcaggtaacgatcaatacgttgatgcagaccgtttggggcctgttgctgcaaaaatataatggcacagatgatgtggtgtttggcagcgtggtatctggacgtccggcagacattccgaatgtggagcacatcattggtctgtttatcaataccattcctgtgcgtatccgcagtcaagtggacagcttattctcagacgtgatgaagcaaacccaagagcaatcgattgcttcccatgcctatgatacgtatccgttgtatgaaattcaggggctatcggagcttaagcaggatttgatcaatcatattcttatttttgagaactatccggtagaggaacaattggagcaattaggcaacggtaatgagtccagcttcagtatcaccggagccgaatctgtcgagcagaccaactatgactttaacctggtggtattgccggggaacaccattcatatgagctttgggtataatgcgctggcctttgaacgggaaagtgtagagcaaattcgaggtcatctggtgcaactgctggagcaggtggtagcgaagccagacattcgggtgcatgagctggatatggtaaccgcgcaggagcgtgagcaaatcgttgaggcttggggaaatacagcggcagcatatccaagcgagcaaacgattcacggcttgttcgaggcgcaaaccgcgcggacgccggagcagacagcattgttctttgaaggagagcagttgacctatcgtgaactgaatgcacgcgccaatcgtttggctcgtaccttgcgtagtcaaggcgtgacgaaagatcgtttggtgggtctgatgaccgagcgttcggtagacatgatcgtgggcatcttcgggattttaaaagccgggggtgcatatgtccccatcgatccgacctatccagaggagcgtatccgctacatgctggacgactcaggtgcaaagctactgttgacacaaagtcatctggtagacaaagccgctatcaacgggcatgtgctggtgctggatggggagcaaacggtgtaccacgaggatggttccaatctggagccgtggtccggtccgaacgatctagcctatgtgatttatacgtcagggaccacggggcagccgaagggcgtgatgctggagcatcacgggctgtgcaatctgaaaacgtattttgatcagacactcaagatccgtacgtcggatcatgcgttgctgttcgccagctattcgttcgatgcggcttgctgggaaatcttccaggcactgttctgcggagccacactgtatgtaccaacgtcagagacgattttgaactacgagcggtttgagcaatatatggcggatcatcagatcaccgtggccgctttgccgccgacctatgcggtgtatctggagccagaacggatgccaaacctgcgtattctgttcacggcgggttcagcatcttcaaccgagctggtatacaagtggaaggatcaagtggcgtactacaacggctatggtccaaccgaaaactcggtggcgacatccatctggccggtatccgaggatgaaagggcaggacaactcatttctatcggacgccctgtaccgaatcatcgggtatacatgatggatgtgcatggacatttggctccggtaggtgtcgcgggtgagctatgcgtgtccggtccgggtctggctcggggttatctggatcgtccagagctgacggctgagaaatttgtatcgaacccgtttgcggctggcgaagcaggctacgaacggatgtaccgtacgggtgacttggcgagatggatgccggacggcaacatcgaatatttgggccggatcgaccatcaggtgaaaatccggggctaccggatcgagctgggtgaggtcgaggcacaaattttgaaagtggaggatgtacaagaggtcatcgtactggctcaggcggacgagcagggacaaaaccaactggcggcgtactatgtcgctgaacgggaagtaagcgctggtcagctgcgcagcttactgggcgaggagcttccaaactacatggtgccttcgtatttcatccagctggagcagatgccgctgacaccgaacggtaaaatcgaccgcaaggccctgccggcaccagaaggcagcctgcaaagcggagcggattatgtagagccgcgcacagcgctggagcagacgttagtgtccatttggcaggctgtattaggaacgaagagagtcgggattttggataatttctttgatctgggcggcgattcgatcaaagcgatccaggtatcctcccgtttgctgcaagcgggctacaagctggacatgaaggatttgttccaatatccttccatctcgctgctgagcggtcatgttcacaaggtcagccgcacagccgatcagcgggtggtttcgggggcagttagattgaccccgattcagcaatggttctttggacaatcctcagcagagccacattatttcaaccagtcggtgatgctgtatagggcgcaaggcttcgatgaagccgcattgcatcaaacggtggccaaggtaacggagcatcatgatgcgctacgtatgatcttccgtcagaccgaacagggctatgaagcgtggaatcgcggtctgaacgaaggccagctgtacagtctggatgttgtagatctgatgggcgtcgaagacgcggcagatgtggtgatggcgattgaaacgaaagccaatgccatccaaagttccattcgtctggacgaaggaccgttggtgaagctgggacttttccgctgcatggatggagatcatttactgattgccattcaccatttggtcatagacgggatttcgtggcggattgtgtttgaggattttgccacgggatatgagcaggccgttcgaggagaagcgattcgcctgccttataaaacggacgcttactccgcttgggcagagcgcttgtctcaatatgcgaatagtccggcgatcgaaaatgaacgtgaatattggcagcatctcgctcaaatggaagtcgcatcgttgcctaaggatcaagagagagcggagggacaacattctctaatcagagacactgcgacggtgaccgtggcttggagcgaacaggaaacacgactgctgcttcaggaagcacaccgtgcgtaccacaccgaggtcaatgatctgctgttaaccgcactcggcacagcggtatataactggagcggacaggagcgcgtgctggtcaatctggagggacatggccgggaagccattgttccagatatcgacatcacccgtaccgtgggctggtttacgagtcagtatccggtgctgctggatgtggacggaaaggcagaagtcgggcagcgaatcaagcgggtgaaggaagacctgcgtcatgtgccgcataagggtattggctacggcattttgaaatatatgtctcagcatgatgcccatccttcctggaccctgcagcctgaaattagctttaactatttgggacaatttgatcaggacttggaaaatggggatatcacgctgtcttcacatccaggtggagagccgatgagtgaccataccgttctggagcatccgctgaatgtgaacggaatgattacagcgggcgcgctgacactggacattcgctatgacagtaaggtatatcatcagcaaaatgtagaaaactttgcgcagttgctgcaggaaagcttgcaggaagtgatcgctcattgtgcctccaaagagcggagtgagctaacaccaagcgatgtattgttcaaaggcttgtcactggaacaactggaacagttgacggagcaaacttcttctgtaggcgagctggaaaatgtgtatgctctttcgcctatgcagaaggggatgctgttccataatctgatggagccggagtcaggcgcctacttccagcaagcgtcgtttgatcaaaagggcagctttgatgttgcaattttccgcaagagtctggatgtactgacacagcgtcatgaagcgctgcggacgaatttccatatgtttgagacaggacacagtcaggagccattgcagatcgtattccgtcacaaagatagcgacctttccttccaggatatacgggaaatgcaggaagcggagcaacaggcgtatatccaggcgtttaagctggaggaccaagctaggggctttaatctcggtaccgatgcactcatgcgcgtacaggtattacagacccatgaagaaacgtatcatttggtatggagcttccatcatattgtcatggatggctggtgcttatcgctcgttacgggtgaagtgtttagtacgtactttgcgctgctggagcagaagcagccggagcttgctcctatcacaccgtatagccaatatatcgaatggctagagcgtcagaatgaacgtgcggcaaaagagtactggagcagctatttggcgggctttgaacagcagacgttgttacctggatcggatgcttcatcgaaaaaccaagcggctaatacggtatccactacagcaagtgaaaccagcgaatatgtttctgaaaaaataacggtagatctggacccaacgtggagcgaagccatacaccggattgcaaagcagcagcaggtcacgattaatacgctgatgcagagcgtgtggggccttattttgcagaaatataacaacaacgaggatgttattttcggtagtgtcgtatctggacgtccaacggatattgctggcgtagagcatatgattggtttgttcattaatacgatcccggtgcggattcaaagtgaacggaatgccacttttgtggaagtgatgcggaaaacgcaggaacaggcactggcctcgggagcctatgacagcttcccgctatatgagattcaggcattgaccgagcagaagcagcatctgattaaccacattatggtattcgagaattatccggtagaggagcaagttgagcagctgggtgaagttcgtccgtccgcttttgaaattacgaatgtagaggttgtcgagcaaacgaattatgatctggacttgattgtgatgcccgatgaaaccttccgcatcatgttcagatacaatgccaatgtatacgagcggtctacgatagagcggatgcagggacatgtactgcatgtcatcgagcaaatcgtgaataatccgcatatccgtgtgaatgagctggaattggtaacaccagaagaacaggcacagatcgttcaggtctggggggatacgacggcagcctatccgcaggatcaaacgctaagtgcactgttcgagcagcaggcagcgaaaacaccggatcaggtggcagtattgtgcggatcggaatcgttgacctacgcggagttgaatgagcgcgcgaaccgtttggctcggacgctgcatgcggaaggtgttgaaccggatcagccggtaggcatactggttcagcgttcgctggacatgatcgtaggtatttatgcgatcctcaaagcaggcggagcctacgtgcccatcgatccagaatatccggcggaccgcatccgctttatgctggaggattcgggtgcgaagctggtgctgacgcaatcgcatttggcggagcaagcaacgctgagtttcgacggccaggtgctggtgctggatcgtcatgagcaggatggacaaggcatttaccacgaagatggctcgaatctggagccactggctggaccacaccatgtagcctatgtcatctatacctctggctccacggggaaaccgaagggcgtgatggtggagcaccattccgtgctgaaccggattttgtggatgcatgatcgatacggcttgagtgcagaagatacgatcctgcaaaagaccgctttcacctttgacgtatcggtgtgggagctgttctggtggtcgctggtcggctcaaaggtgagcttgctgtcggtaggcggggaaaagaacccggaagacatcgtcgacacgattgcccacgatggcgtgagcacgatgcactttgttcccgccatgctgcatgcgttcctggagtacgtggagcagcagccacgggaagtgatgcaaacgaagctgggcacgctgcgccatgtgtttgccagtggagaagcgttgccgccacagcatgtggcccggttccagcggcttgtgtcgagcttggccggagcgaagctggtcaatctctacggcccgaccgaagcgacggtggacgtatcgtacttcgattgcgagccggatgagaaatatggagttattccgatcgggaaaccgattcagaacattcgtctgtacatcgtgaaggaaggcacggagcaattgcagccgatcggggttgcgggtgaactgtgcatcggcggtgtcggcgtagcccgaggctatctgaaccgtccagagctgacggcggagaaattcgtagccgatccgtttgccggcggggaagccggctatgaacggatgtaccgtacaggcgatttggcgagatggatgccagacggcaacattgaatatctgggccggatcgaccatcaagtcaaaatccgcgggtaccggattgagctgggcgagatcgaatcgcagctgctccaagtggaatcggtacgcgaagccgtagtcacagctcgtgcggatgaaacaggacaaaaacaaatggtggcgtactatgtcgccgggcaagaaatgggtgccagcgagctgagaagtgagctgggccgggagctgccaagctacatggtgccgtcgtactttgtacagctggagcaaatgccgctgagtccaaatggcaaaattgaccgcaaagccctgccagcaccggaaggcagcctgcaaagcggagccgattatgtcgcaccgcggacgtgggtggaagtgaagttagcgcacatttggcaggatgtgctgggcctcacgcaggtcggtgtgaaggaaaacttcttcgagattggcggacactcactacgggcgacgacactggcctcgaagattcacaaggagctgaacaagccgcttccactgcgcagtatttttgaagcaccaacgattgaacaactggcagtcgtactggaacagctggatcaagtaacctatgcgtctattccggtaacggaagaacgcaatttctacccgttatcttcggcgcaaaaacgactgtatgtgctgcatcagttcgacccgaatgatgtgaattacaacatgccgtcggtgctgcaagtgagcggtccgctggacgtgaaacgagtagaagacgtgttccgtcaactgatcgatcgccatgcaaccttgcgtacctgctttgagctggtggacaatgagccgatgcaatggattgaggacaccgtgccgtttgaagtggaatatacgaaggtacaggcagagcatgcgactacggatacagatcaggacacagctacagctacggacacgacggtcagccaggaagcacaagaacgggtacgacagtttgtccgtccgttcgatctgaaagctgcgccgctactgcgggtaggcttggtggatctgggcgcacaaggagcagagcaagaaccccagcaactgctcatgctcgatatgcaccatatcgtttcggatggtgtgtcgatggaggtactgaccgatgaatttgtccgcttatatggcggtgaagagctaccggcattgcggattcagtacaaggattatgcggtatggcagcaaagcgaagcccatcaggagtggatgcagcgtcagaaagcgtactggctgggtaccttccggggcggcgtgcctgtgctggatctggcaaccgactttgcccgtccggcggtgcagagtacggcaggggatacgatcgaattcggactggagcgtgaagttagcgaacgcctgaaagaactggcttcgcaaacaggttcaaccttgtatatggtgctgctggcggcgtacactacgctcttgcataaatacacaggccaagaagatatcgtagtcggcacgccgattgctggaagaccgcatgcggaactggagagtctggtaggtgtcttcatcaatacgctggcaatccgcaattatccgtctggcgaccaatcgttccttgattatctgcaagaggtgaaggagcatgcgctcagtgcttatgagcatcaggactatccttttgaagagttggttgaaaagctgaatttgacgcgggatacgagccgaaatgcgctgtttgacacgatgtttgagttgaaaacattggagcagcaggagttgcagctggaaggtctgaccttacattcgtatccgctggaaaatcatacggccaaatttgatctgagcttggatgcaatagagcagccagaaaacattctgtgccgtctggaatacagcacggcgctgtataagcctgagacgattgcgcgattggcacagcattttaccgagcttgtacgtgcaatttcacttcatccacaacagccactggcagctttggatatggtacctgccgaggaaaaagcacaaatcatccatggatttggagatgtgggggtatcggatgttgctgctgaagcaggagccttattccatatcttagtggaagaacacgcgcagcttgtaccggatcatgtggcggtggtgtacgaggagcagcagcttacgtaccggaaactgaacgagcgtgcgaaccaattggcgcggagattgcggaacgaaggcgttggacgcgagtcgatggttggcatcttgagtgaacgctcggtggatatgttggtcggcgtactggcggtgtggaaggcaggaggcgcgtacgtgccgttagatgcggattatccgtccgaacgtattcgtttcatgctggaggacagtggtgcgacggtactgttgacccaaacgggcttgcaggagcgtgcactgggttggctgaatgaaagccaatgggctctgagcgaaggaaagaatgagagtgagctggatacggcggttagcgctgaaacgatggaaagagaccgccttagtgaaggcgtaagcttgaaatcagattcgaagtctgacagcgaagcagcatccgaatccgcagcgaacttgcgtctgcataccgtgctggtgctggacgatgagtcgctgtacatcggagacaccaccgatatcgagcctattaacgaaccgcaggatctggcgtatgtcatttacacgtccgggacaaccggacgtccgaagggcgtcatgatcgaacatcacagcttggtgaatacggctgcggcgtatcgccgagattaccgtctgagcgagttcccggtacgactgctgcagctggcgagcttctccttcgacgtgttcgtcggggatatcgcgcggacgctctataacggcggcacgatggtcatttgtccgaaagatgaccggattgattttagccgtttgtatggctggattcgcgattaccagattaccgtattcgaatcgaccccggccctgatcgtaccgtttatgcagtatgtgtatgaacaggggctggacatgagcagtctggaactgctgattaccagctcggatagctgcagtgtgacggattaccgggtgctgcaagaacgatttggcgcggatatccgcattatgaacagttacggcgtcacggaagcggcgattgactccagcttctacgatgaagatctatcgaagctgccaagcagcggcaatgtgccgattggtcaggcgtggctgaacgcccgcttctacatcgtggacagccagctgaatccggtgccgatcggcgtactgggtgaactgtgcattggcggagccggggtggcacgaggctacctgaaccgtgcagacctgaccgccgagaaattcgtagcgaacccgtacgtaccgggtgaacgattgtac

SEQ ID NO: 22 - DNA, 50890 bp, Unknown
  Kingdom: Bacteria, Phylum: Firmicutes, Class: Bacilli, Order: Bacillales, Family: Paenibacillaceae, Genus: Paenibacillus
ttgaaactgacgagataaaaatatctcttgtttgattttgcgaacaaaatcgttttactcactcgttgttcagttttcaaagatcaatcatttccggccatatcaacaccgggaataataatatatcatacttcgacgattcatgctactggtaaataatacctcgtaggtaatcctttgaatttttgaagtccatctaactatacatcacagcctatcttacgaccggatacataatatatcatttaagtttgctgattactacatgtaaattataccaattaataaccgagttatcaaaatcagttctattactgtactgcttatacttacgaatttgtttttcttcattaaaggtaccgtgaatctttgaccatatctactgcatccgataaatgcttttcatgaatagcagttagatatcttgtgacgactttttgggcatcatgctcttgatcaacagtagcgtcgaaagtagcctggtatttggccgaccgacacaaacataagccatatctactatatgatgcatcccccttttagttccaaaaaagggaccattaatactgaaacgttccaataattatttatacacatttggggacgtgaaatagactaattcattctcgttcctattaagcatgcttttaggaacgagaatgaattgtattttttttacattattgaggtatcgccagcaaacacggttttacaacgttaaggagccttatattgaatttcgtgaatccgcctttaataatggatactaacccacatcatttaaggcagatttattgatccaatcggcctcaactagtaagttggtcctactagacctaacataaaataaaaaaggctgccacggcaacctttttgtttcaactaatgtacccgttagcgtatcagtgcgtattttaaaatttgaaattccttttaatagcattcgaataaaagattttatccgtagctttttcatcaaacaaacgctgaatcaattggttgttcgcacatactcaaaaagtctattcgctcttgaatattattctaaggtatctgctccatcataaacactcactattccactctataaggcttgtagaaggtacgaatttcttgggctaaaagctctggctcttccatggccgtaaaatgtccaccacgagccatgatagtccagcgagttatatttaaattgcgtactgcccagttttttggtggtaatactatatctgctgggaataatgcaaccccagttggtacttttatatagcctaatgacggcagagaatgtgaattttcgtaatacatctgcgttgacgacccgattgtgttagtaagccaataaaccatgatatgcgtaatgagttcatcttcgctaaatctttgacggaggtcacctccacaatcactccaagctcggaatttttcaataatccaaccggctaagcctgctggtgaatcagaaagtccatacgcaagagtctgtggacgtgtcgattgtatcgacatgtaccctccctctagagaaagccattctaatgctcttttcttgtattgaagttcttcctctgaaagttttacctgctcatgggacgtaagtagatctcttatgataccaatatctgttaggtgaatcccgaataaaagttcaggatggttcgatgccagatatctcgtaactccggaacctatatccccacctgctgcagcaaacttatcgtatcctaattcttttgtcattaatttagcccacatctcggaaacctgataattgttgacaccaggatggtcaggagagctagagaacgcaaaaccaggtaatgaagggacaatgacatcgaaagaatccttaggatcacctccatagctagctggatctgtaagaagaggaataatcttctgatatctaaggtaactatctggccatccgtgggttagaataatgggcatgggattgggaccctttccgtactcatgaacaaagtgcacatcaactccattgatcttgcagcgaaactgggaaaaacggtttaactgagattcttgttcgcgccaatcatactgttctcgccaatacgaaacaagggattttaaataagttaaatcaacaccttgatcccagcctgagttttccaattgatccggccagcggatgtggtgtaatcttcttttcaaatcatcaaggacttcatctgcaatgtgaatatgaaaacgttcaacggacattatatttctcctccttttttgcgcacatcttaatgatatcccttgaactgctgtggtactatgctaaaaatcgggcatctttttcgccgtggaggactttagtaaccttccttatcctcaacgttttacaattatcttaattacttcatccttttgttatggtttccaatttctcaacaccatatcactttccgaagcgctccgattttatttgcttggtttttagactaatgtaaatggcagccgatcttctgaatcagctgtgcctctatttatttatcgagattacttcgtcacgctatcctgcccgttagatcaattcaaattttgccccgaccagacttacccgggctatcactaaggaaggcctgttttgggttaatgaatggacaaatcggaaataattcactcataccgtctaaaggagggaacaaattcatgaattctaatgataatctatcagagcagaatgcatatttgaaagagctgaatgccttatttatcccattggacggaatggagaatctagaccgcatagttaaggccatcggtgaggcagatattgtgctgcttggcgaagcgagccatgggacatctgatttttaccgagttcgggccgagctttcgaagaagctaattgcaagcaagggatttaacattatcggcgtggaaggagactggccctctgcttatcgattgaaccggtatgttaaagggatggagggggccgattcttcggcaaccgatgcactgggtgattttactcgctggccgacctggatgtgggcgaatacggatattcgtgatttcgcggagtggctgaaggattacaatgaggtgaatcaagggggcggcagtggctgtcccaaggttggattttatggcatcgatatgtactcgttatgggaatcgatggaggcaatcatcggttatttggaggagaccaagtctccccagctggaacaggcccgcaggacatatacctgttttgatatatatagcagggaccatcaggcttatggcattgcggcaggattgctctcggagagctgtgagaaagaagtggttgagctactgaagcagattcagagccggcgcatgacgtatccgggaagtgaggaagagctgaatgcggaggtgaacatgctcgtcacttccagttcggaggcctattatcgtacgatggtccagggaggcccgcagtcctggaatatacgggacagacatatggttgaatcactgaagcgaatcatgtcctattacggcgcctcggcaaaggccattgtctgggagcataatacgcatatcggtgatgcgcgggcaacggatatgatggctgatggcatggtcaatgtgggtcagctgctgcgggaggatccggaacatcgtgtgtttgccgttggcttcgggacctatcagggcgaggtactggccggaagagcttggggagctccggttgagaaaatgaccgtgccacccggacagccaggaagctgggagtattgcatgcaccgggcgggaggcggccggaatggcgtggtaatgctctccgatgcatcttccatgctgcatacggtcattggccaccgtgccatcggtgttgtatatgagcctgctcatgagcgattcggcaattacgtgccttccagcatggcggatcgttatgatgcgtttgttcatctcgaccagaccatctcccttaagccactgcctatccttcagccgattgcaacggatgctttattttcagaataacagctcgcaagaaccgtctgtgggatgcagggtagctgggtatagtttaccgtcaggctccggattataattataagactggctccaatataaaacagcggcaggctcagactttgtttttatcagtctgagccttggtgaaaaacgttatcttcttttgatggacggtacgtcaattcaactgctcccgaatgtaaggtcttggtatagacatgcttaagagacatcgtcttgatgttatctgtaaacaaacgctttccactcacccatataaacggaaagatcatgatccgaaactcgtcgacgagatcatgcttcctaactaactcgccgcttccaagcaccaagatgttacttccgggttgctctttgaggttcaaaacttcttccttgagatccccttgagacgagggttgcgttccaattcatctggtgttgcgttttccttctttaaaatgattcgatcaaagaatccagtttcagaagtgaaaacttcttatcaccccattataatactttgattcaagagatacccaatctaatcacgtatggttcctgtgacaaaactgtcggatactagttgctagttcttccgcatgagtaaggacaagcatatgatcagctcctttgatttcggcaaacctaatctcaggtacacgcttgaagtgctcggcgatattatacatatccggccattctattgttccttgtataaataacgtactcgctgcaatgttctctaaacgttcaatcgaaggcggctctggccaaaggacatcaaagctcctccactcggtaaatacccttgtcatgtagtgagtatgcatttcactcagaaatctccggtgggggctagccatcgtagcccgatagatcggtccggctaaagacaactctacaagttttgaaatatcgggagcggccgcattcaccgatgctatataattggtaaattcttgcgaatatgcaaaccccgttaatgaaggggcaatcaccactagccgctcaaccatagaaggatatgataacgcaaaatcagtcgcgacttgcccaccgatggaatggccaacaagtgtgacaagatccagtccgagatgttcgagaagtttgcgcaaatcctccacaagtgaagtcggctcttgcatagcaggcgagcggccggttcctcgaccatcgaaggtaatgaccttgaatgattttgccaattcaggcaccatatatctccatacccttgagtcgacacctcccgagtgaatcatgactatagggactccattcccttcgatttcgtaaaaaagttccaccttgttcccctccccagtgaggtaatattttcttgattagcattttaatcatgactgaacatacagtctatattaaaaaaagatatccacatcgaaaaaaaacaatatctcattgaatgccgcgtgatttgcggcttggagagctactttacgtaaatcagaagttcttacaagacttaaaacaccgaaatccttgagcgggtaaaacttacattgatatgaagtcactttgaataactgccctttagttgaatagcggcggatatcaaaagcgaattcttcgctattacgtgctaaaaaaatcggtgataaagttctcttttctgtaatgtactccaatactagttaatctatcattattttatatgacaataacatcaactttataaatgcttcttttgattttatgcttagtaattgagttgaagatacatatttcctgtcttgatgattaatacaagtaaatcacgtttacaaaggacaaaagacagacagaagattataaattcactaacaatttagggtaaacgtaacctaattgaaaccgcccatccaataaccggatgggcggtttttacatactactttcctgctcctttatcacctgctcaacccccaacagaatcagcttcaatccgaactcaaacgctccgtcggtccccatcagctcgaacagcccgttcgtgaacatcctccggaatagtcccacttctgtctcgctcatggaattcagaaggtgaatcatctcctcacccggaagcgctccctggtccttgaggatagcggagacattacgctcatgctgataatcgtctaggacgaagtaggagacatagttcacaagcgtagtaaccacttgtattttctgctcttgctcaagcggcgtcgactccacgcagagtagcatacggttggtgaaccggatgatgtccggttcgtggggcagcgtcatcatcatgagttgcgtggagcaggggtaccggtagagcacactccgcatcgttaccgcaagccccgtcagctgctccttccagtccccctcggaatgaaactcctccagaatcattttcgatacctggttggccaagcgctgatagagattctgcttgctcttgaagtaccagtacaaagagggagcctgaatccctagccggtcggccaatcgtctcatactgaatttctcgataccctcctctccaagaagctcccacgaggcttccaaaatcttatcctccgaaatttgaggctgcttttttttcatcggtatccgcccttttatctaacagtgtaagtttatgctttacaggttcataggttcatgatatcatctaacactgtaaggcacaacctaacactgttagactgaaggacaaaataaataaagaaagtagtgactcgcatggatgcagaaaacctccattactttgaaaaagcaccggtcgcaaaagccgtagctcacttcgctgtaccgatgatgctaggtacgtcaatgaatgtcatctattccatcttaaatgcctatttccttggtacactgggcaatactgccatgttaaccgcactcgcactaaccttgccgttattcgcgatcattatggcactaggcaacttgataggcatgggtagtggcacattcatctcccgtttgctgggagaaaaaaaatatgacgatgtgaagcatgtgtcttcattcgccttttacagcagtttagttctcggtcttatcgtgatggcggtcggtctcccgttgatcgatccaatcgttcatggcctcggggcaacaactagctccttcggattcacgaaggactatgtcacgattatgcttattggttcaccattcgtcgtattattcttcacgctggagaatattgtgcgctccgagggtgcagcaatcacgtcgatgatcggtatgattctcagtgttgtcgtgaatattattctcgatgcgctagtcatcttcgtcttccattggagcgtgatcggcgttgcgtctgctacggtcatctctaatttggttgcgagtgcattctacgccttccatatgggatataagagccaattcttaactgtctccgtaaaatggtttaaggctaccacggatattctgagcaatgtattcaaaatcggagttcccgtctttgttatgagtatcttcttgggtgcaatgtcgctcatctttaaccattttcttgtcgattatggggatcaggccgtagcggcttacggaatttcatcgcgcctattgcaatttcctgagtttattctgatgggcttatgcgagggagttgtgccgttgattgccttctcttttacagcgaataaattacgcatgaagcataccattggatttacaatcaaagctattgtgacgttagcaatcgtgttcggtgttatcgtctatctgatttccgaccacttaattggtttatttacgagtgacccgcaattaattgaaatgggtagctacattctacatgtgacgttcttatccttgttcattacaggaatgacctcgctgtttaccggtatctttcaagcaacagcgcaaggaaccgccgcgtttattatgtcagttattcaaggagttactctgattcctgtgttgtatattgctaatcgaatgaacggattccacggggtggtctggtcgcttgtcatttcggatgccgttgcgttccttgttggtgccaccatgctgtatgttctgcggaccaaattgcagccggatttggataatttagtacagtagaaaacatataacatgcaagaaggcaggataaggacactccccgaccctgtcttctcggtggggtagaactgtattaacctaaactgcccgttagtttaaccttcatttgtagtgccttattcgactattctctgcgagctatacgaaacccttgatcgggaccaaagccattcgcatcgaacttgcctcggaatgatatctcgttgttgctgacgttgccggacatatcgtatattcctaactcgttgggtttctgggtacctattgattttgttttattattgttgctctcgatgataggccagttccagtctccagataagtacttgtctccggcatttttccaataccatgcgacctcgtcgtcattattgcttccgctgtatgtgtagcccttgctcgcctgacctccgcctgctgcatattcccactttacttctgtaggcaatcggtaactgttagctccctcgttgatcgttgctgtccattttatattatcgttatcattcttattgtcgctattaaaataaatattaatagctttctcatggatagataacctttaagctgataggaaaaatagtaggccgtgatggcctgcaactcgcctccagcagcgtcgaaggccgttcgcctggcaggaaacggccttcaacgcatccgcactgacggatagactggaggggaacggtcatcggcctgtctacaatacttagggctcggtgagtcctccatgatcgattcatttaaaccctatctatacagacagctctcaaaacccgcttatcccgtgagacagtcccaaccgcgcctgttcgttgaacagcttgcagttgagtggttaccacaccgttacgttagagctcccgctactctgaagcccctctgtcgccaacatctggtaagaccagttacttcccagattcattcctttgctcgcccatgctttcacgtggttgctgaaagtgattgtggagttgcccccggtcggtctcttcgactgtcgaacactccagtactgaataaacgtcgttttttcgccttcaatggaaggtgcgtcgtatcgcattgttgtgtagatgtcatatgtgcccccatcactggtcaccgtacctttatacgttccggtaggtcgataagtaccccagctatcaacgacgtaatattcgatgagtgagtttctcgtccatccgtagagagccaaatatccattaccggacggcgcccagacaccggcattgtagttgatcgttctgtttggcgatccagtagtccagcctttgccgacgacaaaattcccggtatccttccatgttacgctgtaattaccgcctgatccattaacagcattgactgtcccaccgccatcggtccaattttgccaatagtctgtcgctgcacttgaggttgttgcaaacaacccaaaactcatggaagctgcaagaactaccgtcatcattttcttactaaaattaaacatactctacctcctaaaattttgtgtttgtcccatacacttgcttgttggttgattctctttgcagtatatcacctatacgttccatattccgtaattttttttactttaatcccctttctgagtgaaattatagaatactagcgtttgcatataaacctagcaaattaaagctttaactctattatgtttagctttctttgaattttatagaataattccaatattacagcgatgggaagcaccacccgacagcctagtggcgcctcatgtacatttttaactcagcttatatactaaaaaaaatttatgcaaataacgcataaatatcaatatgcatctatcacatgcagtaaaatgtgcttgggtgattagcagtgcataatgggaaatctcgattcacgtgaggacaaacacttaacttttcataggaggtttgataaaaaatgattttagaggatatgtattatgggaaatggcgtcctagtgaacaaataaattcaaccgaccctgaatcgcaaaaagtgaatcaaaaaattagtgatctcatggagatgttgaaaagcaaattaccagcagcattcattcacgggtaccgggaggggcattaacgatgattgaagtatttagcgaggacaaggaaattgttgatcctaatagatagataatggaggagttatggtggtgagcccgctacgcatgcagattgttcttccgatcgctgttatccctagatttctcctcagtagaatataaacttaaaggtaaaatccagggatagctgaacgaatgaattattttaagagaatttcagacgaatggaggggctgcctagcctcttcctgcgcccagcgcattcatcaagaactcataaatttccagttcgttgattttatcgccatcggtcactatgttatgctgaacttgcagtccgttcttgaacacggtgaacatccgagctgtcctgtccgcatcgattgaaacagggatagctccattctgctgtccgacttcgatccacgttttggcagtgaggatagatgcttcatgataacgtttcagaatgccagccacggcgggcttatcctgttggctgagtagataaataaaaatcaggctggcagcgctgtccccactaccaatgttacgaaggcgttcagttaaggtgttaagcggggatttgattccttctggtcctgcgggagtccgggcgacagattcaaaaaagcgctgattggttttctccattcccgcctccagaatcataccgaacaattcatctttgcttttgacataatggtaaatggctcctttagtcagtccgctgcgatccgcaatatcctgtagtgtcgtcgcccgacagcctttctccataatcatcttttcggcaatctcaagcagcttttttagactgtcgttcatcgctttatcttgcataatcttttacctcccgtttgtctgtctttttattcgtctaatgaagctcatattccaccaaatcgtcaatccaataagcccataggtgaagaacggcgatacgaccagaaaggtcgatatcgacatcgaatacaccagcactactttgatgaaggcttccaacagcaggctaaatccccacaccgccgttatcaggcgaaagttaaaccgatagcgcggaagtccctcccatttatcgttcatctgaggatcatggcctgtaaatctctcggcaaaataataaatcaatggtcggccaaaaacagcgagcctagaaacaccattcccataataccagctacataagactcacgcagcaaaatgaagcgttcatcgccgcccaagagaacggccacgacgccaagaatcaggccgagaaagatgaaaccggagaacgcatccgccttgcgcgtccgtataaggctgtagagcgagtcgcatagcggtacgagggcagcgatggacagagcgatcagactgcttgtgtgcggaattaacaaacggtaagccagataaggcagtaaaatattgatgattaacgtaaagatgatttcgttgcgagatttattcatgatcgactcttcctctcatcattcaaaacctaccttcggtaggtatctttcattttacataccttcggtaggtatgtaaagattaaaaataataatctgtatacgaacctcaatctacatattgcccaaatgtggctacacagttcgcatactctataactacaaaaaggagatggcgtttgccatctcccttgcttttattcttccctcatacttcctgcttaaaaacatattgctcacagacacacactctaacaagcaactatttttttaagcctccacccgattcaaaaacaccttggtccgttccagctgaggattgccaaaaatctgctctggtgtaccggattctgcaatttcgccattatccataaaaatgacacgatccgccacatctctcgcaaagttcatctcgtgggtcacgatgaccatcgtcatatgttcctcagccagctttttgataactcgcagcacctcacccgtcagctcgggatcaagggccgatgtcggctcatcaaacagtaaaatatcagggttcatcatcattgcccgggcaatcgccacgcgctgcttctgtcctcccgacagtcgggatggatacgcatctgctttatctgccaatccgactttagccagcaactcagcgctttggcgacgtagctcagccttgctcaccttcttcaccagcttcggagccagctccagattatcctgcaccgtcaagtgagggaacagattaaaatgctggaacaccatgcccataccggtggtaatgcccttaatgtcacctgccggagcgtactgaccgttttccaccagtgctttatcatgaatgcggatcgtcccgcctgtcacatcttccaggtgtaccaaactacggagcatggtactttttcctgaacctgaaggaccgatgacggctacaacctcgccggctttaacgttaaagctcactcttttcagaacgtcgagcttgccgaacgattttttcaaatcggttacttctattgcattagtattcatatcccgacattccttttactcgaatttaaaacgtttttccagcgccctaaagaatagcgtcagcaccaaagctaacaacaaataaataaccgccgctacaacataaggtacaatcgagaaatcacggtttacagccgtattggcaaaatgcagcagttccggtaccgctactgcatacagtagtgccgtatcttttaccagtgttgtcgcttcattggttaccgcaggcaaagcaatccgtaccatttgcggcacaatgactctaatcagtgtctgcgacttgctcaagcccagcacttgcgaagcctcgtattgccctttatcaatcgacaacatcccgcctctaaaaatttctgcaaaataagccgcataattcagtacaaatgccagtaccgcagccgttgtccggtccaataccagatactccccaatgacaggcaacatcggcagaccaaaacaaaagaacaataattgcagcaatagcggcgtaccacgtataacataaatgtacgtatgcatcagccaggcgattggcttaatccggcttttggccagcaacgtaacgataaaacccaatggaatagacaagatgagcgtgatgaaaaataaaataaccgtcatctgtgccccttcaagcataggcttcataattcgtaaaatatattccatactcatgaccttcgactcctaaacccttagttcaatacactacgtattaatttaatactttatcttcaccaaaccactttttcgaaatttcagcagcttttccgttcttgtgcagctcatccaaagcagattgcagctgcgtcaacagctcttcatttccttttttcacgccgatgccgtattcctcaggggccaatgattcatcaagcagcttatacgtcccttgttccttggacatataatacttggcaacgacttcatcaatgacaaccgcatccagacgtccggttttcaggtctgtcaaagcgagaacattatccggatactcagacacaggcttcaatttacttttgatcggatttgcatccaatgcatcggctgctgaagacagcgtctggagtcccaccgttttgcccgccagatcagatagcttggaaagactggaagtagccggaatgacaatcacctgactgtttttcagatatggcttcgtgaacagcactttttccttacgctcatccgtaatggtgtatccattccaaatgagatcaatacgtccgctgttcagctcggattctttggcagaccagtcaatcggctgaaattccacctgtttacccatttgttccccggccgctttcgcataatcaatgtcaaaaccggtcaactcgttattttcatctctaaagcccatcggggcgaatttatcatcaattccaataatcaatttactgtcatccttaccgccggaacatccggctaacacgatcatcatcaatccaatcaacatcgtaaacatggctgcttttctcatcttattcccctccaacaatggtgacccccgtatccaagaacaggtggcaaacgctttagttcgttaacacgttatcagagtatcatcataacatacggcaggatactcgtcgagaggaataagcggaatcttagccttatataaatggaaaacctgtgacgaaaatttgacctgtgttctataatgtaaaagcttaccttgacatgtcacctaaaccgtcttatcatttcctagtattcttatatacttttatttattttaaaatttgaacagcaatagtatgtaaatcagcttgatagataggagaaataaacccccatgtacattttaaaacgtctctttacgatgttcattacgttgtggattatcgtcactttaacgtttatcatcatgcacatcattccgggtgatccgttctcgaacgattccaaaaccattccggaagcggtattgcaaaacatgcgtgccagatacaacctggacaagccgctcgctgtacagtatgtgctgtatctcaaaaatctgctagtgctggatatgggcccgtctattcaatcgaaaacgacggacgtcaatatgctcattgcccgaggttttccaccttctgcattgctgggtattcaatccatcgtggtcgcaattattgccggtatttcgctcggaacgctagctgctctacaccataatcgaccactggattatatctcgatgtttatcgcgattgttggtatttccgtacccagcttcatattggcaccgctgttaatcaaatatgtcgccgtccaatggcatctgcttccggtcgcctcatggggaacctggcagcatacggtgctcccgtcgctggctctcgctgtttcaccgcttgccgttatcgcccgctttatgcggacgagtatgctggaggtcatgcatgaggagtacatacgaactgccaaagcaaaagggttgtcctcttgggcattagtccttcgtcacggactacgcaatgcgttgattccggtgctttcctttatcggaccgctatttgcttccgtcattacaggtacctttgtcgttgaaaaaatattcgccattcccggcatcggtaaatacttcgtagatagtatctttaaccgggattatccagtgattatggggacgaccattttctacagtgccattctggtcgtcactttatttctaattgatatatcctatcgccttgtcgatccacgaatcaaattagtcagcaaaggagattaacatgaaagcagcatctactgtcgaaaaggacagcctgttcagtcttgtagatcgtagccagatccccacccccacgttgaccagacccaaagaatcaccctggcgagatcggctacgcagactttttaacaacaagcttgctctgttggggctttccctactaatcatgattattgtgctggcgattgttggaccttccatggttccctatgcacccagtgatcaatcccttttgaaaacgaatctctctccttcaaaagaacattggtttggcacggatgatctggggagggacgtatgggcacggacatgggccggagccagaatttcactcatgatcggctttgccgctgccgccattgatttggtgcttggtattctcgtcggctgcattgctggctattgtgccgggcacggcaaaacgggcgaccgaatcgacaatgtcctaatgcgtattattgaaattctgtacagtattccttatctgctggtcatcattctgctgcttgtcattatgaagccgggactgctcacgatgattattgcattatccattactggctgggtcggtatggcccgtgtagtgcgtgggcaaatcttacagctgaagcagcaagaatatgtgttagcagcccgtagcttgggaacatctcattcacgtattatcttcagacatttgctaccaaacgcagcggcaatcattatcgtgaatttgacattcactattccgtcggctatttttgccgaatcattcctgagctttctcggtctggggattcagtctccttcggccagctgggggacgatggctaacgattcacttggcgttattttaagcggtcaatggtggcgcctatttttccccgggctgatgatatcgctcaccatgctggcgttcaatacacttggagatgggcttcaggatgcacttgacccgcgctcacaacattaacaatgtagagatcgaaattggacaaggaggggtgtcaccatgatccgcagcttcttgcctaaccgcaggaaaaacggcaattcctttatcgaagtgcgcacacgcggcatacctgcgggaaaggaggatgaataaccccggtacggtgtaccttatttttggcataattaatcacagtaatggaggaaaaccacgatgaaaaaaatgcattggatgacgatcatcttacttttggccgtaacggctttggctggatgctctggcaccacggacaaaacagcaagcaacgacccgtccgctgcgcctcaagcagatatcccgcaagaaattactgccaacctggcaggtggcgagccttatacgctagaccctgctttcgcatcagatacaacgtcctactttgtgattgataacttgtacgaagggctgtatacatacgataaggccggtaaaatcgtagaaggcgctgccagcaaagtaaacgtatctcctgacggtaaaacctacacctttacgatccgtgacggcgcaaaatggtcgaatggtgacccactgacagctaaggattttgaatactcctggaaacgggtactaaatccgaaaacagctgcctacgatccttctgccctctactacatcaaaggtgccgaagcttacaacacaggcaaaggtaaaattgaagacgtgggtgttacagccaaagatgataaaactctggtagttgagctgaaatcaccgctgagcttcttcccaacgatcgcagtgggtcatgcctatctgccagtaaaccaatcggttgttgagaaaaatgacaaatgggcagcagaagcaggcacaatggtcggcaacggtgcgtatgtagccaaggaatggaaacataacgagcagattacgctggcgaaaaacgatcaattctggaacaaagatgccattacaatggcaacgattaattttaaaatggttcaagactccacaacttattatcaaatgtacaaaacgggcgatctggatctgattttgagccttcccgtagataccctggatcaggaaaagagcaacaaggaattcctgtcgcatccatctttcagtgtgtatacctattcttttaacgtaaaacaaaagccgtttgacaataaaaaaatcagacaggctattgcctatgcgattgaccgcgaagcactggctaccagcgtaaccaaaggtggcgaaactccggcttacggttatgttccatacggaacaacaacgccatccggcaaggacttccgtgatgaagcaccgaaaaaatactatgagtttgacgctgcgaaagcgaaacaattgctggccgaaggtctgaaagaagaaggtttgacccagctgccaccgatcacctttaaatacaacacttcggacaagcataaaaaagtagctgaagcgattcaggaaatgctgaaaacgaacctgggcgtcgcagtgacgctggagaatcaggaatggaaaacgtacattgatacctttaaacagaagaacttccagatcgcccgtatgggctgggaaggaaacttcctggatccactcggcgtattggggcattatacttccaaaaattcgaacaactttaccaactggagcaacccggagtatgacaaactgattgaatcctcaacctttgagcttgatccggcaaaacgctttgaacagctccaccaggcagaagacgtattgatggaagatctgccgattattccgatccagttctctgcggacaccgcattaatcagtcctaagattcaaggtatcgtatttgatgctcgttcgaacccagacctgcgctttgcgaaacgggtcgaaaaataatgattttacgtttcgggatcactgccctgattgtcggtactttaggatttctgtacgccatcccccatctcttgtatggtcgtgaaaacatggctactgcaaatctgctattcctgttggggttgctgggcttggtgatcggtgcaatcttccacgttctgcaaagcggttttctaaccctcttcctgcggggatttgccgacatcagacagttgttcattcgtcaatccaaggcattacgggaggaaaatgaacgtttacgttccgatgaatctctgtcagcctggaaaacatccatgttccgccacctcaaggtatatacttcggggtgtggggcggggcttatccttagctcgatgatattaatggggataagttagttagggcgtatgaaagctttcttacggttggtgggcgctgcgcgtgcagattgttcttccgatcgcttcgcttcttcagaacaattctgcccgctccgctggcaaccgccgtagagcttctatacgttttagaggtgtgtaaagaaaagagagagtttcgcaaagcgtttgctagcggaactctctctttttttgtttcaataagtctaccatctgcgtcgttcgtcgcctctcaggggaaagtcgctcaattctccgagttggtcatgtgcagccttataaatgcgaagaatagcttgtaccttgttaaaatcattgtcttccgggccgaatccttccatatacattttttgaatgatgttttggaagaaatctatacgctcgcggacggaatcctgctctatttgcagtacctcttcaaagctgtgtgtctcagcaaaatcagacagctcatcaaattcctgttcctgatatcgatctccccgagtttcgggattgagatcaatagaggtacgcagggttgataataaaatattttcgcgcgccagcatgacatgaaaatctttgttcttaaacagatccgtaacgatcagacggcacatttccttgttctgcagtagaatcccgtcaaaaggatgcagcgtccacacaccgtagttgaaaaataaattaaaattgaagctactgcttccatactgatatacaatgttgattttcgattcgtcgatgatttcaaatgaaaattccagcatgcattctcctttgggattccaatatttaactctatcctatcagaaaatgcatgattttcaataaaaaattttatttcacagaatcatttaactccacaattgaatctgctttttcgctactgacagccacgagtaaatagacaatcacacaccctaaaataaaggacatcatacgctcgctctctccttttgtcattcgctttttaagagtttatgcacgagaatgctatgtatgttcatcatgtcctttattagctgctgccaaaccaaaaaaagacgcctttcggagtcatcctggcgtctttttcatagattgggtctattattctacattgtcatcagttcaaaaacgagcttagaccctcagaggaattgctatccttcagcggtttggatggttctttcccttcgatccccagacgttggctaaggttggcattgattgctgtcattttacttgtataatcgtggcagctttcaataatccgacggtttgatttttcagacagatccaaagcagataccaaatcaccaatcgcctgattcacagcctccagtgacatagaaggcttgctaagcagatctgtcgttctctcggtcgtcgttttgagaagcttcgcattttccttgaattgatcttcaatggtacgattggtcgcatcgacggctgaaatgattttatcctgatctgccagcgccatcgcgatcatagccgatacagtgatcagattcgatgttttatcaatcgcattatttacagaatcaatcagtttatcattattatcattaataatatccgttgctgcaatcgcctgattgtataataaaatcatttcagtcattgactgcgtacgagtaaccaccttgcgtaatccccgctccagatgaggcttacggttttcgttttccggcttggcaatctcggtctcaaacagttctttcaagcgattaccaaaggcaatcttcgtctgtaaattgtagatttcttcaatggaagccttcttcaactgtctcatgctgacgatgttttcttccagattatccttaccatctctcaaggcagtaatgattctctcgatgttcgtcttcaccgactgatacttgtaaatgtagttttttaacgggcttttacgcagcagcttgccaaaaaaactcatatttttgctctgctggagcgtttcgcattcatcacgtagctttaagatcatattggatacctcagcccgatcaccggacatgaggtcgtttaccggacgatccagcattttaagggtctgccccgcacgttcctgcgttttaacccccagcttaccgatatcatccattaaggtatccaggctcatgacatcgctttgtgataccttctgaatcagctgtgaagcctcctcagtcaccttttgttcatcctcttttttcaattcagcccatggggtcaccatacgctacctcctattctgaaaacaactgttacccaagtctaatcgttgttattcagagcagctattctgctactttttttattttctcaaaaaatcgcctacaattcggaactgctatatcgctggtgaataagctccgctttgctctgtaattccagcaaatccttgtgctccaccgtggacacaattaccgatattttgctgtccacatcccgtaatccgtttaataacgtcctccggttggtccgctttgcatcgccgctgagccgaagaaacggattaatcagtccgttcaaatccttcaaaatcaatctccgaaccgtatgattcacttcgctgttgttcagttcatgcaaaagcggaatgacccgctgcaaacgtgcaaatagagccagcgccttctcgacaatctcgttatcaagcgtatccttctgtccctcggagatcaccatatcctccagtacctccaaatactccatcacctgagcaaattcactgctcacctgatctggttgacgtacttgtcctgtcatagactccggtcgaacggtagcttccttttcatgctgctgtgtctcaccgacctgctcctgcaccaccggaatcacggaaccggtcagattggggcgaggatggcgaacggccatgatggcgctgtatcctcccaaaccaatgatcggaatcgccaaacacacaaacagtggcaaccaaaaacttagtaaaagcgcaaacaggtagctaaccacagcaatcgtggcaccccacatttttgacgtcatagcttgtacctcctgacgtaaacccttaccatattgtagaaaacaatatttgtgtgtgtcaatgtacggatttacgtatggtgattggctgctcgatatgactggctaaaatgtcgtattgcggatgaagtgaaccgatctcatgacccaaagccgatttcaccgctagataaggaaaattgatacccgacaaacatgatacatgaagtcctccggacatccgcggattgatctctagcaacttggcatgcttgccgttatattttacctgaatgttataattgtacggaatgtgatacgcctcagcgaccttctgtgccacctccaacagctcgaaatgctgctccagcagccgtaatcgtcctcctgctttcctacgcggaactgccgctagcagctttccgttccggtcagctaggcagtcaatactgtattcgtatccctccagcagctccatcaccatcagattgggaaatgattctgtagatgacaatacgcgatgtgcctcctcgaacgaaatatgattcagcgcatggccgaacagttcctccagcggattacgttcattgtcgatgatacgaaagcccatcccgccttctgcattacatggcttgaagcataccttatgcccatgtgctattaacgactcataagcctgtttaaactgctcggcattgctggcaatggcataatcgggaatcgtgacaatattcttttgacgaatggattcataaaacagatccttttccatcagttgctccagcagttcggtatcccggcataccattacttttgtcccaatagcatcgaacaaataaagatgcttgctaatatcgagcatattccaccgggggataaagacatcaattccgtgccgcctgcaaaaatcagcgcaaaaccgtgcgtactccacaccactggtgcgaggctctacttcagctatatcactggcctgtagcgccatgtgctgcggatcagagtgcgtcgcatagatctcgaacggaataccgtcctcattgttacgaatagcattcatataatgatacgccactgaaaaccagcggttaaaatacaccttaaccttcttcacagagccacgtcccctatctattctgaaaatgaagtttgagctgcgaatacactccggtgtattgcatgaacatacgccatgatttcgtccgctgcataaacccccgacacttctgtaaaacggtaattgacctccagcttatcccgtagctgttcccgatacaattcaccatgacgcggagcaatcgcataatcggcatagtccagcagacaacggtctagtaaagagtcaccggacgcaaccacggcccctccattcgtgagattgcggatgtgctccacggctgcttgtttattcacggccgcaggtaccaaatacaccttacgaccttgaatggatacctcccagcccatttcacgcatgattcgcgccttctccagcacctgttccagcggcatacgatcccgttcaatcatgaaagcatagaataactcatcgcaaaagcgctcgtttaccacccagtcttcatgcagcacctgtccgaacacctgacgtgcttcttccgcatgagcaccatcacggcgtacttgttcatgaatacgccgattccactctcgatccacctcgcctccgacgatgatgtttccaccattactcgtcacggcatatgcgggaaccaactccgtctgaaacacagtgattcgtctatactgttctatcgtccgagtcgtcacgggcataaacatcacatcttcaggcagtgtctttagccattgcagggcttgttcagaaataaaagccgacgtcgccccgtctatctgttccgcaggcaacagcccaggagactccagcggtacgccaagcgaacgtttggagtaaatcagtgtctgatccagatcacttgcgtagatcattcttgtccccccttgagcggcttgataattccgcagcaggaataagtcaatccttcaaatacctctacaggcactccacggtccttggccagcagcataatatgctgaagattcggattatcttcgcggtcaatcagaattttccacggcaccctgcgcagcagtacacgggtcgtctcccccactccaggcttgaccagattgatatctcgaataccaaatgcctgctgaatcgcctcaatatcccgtaagccttgccatgtcaccgcaggcggattcaatgtcatttgttcagcatatgcaacggccgtttcagccacgtcttgaaagtacccggataccgtatccacaaacgtattggactgatccactgaccgccaggattcataaaatttggccccatggaaatcgtcagggcctatgagatcgtcgcgtaataccgtccgactcatcaaacctgatacagtcgaattcagacaagcacttggaatcaaataatcttctcgtgtaccaaaggtttctgaacatctgcccggatcggccagcaccgccagatcatcatttagacgcaacccgtaatccgcgttcatctcacggcaggcctcgatcaacacctggcgaatcgcccctttccccgtccagccatcgacaaactgaagttcaatccccagcccatgctgctgtaaaatgtataaaatcgcattccggtcaatgcctttgccacgaataatagaaatgctgtaatgcggcaaggatacgctatacttccagtcaatataacgcttgatcaggataccaatgggcgtccctgctctagccagagaaacaatcgccgtgttcaggcctctttttctgacaatcatctcagccacagaagctgccgctaatgcaacccttttggcagattgggcaagcgtttcgtgaaacagtgcaatatactctgctgtgggctcgtattccactggtagcatttctgaataatggactcccgactgaatcgcctcttcacgatcctccgtccctttttccaacgtaacccggctcaaatccttcaataaaaaagtgacatccgaggcagaataactgcccagcggttcgggcggatgaatgttcttctgctgtatttgctccataagtgcttgcttcatatccgcgctcctttactctcctgtctggttaacccattaaaataaacaacatgcactttatcgcagcccagacgggtcaaagcctccagcatggggttcatccgctctgggtccgactccctttccatcaaaacgaatatttcgtcatactgaccggggtctacattataaataaaattgcgtaccgtactgtcctcaggcgaaggatatgtcacaccacaagcgacgccatacccttcttctcggtggggatacaccgggctgcgtgtcgtcgattgaaaatacacatccgggcctagctctgctgcaatccgcattgggatgtacatgaattctcccgtgcccataaccagcgtgcgttgcccagaacgaagttggttcagtcgttcagctgtacgcgtgatttctgtatccaatgctgaattgtcagcggattgtagaccaaaacggcctgtatattttagataaggagctgtattggcatacccgtctgttgacatggaactgtgtactacccgctcaaaactgggagtatccctttcaaaacggtggtcaattattccagaagcgtctttattaacctctgccatgctagtggctgcatgttctgagtgcccagcctgtccggcatatgctgcgtgatccaggatcggtacaccctgtacctctatctttcctttgagcaagcttaaaggcgtaatcgtaatgcctagctctgcctccagatcagcgaaagcctgctcgtcgctgtctgtccgccaatccaataacgaagcaatcacatactgtttacgcggaaaatgctcctgaatatcccgtatgatattaagcgttgttttccccgtcgtaatttcatcatctaccagcacaatcgggccatcacccgcaaaagcaccttcatccagtgcatagcaacgatgatcaacagcgtgcgaatgctcttcttcaaaccgaataataggtcgaaggtctggaatatcctcgcgcgtcgtatgaatatacgaggccccgtcgtcaaacaaccgatacatgctgtgtcccagtgctgtagccgtctcggcaaaaccaacaaacttgatcggctccgtaaaagcaaaagctaaacgttcatccatcagctttcggtaggcctctttcgcatagtccgggtcaagaagtcctctcacggcctctcctatcagttcgtccatctgttgtcccgcttgtgggacaagctccttatatagtagaatcgccagcgccgcaccactgagtagagaagtgtatgggtttaccggaatatgcttgcccagcaccttactgacaaataaaaacgaacgctttttgttgacccgtgccgccatcgcaaacagcttgtccacaggaaggcggaatggattatgtgtctccgtaattttaacgttgaactgctccaggattggcagcagatgtgttttcgtggttgggtaagagactgacaaaatgttgttgttcatgtaacaccccgtatacttttgatctattgataatacgatgagcccaattcatatgcggcttaatttcattcattttgttggcataggtacttttgaatacacccagactaccgtcgttacgctcaacaatttcaagtgcatccatatactcttcatgtgtcaccgcatacatggcctgtaccggtttaatatgggagggatgaataatcgttttgccgataattccattctctttgtccatcatgacttctcgaattagtccgtctacagcatctgagatgaagtccatccgcaagtgtcgtcccggctttccaagtgcatcttcgaaaggagacactcttaattgaggtttaaagacacgttctcggtgagagaaatattcccatacaggaccggaaataacgtaatttgagcctacgcgtccaaacaagttaataatatctgcgatgcaatcccgaatgacggcaatttcataaatcgtaatatccgggctgcgtctcaagccatatagactggaaaaatcggttgctccaatgcgtacattcaacacgtattcttggtactcgtctaaaatttctttaatcgacagtagctctttccagcgggattcccgataaatgattttggagctttcaagaatcggtaacccgtacagcacaggcatgttgttttcgtttcctgcccctgtatgcatactccggttatattctgcaatgagtgcaaaatacgctcgtccattatcagaagagaacttgggtaagacaaagcccgtgagcagcgacaaagattcacccaaaccgttcagtagtcgttccaactgctccacagagcgcacacgcacaaataacaaaggtaattgctgttcactcatcatccccgtccgtacataggacaatagttgaaacagctgctgcgccagcgattgttccgcctgcccgacctgctgatcccctatagcatcctccaaatctaaaatgaccgttgttagcccttcatgttttccatttttgatctcttccgctacttccgagcgggtcgctggcatatacaaagccgctcctatcgcataagccaatatacttttgggagaacggttatgaaactccgatggtggagtataaaagatcgcttctacttcctcagaggttaaatcattaaaatatttcagggcccttcccctcctcttgctctttcttgcctgactgaagccctgtgcttcgggtataaaagaaatccccccttagtttcaggagggatttcgctatactttgtacattaagcctctttgtcggcctttttctttcttttcgccgagctgataaccattgtgcctacaaagacagcaatcaaaatgccgaagaataaaacctgcgacatatgaaagtcaaaagcagcagccagcattttacccccgataatggcgatcataataaaggctgtctgttccagttccggaaatttatcaatgagcttgaggaacacttgagcaacaccacgcatcatcagaacgccgagaataccacccaggaatagaacccatactttctcgctcacaccgaaagcggcaatgacgctgtcaatactgaaggcaatatccatcagttcgaccattaatacggttttccaaaaagaagtaggtttgtttttcacttctccatcaccttcggacttgaataagcccttataagcgatatagaggagataagccgcacccagtaccttaatcagggtgaacttaatcaggaatgtacccaagccgatagccaggaacctgaatatatacgcacccaaaatcccgtaaaataaggctctcttctgttgttccttaggtaagtgtttaaccataactgcgagaaccaaggcgttatccgccgataaaagtccttccagcaaaatgagagttcctataatcccccaactcactggatcagtaagcgtagctacaacatcactccatgaaaagaaatggccgtagttttcgctgatatttttaaacaaatcattcaacatgaaaagagtgcctccgataattcaatttatttactaccctgcgaccagcgcatgccccagttatatgcccgatccaactcacgatggccgccatagaactgcacgagtctttcaatgctgaacgtttcatcgtttacattttgaatcatggcaattgcacacatccctttgcgattgtcatgttcattcatgtgaacgataatgtccggcccatccttctggtacagcgtgactaccccgtccgcttgtgaccagttcgtgactccttcatagatgaaggtaaacaccaaaattcgcttaatttcagaaattttagcaccattaatgcgaagattttcccctgttttcacagagcctgtacggtcgtcgccatccagagcaatgtacgggaagcgatttagagaaccgaaaacttccccgagcgcctgcacaacgcctttatctccgttcttcatctcatacaagcagcccagatccagatcgacacccttggaaccgcgattgaaaaagcccttgctttgctgcacctggttccagtttagattgatcaggatttcacccaatccgcctgagccttttttcaggttgatggtatcgcccttcttcttcagctcaattttccgcagattcagattcaccggtgttgcagatggctctggcttcggagcaggtggtactggtggcggcgttggtgctggccgaggcgctggagacggaggtgtaggcactggcgtgggaggagccggattattttccacttcaatcccaaaattaacgcacaacgcatccaatccaccggaaaaacctgcgccaatcgcgttgaatttccattccccgttatgacgatacaattcaccaatgacaatcgctgtttccacggtaaatccactgtccaaattaaaccgcaaaacctctccgctaaccggatgagcaaaacgaatgaacccaccttgaacctgtccaaaattttgccgtttctgatccgcatcataaatcgtcagtgtaaacgcaatcttctcgatgtttgcaggaattcgcgtcagatcaagggcaaattgctttttgtcaccggactgttgtccgtctgaataggtgataaagggcgtggtcggattgttataaaaaattaagtcctcatcgcccgatacttttcctccaggccccagcaaaaatgccgaagtatccagctccagagacgctggggactcccagccaatccctacgttgacatgggtcaggcccggatttgttttcgtcaaatccgccttctgtccctttactacgataacagccatgattgtgtcacctttctgtcggtttgtcatgtgccagcgtacgctaatgtaatagcttaaaaagaaagggtagcgccctatggacaccaccccaagtggatattattgagcgtccaagccatagtttttagcaagcgcacccaatccaccagcaaagccactaccgatagcctggaatttccagtccgcattctgacggtaaaattcacagaatacgacggccgtttcggtggagaaatcttctcccaaatcgtagcgcagcacttcacgatctgttgccgcatctaccacacgtacaaaagcattggacacttgaccaaagttttgcgcgcgagcctcgtaatcataaatggtaaccgtgatcccgatacggtggatgttcgcaggaatcttcgagaaatcaacgatgatttgctcgtcatccccatcgccctcacctgtgcggttatcgcccgtatgagtaaccgatcctgctccgcctgtcgggttgttgtaaaatacaaaatcatccgctgctttggctttaccgtcttcataaagtaggaaagccgaagcatctaggtcaaagtctgcgccaccactgtatttattcgtatcccatccaagacctacaacgacacgagtcaagccgggattcgttttggtcagatcaatacgttgtcctttggaaaggctaatggtcattccgcatacctgctttcgttgtatagatttttttacgccaaaccgtaatcgcgcgtcaatcctgcaagaccatcttggtagccgctaccaatggcattgaacttccactcaccgctatgacgatacagttcgcctacaacaacgcctgtttcgattgagaaatcttctcccagatcaaagcggaccaattcttcattgtttgcttcgtttacgatacgagcgtaagcacgggacacttgtccaaagttttggctgcgttcttgtgcttcatagattgtaatcgtaaaagcgatcttttcaacgttagctggcacgctacccaaatcaattttaatttgctcgtcatctccgtcgccatcacctgtgcggttatcccctgtatgaacgacagaaccgttctcattttgtgggttattaaaaaagacaaagttcttatcggattctactttaccttccgcattagccaaaaatacggatacgtccaggtcaaaatctttaccgccatcgtatttgtttgtgtcccaaccgagaccaaccataattttggacaaacctggatttgttttcgtcaaatcaattttttgacctttggataagttaattgccatgagtaagaaccccttttcacattaagttttgtatgagtaactaaaattacatataacgctgagccagcacatcaatatgtacggcatgggttccttcaccgattgcagcaaacttccattcgttgttatgacgatagagttctccacataccagtgcggtcagcccttcataattatcagataaattaaacgtcaccagctccttggaattagcaccatccagaatgcggatatacgccttctcgatcatgccgaaatcctgtttccggtttacgcaatcatatatattcacaaccacaagcactttgtcgacattggcaggaatacgtgccaggtcaatcgcaatttgttcatcatcaccgtcgccttgtccggtcagattatcaccggaatgcacgacagagccgcatggactttttttattgtggaaacatattacattgtccgactgagtcagtttcccgtttgcgtccagcaaaatggcagaagcatcacaatcaatgttcggttgcttcttgatgccaaaaaatcctttggactgcactgggtcccatcccaatccagctataaccttggttagtcctgtgttgcctttggtcaaatcaattttctggcccttgaccagattaattacagccactgattaacacacctcccttccgtaaaatttacagactaaattcagacggattcaaaccaagcgcgccgcaaatctcagccacaattcgctgctcattggcatcaaagtcaccatcagctgcaccaatggcactacatacgccaacgacgagtcggcctacttcaggcttgccattcaatttaccaatcgccttcagtgcttcctgcttaccgatttgaggtgaaaattcaaagttcgctacatagtgattgaaacggttgatgacctcacccatatcaaacactttcaattcttcactgatatttatgtatccggccatttttgttttctcttccggactaatcgtaccgtcagcaaatgctactaatgcacagcctgcaacaacagcttccataaaatctttattcttaaacttcttaacttggtctccaagtccttttttagttgtattcaaccaatttttaaatgtactcatgtttccctccacaattacgtatttgggtaaaggcatcctagttaatttcttcctttactataacctgaattacgatctttttctacaataatatacaaaaatacggtaaatccgatctatttattattggtatcctctctatctttagccctattttctacataaaactctctcctccatcatccatcatttagtaccccaattgcaagtctgtgaaatggtagagttgatagaaaggcacagccttccgatttagcagaagcactgtgcctctcaccaactccgaaaaaattggtaaacaaaaaaatctacagacttctccagctagcgagttgacagtttccaactgccgctcacttgttccagaaaaaaagactgtagattttatagatactcctattcacgttatcatcgttcacagctcacgacctagttataatcctcccaatagcgatactccatttcattctcacctttggtgacaacgaccatattttcaatatgtcccgtttctttattcgttcggtagatcatggtacgggtttcgccctcatcgggtacagagaaaagtactttgtcactgagcatgccgccaccaatgccgacgacgtgttccccccagccggaggctgcgccagaaccgatgcccgaacctgctccactaacaccagccccgcgcgacaaaataagacctattccatatccggtgacggtctgggccgttttacctagagcgtgctctccggaggattgggtatgcttctggacccagtaatcgtatttatccgtattttgctcataactcacaacattcccttttttatctatagatatatctgtcttgcttccgtctttacctgtcagttcggtgacggcgacaaggtaatcggatgtgatcttggaggtttctcctgtattgtaatctgtacgggtaactgagtcttcatattgcagccgcaggacattcatctgatcgtgaattttctgcataacttgcttgtcgccgatggcctcggcgtttttcagtagttcctcatattgatgatatttatccgcgtctgcctgatcccattcgtctatgttttttggaggcttggcgatatctccaccatgattcccagcctctcgactgcccgccagcgctgcgctagcgttcatcgccgctgccaaggccgtccagaagccacgtgtgctttcaccatccacatttctaaacttcgaagcgatgcttttcagctcaatttcaatggattgaaccttatttaatacagaagaaagtgtatatttagccgtacgatagtcattataaaaacggttcctctccataccatcccactggctgtgaaggctgttcattgtgctatccaggccgtttaactggttatacagtgtgccgtgggcattggcaaattgggaggccacgctgtccagctgctccggtgtgacttggatttttgtcatggtgatcacatcccatctaagaaaataggagatagaaattatattttacagtaatccttatttcatattgtaagctatagaggtcggacattcatgaggatttatacgtatttgtgtattcagaagcagttcctttgatataatgaatccatatgagttcatttcgacaatacattattgaaagtcaggtgtatggacatgtcagacaaaaaaattatcttttttgatatcgacggtacgttactggacgatgacaagaaaatgccgttaacggcagaaaaggccgtctttgctttgaaagagctgggacatgaggtggccatcgcaaccggccgtgcgccttttatgttcaaggatatccgcgagcagttggaaattgactcctacgtaagctttaatgggcaatatgtcgtgcttcgcggggaagtggtcgctaccaatccgttgaacagagaagccttgcaagcgatgaccgatctggccctcacacataatcatgctctcgtctatatggatcatatggatatgaaggccaatattcctaacgatgagcttgtggagagatcggtccaaacgcttaaggccaagatttcagttggatacgatccgctctatttccagggaagagatatttatcagacgctgttgatgtgtacagcagaagaagagcctttctatgaagcggtattcaaggcgtttgactttgtgcgctggcatccgagttctgtagacgttgttcctcatgctggctccaaagcgaagggcatccgcgaaattacgtccagactgggcattgccgatgaaaatcaatacgcctttggcgatggcttaaatgatgtggagatgctgacagctatacataacagcgtcgcgatgggcaacggctgtgatgaagccaaagccgcagctaaaatggtcacaaaacgcgcagatgaagacggtattttgtacggactgcaaaagcttggtttgttaagctaacaggattgctgacagactggacatgtttcgtgaaaaataaagtctgtttaaagacttacatatgagaaaataggaggttgtccttaaatatggagacggaaggcttacgcaatgtcgaacagctagccatgaagaagtacaaaatttacaagcagagcctactccggtatttggcacgttccatgctggcgagtatgttcatcgggttcggcgttattgtagccttcaagacgggcaactttttttacatggagcattctccattcacttatcccatggcggcactcacgttcggagcggccatcattctgatcgcttacggcggcggggatttgtttacaggtaacaccttctattacacttatgctgcgctccgtaaaaagctgcgctgggggcaggtgcttcgattatgggctgccagctatggcggtaatttgctgggtgcaggggtatttgcgctccttatttacttgaccgggctgtttgactcctccaacgtgaacagctttctactgagtgtggttgagcataaaatggaagcgcctgcaatgcagctattcttccgagctattttatgtaattggctggtctgtcttgccttttttgttccaatgtttatgaaggaaaatggcgcaaagatgtttgccatgatgctgtttgtgttctgctttttcatttcgggatatgagcatagtgtggctaatatgtgtactttcgccattgcgctcgtgctggatcatccgggtacggtttctgtcgctggtgtgatccataatctcgttccggtcacgctcggaaatctggttggcggcgtgttgcttatgggggttatgtactattcggtgaatctcccgtttttggacgaggaagaacactaaaaaagaagccgtgggactttggttccacggcttctttgcgttattttagtaatagagtatgcagtgttcacaggtgattccttgccgtttattcggcttgagcaggaaaatgaataaattcctccaactccttgaacagcttcttgggattgacgttgtcaggtacaaccagagttagcggctcatccagcttcagcacgtacatgcctaaaatggatttggcatctgccataccgcttttgccatgaatccagatgtcgtaggtataattcgaaacgatttgattgatcttctcaatatccttaacgtcttttaccttgatgggtgtcatcattgcacagcactcccctgcgttgaattggggcttacaaaacaagccttaacatcactttaccccatatgaagcctgttgcaaaatcttaatttagaaaatgacatgcggcgcggagctgattttccagtagctgccgaccttttcaaagttcacggtgattttcgcattcgcctgcttggtttgtgccggataaggcacagtcagcaaatagctgcgcttcaccggagtcatggttaccattttcgccgtagcccgactgaactcgagcaaattgccaccatctgcgttcaactgagctaatctaccattaacttcaacgaaaaatttaccgacaaattgctcactcgcttgctttgtgtaggcctgcgttagatagctgatcagcttggtcttcgtgccgatgtcctcggacagatagcggtagcttttgccgttcaactggaacgcctcacctaccgagctgccaccgctaaccgcatactgataacgagattgtgcctccagcacaagcggaatcgcactctcgtggttcagcttgtccagctgcgtcggtttcacgctggtagccgcagcggctggcgccgaagtggacggctgctgcggcttagacggcttcgcagtcgacggtacggtcggagcagccgcgggtgctactgatgtagatggacgctgtgctgatgcagacggagctactggtgaagcggctttggcagaacctgcggctgcagccggggtcgaggctgctggaaccgacggcgcttgcgccggggctggcgtcgtagccgacgcagacgctgcgggtgctggcacctgagccggggcggatgcggacggactggccacgctcggttgcgtcgcttccgctggagctgtcacagcgggcgcggctgcggcggcctgtgccacgctcataagtgtggccgcaatgcatagtgcggatagcttcgtatttattttcatactcatatacacctccataatcatatgtctgcataaactgcacacgtctctattataagaatttcacttctcgattgggttgctaaattgtttctttttgcctttttttgttcattctgcacgaagtttgtccgtatttgccggggacggttgttctgactgtttcaactgctttgcctccatctcttccaaggatagcgacagttgcttaacagatcggtccagctcctccaatctgcgactcaaagtgacgaggatgtattttaacagaatcagacttaatgcagcaggaaatccgacattagttacgagctcgatcatgccttcagtcgttaaagaactcacagattccgcctcctttttcatacatatattccaccgatgagaactaatgttcccatttttatagaaatcatacgttatcttgtgggctgtcatgacaaaaagagctccaattagcttggagccctctctgtttttgttcattctacctgccttcagaccactaccgaacgacatatcaaggagtatatatattcggctgctggggcttggacatcccttctcccagataaaatccggtgtgcggcggctgattataagctacgttctgccaaacaacactcaggcgatacactggatcatgcataagcgtatagaatcgatgttctgactcgtatggtgttgtgtagatacgcagcgccgaattatcacttttgcgccaaatgacttcctcacgccagtcaccgaacagatcggcctgcaaggacggcgttcctttggttccgttattggaactcgttcctgttgccgtaagcaagttggaagtagtggagttcatatagttccacttgtctatttttccagcgcttgatgaggtatgatccagcagttcacggaagagatccccatcccaccagatgccaaaattaatggaagacggtagcgtgttggtaatgagctgccccatagctgaacgcaaaccaatacccggtgcccactgctcgttccctctggtccgcgggtcaatgtctgccgacatgcctcttccagtatccttgcctgtatttacgccccataaaatatttccattacgcgggtcgtacatggcagctccgtaggtggcatttttgtcctcgttcaccttgaacacttcataacctgaacggtcggggtccagatcgccaacatgaagtgcatctccatgtcccatccccgtgttagccagcttcgctccgttatcgtctacaaccagtgagccatacacgatctcatccttatcatctccatccacatccgccacgctcaaactgtggttcccctgtccagccgttccagcattggtggagctgttgctgtcaaaggtccagcgtcggctcaggttgccgttccgccaatcatatgcgaccagaacggtgcgggtgtaataaccacgtgccatcacaatgctgggtctcacgccatccagataagcaaccccggcgagaaaacgatctacacggttaccataattatctccccagctcgataccgttccgcgcggtggcacatagtcaatcgtactaagagccttgcctgtatcacctgagaatacagttagaaactcgggacctttcaaaatatatccgctcgtgtttcgatgatcagccgaagcgtccccaatcttcacacctgcaccatctaccgtgccgtctgctgttttacatacgatctctgctttgccatctccatcaaaatcgtagacgagaaattgtgtgtagtgggctccagcccgtatgttacgtcccaggtcgatccgccatttgcgtgttccatccagctcatatccgtccaaaaatacatttcccgtataaccggattgcgaattatccttggcattggaagggtcccattttaacacaatctcatactcgccatctccatcgagatcccctacgctggcatcattggcgtggtacgtgtagttcacattatccggggttgtgcctcccgagggctgctggatcggaacatctagatagttgttgttccataccttcaccgcaggagaagcggcctgctctgctccattgaccacggcacgaacggtatacgaagatgaggtcgtacctgccttgtccaaaaagttggttctcgatgtaatcggcgcatcgttcaccttgcttgtccctctgtacaaattaaagccgaccgaatccgcttccgtacccagcaagcgccagctcaccagtacaccctcaggcaccttaacagcgacggctccacggtttagcttttccatttgcctcgtagaggcagcagagacctggctatccatcggggtgaccactccactcaacatgacaccgagacagagcaacgcagtataccgaaaccttttgttcatctgaatcattagctcctttcatggtttgtattttcaataaatttattttatgtgactgataagttattgttgtttaaattctatgatagcgcttacaccaatgtaaagggacgaatacgtcctttttgttcaaaaatccgggctaatgctttaaaaatcagaggtccatgaataatctttcttcatccgcgatgctctggatatcctccgagctgatgctgatatactgatagccctctgcctgttgttttttcaatgcaagttccttcataaaacgtgggctgccctctccggcatcctcatcgtaaacaagcaataaaccgtctgttttgcggaaaaggagttcatcccgtgccttgagttgccatattccctgatagggctgacgactaactactcccacatagtcaacttcggcacaaatctgctgaaaatattcctttttgtcctctttccatttctcttccatattttgataagccatcataatagagcatttcaggtggggatattgctgttttagtgcagtaacgacctcacaggcccacaaatccaccccgtattgaccgggggtaatcacccattccagcccttcttcaatcaggggaataagccttcctgcaatcgcctttttaatatatggaatgccttcgtgcttctgactgaaaatattcagctcatgggcacgatagcccgaaacgagcaagtttttcatcttctcaacgtccttctctgattatcataaaggttattgtaccacttcagagcaacccactaaacacttcgtttcttggaggaacgaagtgaatataacgcaaaagacgaacctcttccaattgggctggatcaggttcgtcttttggagtttggtgctagttctgaatggatggtttacccatcgctattatccttttccattccatattactcctcagacgattttatgcggacatctttaattctaatgttgctactaaatataccggcatcactgcttagcttgaatgacgggtaactagggtctgcctcaagccgcattctgctatcgaactgctgctcctgctggcgatctacccaaaaagaataaggctcagactgaactactttatcagttgcattcggcgtagtgacaaccaagatgacaagtacgccattgcatccgcaatcctcggtgtcataaaacaacttgaacattcccggtcgtcctgaaagggccatttctagcctttcaacggacaaggaatccaattctaaatgtatgctcatgagatgaattctctcctttgtaaatgagatgtttggaaccgtcagctccataaagactaaattttaactatgtgttcattatagtcatgtttttgtatgtgtctatgtgactgcactcactgctatcaatgaactcttacctaaaaaaggcaacccgattacaccgggtcacctccgtcatcgctcaccctatctaaactaacattctagccacaactctatcctttgtaaaaaggattatgacctgtgcctttgcccgatggcatcgccccaggcacaccgtccgcttcaagcagcggacggacaatgagcttcaccggccactccctgctctcgaataccgcttggagcagctcggcccggtcagcttcgggaagcggcaccccccgtagcgcttccttccacgcctgctcggtaatatcccataacttcgcttccgggataggatacacctcgcttagcgcttccataatcgcagccaggttcacctgcgtgcccagcgactgcacgtagaagatcagcttgtggatcgtctcattatacaagctgttcgagtatcctggccgaatatgataacctgggtccgcaatgccgtgtttgtccagatacggctgatgcaaacgtacggagtcgtggtcacggaataacaggccgttcacctgtccgtcccgcaggaccacgcagcagttctgaccgtgaatttcaggtacaacgcctaccttgaacaaccgcatcaccacatcatagaataacgccgtcagatcggtgtagaatcctataacctcttcactggttaacgctctgcccagcaggtcggataacatatggcgaccttccagcgtcaccccaagcgcagccatgggaatgacctgcacaccttcttccagcaactttgtcggatagatgcgaatctgggcggccagatggcgaggatgatcatcgaacaatcccatggattcaggcatgtatccccaccagttccgttcttcgcagagccacactttacctgtgagcgattcatcacaggccaccgcctgtcgtaacatcttctccccagccagaccattcagcagcttcaccaccggaagatagcgggcggccccgagagacaacacactgaccggaagcttgagcatctgtgtggattcctccatcggagccatcgagcgcagggacgatgtcgcctgcacctctcccaattcgatatccagtacaatgagggtgccgtccgcgatctctccagtaaaacgcggcaagatgatatgctccatctgccatggatgtactggcatgggcatgtattcttgcagattcaggcctttccgggccaattctgcttccagcctgctccgctgttcttcatccagtacatccagtgtggacagcccttcctcacatccctgttgtacggcatcccaacgcaccgccacccatcgcagcgggatctccttcctgaattccgctgcataccgggccacatccgcttctgtgaatcccaccttggccttagaggtggggtgaaatggacgatctcgtagcgctgcaacctgctctcccttgataaaccaatcgtaggcattgaacggaacttgttctcccagcccttgcacttgctggagtcccagtgccaattgctcggtggctatttccacgcctgccaagaattccgcaaccccgggatgcgcgtatgcttcatcggaaagcgtcatccgaagcacagcctgtcctacgactgctggagattcaagaagcttccagcctccatccggtgtctctccatagacaggtgaaccttgtacccattgatatccctgcctttttcctgcttccaccagaaacaaaatccctttcagatgcagcataagctgtccactatgcctacctgttccattctcatcctgcttatccttgcctgcgacattgccgtcgagtccgtcagctattcctcgtccgctctgcggaggacctccattaccatcccccagaaacattcggcggaacggttctggtgaagtagagagttcaatgaacggatgcccttccagcggaagcaattgctcggccagaaatgcattgatcagatcctccataatccggcgctcagcgtcttgcagactggcacgcttcatcactgttgacatggttgtcgtcctccgtcaaataatggaatgccgggtgcggatgacccagaaaatcatgatgcgagatggtccagcaataggctcccgacttctcgaacacaataatatcgcctacacgtagccgctctacttccgcatctgaatgcatacgatccttgggtgtgcatagttctccgaccacgtgaactttgctgtcccgtacctctggtcttgcaaacgaatgcccccaacggtccgtagacataatgtgaaatggatggttgtgtccccatgatgcgggcagacgattatgatgtgtacctcctcttaacacggcaaaatgctgaccatgcgatgttttgatatccgtaacctctgccgcataataaccgtggtcagcgacaagcatgcgacccggctcgaaatacaactgtatgccgcgtgaagcaaggcgccatctagcttcacttcgctcaatcagggatgtgaacagggaccagtcgaacccggggctaccatcatatgtgacaccaaacccgcctccagcgttaattacttcaagatgcaggtcatatatctgctgccacatctccgccttttgcaaatacagctcgatcatctcggcatgcagtcttgcgtccacattgttcgataacgagtgaaaatgaaatccgcataaacgcaccgaacccgcaccttcctcacgaatgacccggactgcttcctccacgctctcctcatccatgccgaatggactcggaccaccgcccattacaatccgggtccgtggcaatgtgctacttctcagattgatccgcagcagaatgcgaacttcctctcctctccttgtagcaatggcgatgacacgccgcagttccagcaggctctccacatgaataaaacgcaccttatgctcgatagcctgcttcaactcattctcttttttccccggaccaccaaacaggattggaacctcgctacttacgctcctcaccttgagcaactcgccaatggaagctacctcgaacccgtgaacccagggcagcaaagcctcaataatttgagaatcgggattggcctttatggcatagaacaaccatatgcctccgggcagcgtgtgcagcatgtgacggacctgcttctgaataccagccagatcgtagacataagcacataccgggtcttcactatctctttgcagttcatggatcatattccatacgcttgatttcatatcagtccacccgcatttccatagtcattccgtttctgttcgtacgcccgaaaagccgtattccggtcatcgcccaacacgtatatgtataccccccgttccgcccacagcgccatgccttccttgcttctggccaccgttgcatacggtacctggcactgcttcgcggcttcatgtaatgcacctagcgaacgttgcacgtctggatgttccgtctgccacggtacgccaagtgattgcgacaggtctgccgccccctctagtacccagctcacctggggatgagatagaatgctcgcactttgccggatgccctccacactttcgatcatcggtacaaccatcacctgttcattcgcttcctgaatatacccagtgagtggatacttgccgaatacccccggtcgcccactgttcagactccgcatgccaagcggatgataatacgcatgacgaaccgcttcctccacctgctcccgctgttctacatgaggtatgacgatgccttgtgcgccgcaatccaatacctttagaatctctactcgctctaccttcgagatgcgtaccagcggggtcatccctgccagttccgcagcacgaaccagctcttccaccgattccatattcgttgcggcatgttccaggtcgataattacaaaatcatactccgcatgtccaatcatctcgatgatgaccggatgcgggatagagacaaaaaggccgaacactggctgtttacgttcaattttctccttcagcgtgttggttctcatccgaaaacgtccttcgccaacttcaacggattgctgaccttacggaaatacagctctccgtccccatacaggcggcgcttggtcatctcttcaatcagcgcatcctcggcaaaaagatcaaaccagtcgaaccgctcctcatactccgggtgctcccgctggtagtccataatcgtagccgcgcacagttgccagaacgcttcttccgtcagaccgaacttctccagcgtcagcgcaatatccgtcatgcagataaaaaagaacgcatcatacgtatagtcccggacttccgacacatcacttgcgtagataaaggaataccgattgaacttgtgatgggtctccggttcggggtgcagcttcggggctctttctgggttcagcaacttctcgggtacatagcggacaccatcgtgaagatccttgatgataatccgtttcggcagatcattttccagcaccagaatgatgttctgggcatgcgattccagcgcaatgccgtgtgcatagagcagatgaataatgggcagcgataccgttcgaacgagggcttcactccacttctgaatgccatgacgctcaactgcaccctggataaacggtaccccgttcgactgtactagcataagtgcatttaagggccaagctgtctcgccttcttgcagatgaacagatacattttcacgccagatcgccccgattgtgccatacgctcgtccatactggattgcaggcaagttctcgtaccggagcgagagtcccatgatttctttcagaatggcaaactgttcccgttgcagcaactcatcctcccgaatgagtgcttccagccagtcgctgatcagcggtgcgttctgggttgtgtgttgtgggagaatacgtgtactggacgtattggtaatactcagtgccagcttgagataaggcgcttctggattcattcggttcgacagggaacgaatggactgctgagcgcgataagctgatgccgaagggccgagaaaaacgatatctttgttcattcgttgccgggcaaacaccgattccagctggtgttcccattgccatggatgaacaggaatgaatatatagcgattcccctcagtgtcttccgactgaagcacccgatcaaatcggctgatatccgcctctgtgagatgttgtctcaccaactgttctgacgtgtagcctgtggagagagccgtttgcacaagtccttctttcacggcaatccagtatacggtcacatccgagttaaactctggaccgtaagcaagattgtcttttagggtgaagccaagcctcgacttgtagcttggatggtagagatgaccgtcgctcatatggctttcgagggcatcatagtgtcggtctttatccggaatcttctcaggcagcaaagcccggcactgactgtccttcgccatcgtctccagcaattcctgaatgaaggccgtcacattcgcaccctccagaaggttcagtaccatttcctccagaaacagatccagatcggtgcagggcacgccctctcttcgaatcgagcccttcaccaccttcactcggccaaatgaaaacttctgctccgcctcacagctgtatgtcacagcctgccctgacgtattccgccccacagtgcgccattcgttcccatccaccttatagtcaaggataccctcgaaccacatggctcccagcgtctgccgcatgatccgttcctgtacatccgtgtatactgccgtcctgtgacctttctcagccctgtaccctatgaaccccacgccacttcactccctattcggttcattatattgctcaccggcacatacgccggggtctgactgattcccctgagacagctcaccagattttgtttcgccagaaaactgtccgcggtcagcaaatgctgcacatatgcgtttccagttcggtctagttccttcaccagcacttcgcggacctttgtccagaaatgctcctccggtatgttcacatcccttgccatcgcatgaatgagggaacccagatgattgatgataaagtaataggatgtcctcgcccaagccttgtcccgtggataaaacaacaatctagagggagcggtatccacctcatggatcagctcctcatcgacactgactccttccaagtcacgcacgataaatgcctcaggcattccgtctcttagcgtcacgagagtattttgcaaatgagcttcaaagtgaatgcctcgctctccggccgctcgtacaatgggtagcaaagacaaggtcagataacgtgcaaaccagcgctcggcttcagcacgtacgccacccagaatcgtcatgagtcgtgattgcattcccggcaagggagcttctaccagactcgacaggacatatgtacattccgggtcaaactcaatcggtctgtatgcgacagtaaacaaactcgttaattcttcctcctgaaaatcacaagtggctacacctgtctcataggcaatctgcgtatgctgatctgcaccgaagcaattttgctgcctgacgtacctggaggcgtccagcgtccttcgcatctgctccgcactattggtgcgaatcatgttggtaatctgtatgttcagcgacagcttgatattgcaatttagctctgggatatagacggtgcgtaccgaggaggtcgggtaggccttcggtccacagctgcctatcggaatgagtttcttgtccagaatatactgctggacctcggacaagctcaacacgtacgtatactgccagggatggacaggcagcagttcatactcatccccatgctcaccgcactccgcttcccaagcttgttccacatgcccgtgcaggctggcatgcagattgatcctggtgggatcatctacccattcctgcctatatacgtccttcctcacagcaatgtaacagagttggaacgaggtacgcagttccgggctgtacatccgtacgtcgtgttcagtgaaacccttggagtttttgggaaacgggtgaaagggatgtccatacaccagagactgttcggaagtacagtaatcatatatgccaagtccaacagcctgctcgatatacagcgtaagattattcacgctgttatctaccttttccgcaaaatcacgtacagcagccgcatgggtcaacccaccttgctcatgccgactgtttccatacgccgtgtcttcactcagctcccgggtgatccagcgaaccaggtcctgataatgcaccgcttgcccgtgaagctgttgtatgcttcggtactcatgctcacccatagccgagtaatacgcgaattgtccggttatcgtcaccccgctggcctgaaaagcaactgcgtacgtcatcgcatctggattaatccgaatgtcgccctccttctccaccgcaagctcccggatataacaattgagcagcaacttacaagagtgtacattcgcctgctgctctgcttcagacctgagcctgttttccatctcgaacaatgttgccaaccttctttcgggttataaataaaacgagggacaaggtcaacaggatggcacagccgagagcctactaacctctttcagtgctgcccatcgggccatattcgctggtgttccgaccccggcaagtctttagcagacctatcatccagagaccacactgctgaccagcagcagaatactgatggatgccaccgcttgcggcgggtgggcacacacattcgaatgtaccgaccacaccataggagcgagaacaaagtaagcgggacattgagccataacaggcaatgaattgcccttattctgtaatcgacttttcgaaatgatgttccatttgaaaaagatattccaggtacaatcggacgacatcacgtgtggtccccccaaagggaaagacatggtgcgtcaggtccggcaatgcgttgacttccagaatgcctccctgatctgctgtcagcggctggccgatatccccacaacggatatcaatgccagccacatcaatctggagagcttctgcggctttaattgccatttgtgcattatcaggaaaaatcgcttccgtacagtccacataaaactcactgatgtttccggcggccgaattgcgaagatcatatagctcgatctttcttcctgccgcaggtacctcctccagcgtgattccctgttcaagcagagcctttcgcaaaggctctgcatcttcatcaatcttgggaaaggcctcgaacttccctatacgggtatgctggattcgttgctgattcaagattcgaatcaacgcccggatggttgaggtgccgtccccttctacaaagacagaccgatactcatttactgctgccacttccccgttaatgatcagtaccctataatccaaacccgttatgaattgctgtagcatgatgctgttactatgggtacccgcccgggcaatagccgcttccagttcctcgtttgttcgaacgtccagtgtcacacctgcactgcagcttgcgtccagcggcttcactacaacggaacgatgcagtttcagaaacttcgctgccttgtcacccattgccttgataacgataaacggcggcacaggcattccccgctcatgcagtagcatattacatacctgcttgttcttagcgagcagtccagcgatcaagggtagacgatgcgatctggttttattaatgactctgcgcttgtccccataggacaattctagaaaatcttcacattctgcgagaagtggctcgcaggtcattcccatttctcttgctttgcttatgatgagtcggttttgcagattatgaattcctttcggaaacaatgaaaatcctccccgaccgaatgaaggcgttcgctcctggttgtgctttcatcggattgatttgatagaaatattgataatgattatcagtttcaaacaaaatctattttatggcaatttcattcaccttgtcaataataagctttttaggaaaaaaaagatgtttttgcagggagagaatccccaaatgaaggattgtacatggaacaatgggcacaatgtgggttataacatcaatggagactaattaaattatcgaatgagacagcttataacatccaaatgagacaacgcaaatgcccgtaaagcgagtaaagacgggaataaaataaaaaaagatattttaacaagatgagtatcgacttgtggtattaaccatcggcagaattttgttcttttttaatatacttacggcggctttcctgaaataaggagagcctttttattcaataaacggttagttgaaaaaaagcattgcaataaatacttgactctccccattagaggagacattaaactcaatttgtaagctaatcaattaaaaggaggaagtcaaaatgaacttagatattagagacattagaaaagaggatatagaacctattaaagcaattattgcagatacttggaacgcaaaagattttatcgaggatgagagcatcataaatgcagcagttacaatgatgttcataagtccaatattaaacagaagtacttttggaagagtagctacattagatggagaagtcattggtgtaatttttggttcaagagttggtgaagcaacatcttatagattgctacaagaagattatacaagtgaattgctacaactcttaaatctaaatgacatagaacaaaaagtatttgttgaactcacctccatgactaatgaggcaaacagcaagttaattagaggaaaagaaaatgagtttcagggttgcttagaattctttgctgtttctgaagaagctagaggaaaaaaggtaggaaaaaaattatttaatgagctcatctcttacttaagagatacaaaagcaaataaaatttatctgtatacagacacaatgtgtaactatggattctatgaccataatgggtttgtccgtcttgatgaaaaagcaactgtatttaatctacctatcggtaaactcgaaaatacaaattttatttatgaatacaaactttaagctaaaagtcagtccacttcatttatggggtgggctttagacttatttgaaattgggagaagtgattatattgattaaaaacatctgtcactaaataaaacatataaaccttattacacgtcaaactgtttttcttcaaatattcttttactaattgaaatgtttcaatttcagtatctctcgtacaattaacagttaaatattcccccttgggtaattcaggtacattagaggtatctttaagtaatctataatcatctgatgttattagacgaaatacatcactgatttcccaattatcatagtgacatgaaaaaattaatccatactgaaacgtatgggctgcaaattcgcctaatttttcatctaatttatcgaatgactttatcttattaagttctccaccttgtgtaggtaaacttaaaaagtatctgtcttcaaatgtctgaatattaaatccattgttcataagttcatcttcagatgaatgaatagctgcccttaatagttctattcgtttattaagttgttctaatttctttatttctttatgaatttcttcttttttctgttctaagtaaagtttaaggtaattagtatcggctttagcaaataaggctttaatttctttaacacttacattactttgcttacaaatttttataatatccagatagatgaattgatcaattgtataatagcgataaccgttattggaattaatgtatgcaggtatcaacaagccaatatt

SEQ ID NO: 23 - DNA, 378504 bp, Unknown
  Kingdom: Bacteria, Phylum: Firmicutes, Class: Bacilli, Order: Bacillales, Family: Paenibacillaceae, Genus: Paenibacillus
  misc_feature (119550)..(119551): n is a, c, g, or t
ctacagcacccgcgtgcaagctttggcttcgcacgccagcctgctgcgcagcttgctgccgcaggcttccgcgccaagcgggttgccccgtgcggacgcgcctgcacctgcgtctgatacctccgctgctgcctcgccagctgcgacgccaacgggcgttgcgcgtcctggtatcgctggctcgcggaacgcatcggcgcagccgctagcaggaacggcggcagcacagcctgccgccggaggccgccgcacgcggctggatgcagtagcggcccgattgaaggccgccgctgccctggtaagcccataccctgccatgcaaacggcggtacgggatttacatgcccgcgccgctgcgctggagggtgggcagtttacgctggcgctgttcggagcgttcagcgctgggaaatctagcttcgccaacgctttgctgggtgaagctgtgttgcccgtatcgccgcatccgacgacagcggcgattaaccgcataatggcgcctgcgagtgctgagcgccatgccacggctgacgtccatatgaaatcagtggacgcgttgcgggaagatcttaaatactcatttcggctattaggattgggggaaccagcggcagcgggctggcaagaagccgttcatgctttatctccggaaggcatccatcctgcgggtaggcctcattatagttttttgaaggctgccgcagcgggatgggaagaagctgaaagcttgctgggacaacagcttcaggtggatttagagcagtatcgggattttgttgcgtctgagcacaaatcatgctttgtggagcatatcgacctttattatgattgcgctctgacccgtcagggcatcgtgctagtggatacgcctggagcggattctgtgaatgcacggcacacaggcgtgaccttcaactatatgaagcatgcggacgctcttgtatttgtcacctattataaccatgcgtttacgcaaggcgaccgacagttcctgaaccaactaggtcgagttaaagagaccttggcgctcgatcagacgttttttattgtgaatgcatcagatctggcttcttctgaagaagaacttcattctgttacccggcatgtacaggaacaactacaggcgaatggaatccgaaagccacgcatttatccgctttccagtatgctggcgttggaagctgccgaacagggagaggcttcattgcgttcagcttcacgttttgatgcatttgaagatgatttctcggcatttgcagccgaagagctggcaggtctgtccattgcttctgctgtgcaggaactgagccggctgcggaaccgcatagagaaacatgcagccgatgcccggtatagcgtggaagaacgtgagatccgattcgagcgattaactcgcatccgtggggaattggagcatacgctcctagacctgactgacagcaacggtgcatctgtgttatcgggcgaaaccgatgaactgctgtatcatgtacgtcaaaggctgtcctatcggactggagaatttatggcagaggcgtttcatccatcagttctacgtgaaggagtaggtgatctccgttcggcttttgcatcttgtggtcgtgagctgatgcgcttgatcgaactggaactgtctcaggaattactggcaaccacactccggctggaaaaaacgggacaaattttggtgcacaaggttacacaacagtgcgtagaacacatgaaccatcagttgccaggactagattgcacaattcctgaatccagaaaatgggctgttcccgagctgaatgaaatttccctgcaggagtccattcattggaaggattattggaatagctttaaaaatccaaagctattctttgaaggaactggtcgagcgaatctacaaaccaaactggagccgatattacgcgagcgaatcggggaagctgtggatcagcaacgagaacgaatgtcttctttttacgttacgcttatgcaggaggagcaaatgtggcagaaagctcagcttcgagagcaaatgctggagacgactcgtggcatggagcatgcgcttatgggcggtgagcagccacaggtttgggaagagcttgctggcaagattgcggctttggagtaaagataaataagtacaccatttatttaagttcaggacaccgggttgtgggacaacccggtgttttatgcatgctccaaaaagaaagcaatactgagtaaatagccatattcaataataagaaagcgatttaatttgtctaatcacccaccacttgataacctgcctgaatacggctcgttatcctctttgccgccttggaacgcgaatggtaaacttcactaagccatataacaacgtcgtgcaactaatggagggacattgacatggaagtgctcaggcaactgcaagttttttttcgcgagaggagacactatctgtttctttctattttatgccttgcgatagctacggctctgggactggtgtatccgaacctgctccaaaggctcattgataacgctatcattccaggtgacttcgggaaagtcccggcgctggctctgactgtgctgggagtagtcatcatcaaagggttcatgcaatttttacatggtttttttggtggacggctaggtaactatctggcgtaccgactccgcaatgcttgttacgaaaagctgcaatttctgtccttcagatattatgacactgccaaaacgggtgatctcatgtcccgactgactggtgatttggaggcaattcgtaactttattgggtttggttttgcccaactcctcaatgtgctactgatggtcgtattcggctctatgatgatgctgtatattaactggcagctcaccctcattacgatgatcagcatgccattgctgctcttcgtcacattcaagtttgaatcccggattcatcccacctttcaggaaatgcggattgcccttagcgccttgacgacagcggttcaagaaaatataacaggtgtgcgaaccgtcaaatcttttgcccgcgaatcctatgaagttgagaaattttcagtacgtaatgaacaatacaagagtaatcaaattcaggctgcttccttatggagtcggtttttccccgctatggaactgattgcttctgtcagtgtggtccttctgttgggcatgggggggtatctggttattcagaagtcaatgaccttggggcagctcgtcgctttctttagcttaatttggtatattatcggccccatctggagcattggctttcatatcaataactatacgcagtccaaagcttctggtgaaagggtcttggaactgctaaatcagtccatagatgtaaccgatgaagctggagcacttacactcaatgctgatcaggtggaaggacatgttacgtttgaacatgttacctttgcttacggaaataagcttcctgctgttgttgacatcaatttagacgcaccgccaggatcagtcattggaattttaggaggaacggggtcagggaagtctaccattattcaattactcatgcgcgcttataatgtgaatgcaggaagtatcaagttggatggcaaggatatacgtcacttaaagattcgcgatttgcgtgctcaaatttcttccgtgtttcaggagacgtttttgttttcgtcctctatacgcaacaatatttcatatggtttaagtcatgtcagtatggatgacatcatacgcgtttccaaactggctcaggcgcatgaattcataactgaactaccgctgggttatgacactgtcgtcggagaacgtggattgggactgtccggaggacagaaacaacggatcgccatcgcgcgcgcactactcaaaaatccgaagattctggttctggatgatgctaccagtgcggtcgatatggaaacagagcatgaaatacagaccggttttcaagaggttatgcgtggtcgaacaacattcataatcgctcatcgaatctcttcgcttcgtcatgctaatgaaattgtggtgcttgaggaaggacgaattgttcagcgtggaacacatgaacagctcattgctactccaggtccatatcaggatgtgtatcatattcaatacgccgattacatagctcaggctccagacggtgtatccgaagggcaggtgagaccatgaatatacccgcagaaaaagtcaaaccgctaaaaaaaccaacgaatgagcgctttgtctatcaagatgatgatgtcattgacaaaccgtttaactggtcagaattcaaacgtttgttggcatacatgaagccttatgcccgtcagattttgccgatccttctggtcatgatgattctcggcaccattaccaagctgaccgttccttatttgatcagtctggccattgataaagcaattgctcccgcatggcctgcactgcccagcgtaaagttgctgttgctcatcacgggtgccgtgcttttgttatatttaattcaatgggcagccagcacgtaccgcattaaattcaccaatattatcggtcaacgggttatttacgatttgcgtgaagatttgttcaagcatattcaaaagctatcttttaacttttttgataagagaccggcaggttctgtattagtgcgcgtgacgaatgacattaactcgctacaggatctatttacgaacggtgcagtgaatgtcctgattgactgcgtacagcttatcggaattattgtcattttgctgcttattaactggaagctcggtttagcggtaattgtcactgttccgattatgtttttgatctcgaccaagctgcgcgtacgtatccgccgcgcttggcaagaagtgcgtatgaagaactcgcgtatcaactctcatttgaatgagtctattcaggggattcgtgtgacacaagcatatacgcaggagcaggaaaacatggcttttttcgacgacatgaacagctctagcaaaaaatcgtgggataaggcttctgccatgaatcaggtttttggcccacttattgatattaccgggggatttggtacgcttgtgctgttttggtttggagcgcatttaatccagacagatcagcttacggtggggctactggttgctttcgccaactatgttgggaacttttgggagccaattaatcggctgggccaaatgtataatcagttactggttgcgatggcttcgtcagaacgaatttttgagtttatggatgaacagccgaatattgcaaacaaaccgggagcaatagccttgccgccgattcggggagatatccaatttgaaaaggtcatttttgagtatgaaaagggacgtcaggcgcttaaaggtattaatctttctgtcgaggcgggtcaatctatagcgcttgtgggtcataccggatcaggtaaaagtacaattattaatctgttaagccgtttttatgacattacgtcagggcggcttacgattgacggtcatgatgtgcgtgatgtcacggtggagagcttgcgaagccagattagcatcgtacttcaggatacatttattttttcggggacgatccgtgataatattcgatttggccgtttggatgcaacggataaggagattgaagcggctgcgaaggcggtcaatgctcatgaattcattgttcacttgccagccggctatgaaacagaggtagaggaacgggggggaatgctgtccatgggccagcgacagctcttatcctttgctcgtgccttgctggctaatccgcgaattcttatcctagatgaggccacagctagtattgatacagaaacggagttgaaaattcaggaggctcttcaggttttactagaaggcagaacttcttttatggtcgctcaccgtttgtccaccatccgtaatgctgatcatatcgttgtactggatcatggggaaatccaagaaagtggtaatcatgaacaattgatgaaaaaacatggaatatatcgggggctggtggaagcacagttcagatttttgtaaaaaaaagatcaaaaaatcgcgttttttgtaaattttaatgccgagcactattgcattcttggagctaaaccctgaaaataaagatgaaaagagatcagagcaatttcgtcagagggggaagagttcaagatgtggggtgctcctttttctgccaaggctaagaagatgctgctgctgggtagcggcgaattgggaaaagaagtcattattgaagctcagcggcttggcgtggaatgtattgctgtagatcgctatgaactggctccagcaatgcaggtggcccatcgctctcactgtctggatatgcaggatgctgaggcgttgaaggcactaattcgtaaggaaaagcccgacataattgtacctgaaatcgaagctattgctacgggtgctttggaagaattagagcaagaaggatttcacgtagtaccaacggcccgtgccgcccgtcttacgatggaccgggaaggtatccgcaggctggctgccgagaaattacagcttccgactgctgcctatcgttttgcagataactttgagcagttgcggtcggcggttcatgagctgggcacgccatgcgtggtcaagcccttgatgagttcgtcgggtaaagggcagtctgtatgccgggcaatcgaagatgcagaatcctgctggaatacggcgctggaaggcgcgcgtgccaaaacaacacgtgtcattgttgaagcttttgtcccgtttgagagcgaaattaccttattgaccgtcagatcggttttgggtacgactttttgcccaccgattggccacattcagaaagatggggattatgtcgaatcctggcagcctcatggcatgacggacaagcagctttcggaagcggaagacattgcccgtaggataacggatgaactgggtggttacggattgtttggcgtagagctatttttaacagctgatggcgtcatattcagtgaagtatcccctcgtccgcatgatacaggaatggtgaccatgattacgcaggatttgtcggaatttgcgcttcacgtgcgggccattctcggattcccggtgccatccgtcacgctgcttacaccaggagcttcagctactttgaaggcagaagtgactacgcgggattttgtaataagcggtctgcatgatgcattattgctaccccggacacaggtgcgagtgttcgggaagcctgaaaccaagccgggacgccggatggctgtagcgcttagcgctgcagaagatgtggaaacagcacggaagacggccaaagaagctgctaatatgctgaaagtggaggtaaatcatgtctaacaatgtgatgattccagtactgacaattcgttccgtagagcttggcgattgcgaagccgtaactggactactaagagaagtcggatacccgatgacttgtggtgtaatgaaagaagttatgggaacagcgcgggaggacagtcaagcgaatatgatggttgcagaaatggatggtcgtgttgtcggagtaatcggcatgcatacggctcaaagcttggcttatcctgatcctgccgtacaaatcaccatgctggtcgtgagcggggagtatcgcggcgagggcattggcaagcgcctggtggcttgtggtgaggagtggggacgtgcgcaaggatgctatcatttattcattaccggagcgaataaccgcatcaaacaagtagaggcccgagctttctacaaccgaatcggctttgaaaagcaaggctaccgtttcagcaaaaagcttagataatcagcctataacaagacaatctaatacttaaagcctcactacttttaacttagttccgcatgggtcaattccgagcggggctattttttttccaacttttataccattgatcctgctataaaacatgatatactgctagagtaaagattacaaagttgtaaccagacgcgttcacaccaaggcatttatacaacaaggagatgacgaaatgaagaatatgttgaaaaaaacactggtgatgggaagtcttagcgccattttatccgcaggattcatcgttccggcatcagcttcaccagctgacgatttgactgcccaactgcaacaatggtttcaaaataacggatataccgtcaatatgtccaacgggacgactacgataacaaagaccgtaattaaggatgtttctggaaaggacaaggctaaaaacaaaacagaaaatccttcatccggcaaacaaacaacaaccaaacagggtggccaaaaggcttcgcagtctggtaccaagcaacagactcaaaaacaaaacacaaactcaggcgcgggtcagtccgcaggtacggatgcacaactcagcaagtcccaatttgcagctgaggttgtaaagcttgtaaataacgagcgcagccaaaaaggtctcaagcccctcgcatcgaatgcgaagcttacagaagtagccttagtcaaggcgaaggatatgagtacgaacaattacttttcccatacatcaccgacctatggttcaccatttgatatgatgaaaaaattcggtgtaacttatacgtatgcgggtgagaatattgctatgggacaacaaacaccacaagaagtgatgaaagcctggatgaacagtcagggacatcgtgagaatattttgaaggcagagtttacacaaatcggtgtggcttactacaatgggtattgggtacaagagttcacacgtaactaagatgatagtaaatacgttcccaacgttatggcgctgctacgaaaagatagtgacgtgacgttaatctagagacccgctgacacgttcagcgggtcttttggtgtctcttcatcctccagtggcataaccactgctttataccagaaaagacataagggacgtatttatagtatgatagcagcaagttgaatagatatcagactacttatggaaagccaggtgaacaaatgagctacgaaatcgtgcatgaaggtgcctttgctatgctcaaggtgcagttgaaacccggggaaatgattaaagcagaaatgggagcgatggtttccatgtcttccagtgtagatataaaggggacggtagacggtggactgttacgtggcttaggcagaatgctgagcggagaaaaattcttttttcaagaactgagggcagcccggggaccggctgaggtgttgttagcccctgctagtataggtgatgtacaagcggtggaactggatggcacgtataggctattcgtccaaaaggacggttttctggcttgcacagaagggattgaggttagcaccaaaatgcaaaacctgatgaaaggtttattctccggtgaaggtttttttatcgtagaaatcagtggtcgaggtacggtattcctgtcctcttatggagccattcatcccatttatattgcgccaggagaagagcgtattattgataatgctcatctggtggcatggccggattatatggattataaaattgaaaaagcatctaaaggctggttgtccagcgtaacgagtggagaagcacttgtatgccgctttcgcggtgaaggaacggtactgattcaaagtcgaaatccgggcagttttggacaatggatcaaaagttttatccctgatagcaaatagtttgattcgcctgattagagatgagaggataaaccgttcgcagaagaaagtataatataaggatggtcatttgccatcctttttttgcatgttcatgggaaattatatgtgacactaagcatgtattgcgcttttaatccgaacggtttatttgcaaaatgatatgagaagctttatgtttatttcactaagctatcaggagggaacacgagtgaattcatcaaaatggatttggcggtctgtcggttccgtttccattgccgccacattgctattattgtacggattttttacagcagtacaaagtatcacggctccagagccaatggttagcactcaacctgtacattctggttcatcgcagacacaaactgtgccatccgctactaatcagacgggagagtttcgggtagctgccattggagattcgctagccaaaggcacgggagatgactccggaagtggttttgtgcgtcggtcggtgagcttgttaaataatcaggaaggccataaggctcagctcataaataatctggggattaatggactgacgactcaaggactattgaccaagctggatgagcctggtgtttcttatgtgttgaaaaaggctaacgtcattattgtctcgattggcggaaatgatttatttcagggggctcaggctgcccaaaccggcaaagagccgcctacactcagtggtttgcgtaaagctgtgcctgatgccgccaaacgtctgcaaaaagtgctgacaaaggtagggaaaatcaatccgaatgctaaaattatctatgtcggattatataatccattcagtgatctgcaggaaatgaaaattcccggtaatcttgtagtaacagaatggaatctggctgccatggcaattaccaaccaaaacagcaatatgactctggttccaactttcgatttattccagcaaaatttgcccgtctatttatcatccgatcattttcatccaaacggacagggctatcaggcaatcgctgaacgtatcgcgcaagggtttgcagttgcaaacacgaaggatgccgataaagtggataatgaacaacagtctacaagtagccaacccgctgaagtgaaaaagggaggaaacaagcaatgagcatccaatctgctgacaagaccggggctggaagtaccgaaaattcgacatcaagggatgcattgtccagtttccattccgccaatcaggttggcagcggaggcagagacagaagcaataccgaaacagttctctctgttcagcacgttaagaaacgtatcaaacgcaaaatgatcattcatgatgtcacattcgacgttcgtgcgggtgaaattttcggatttcttggtcctaatggggctggaaaaacgacgactattcgtatgctggtcgatttaattaagcctacggaagggacgattaccgtctgtggtcataatgtaaatcgtgaccctgagcaggctttacggcatattggttctattgtggaaaatccagaggtgtacagctacctgacagggtgggagaatttagagcattttgcccgtatgcagcctggtgtagacgagcagcgtatccgcgaagtcgttgagctggttcggctcgatcgccgtatccatgataaagtaagtacgtattctctcggaatgcgccagcgccttggtatagcccaagccttgctaggtagaccgaaattactcattttggatgaaccgacgaacgggttagaccccaaggggatcaaggaaatgagagcttttatccgtttgctagcggcagaaggcatggctgtatttgtttccagccatttgctcagcgaaatccagctgctatgtgatcgggtggcaattataagtcggggaaaggtgctagctgtaggtggtgtacgggaactggttgagacgcattcgcacatggccgtgtggcaactggagcctcgtgatcagggtcttgccatattgcaaaattctccgcatgtgcaaatgattacgaatgccgatgaattaattgatgacagcattgttgcaggcagcggagccgatgcaatttttacagaaatggatgaagagcatattgcggagctggtgacacaaatgacggcttccggtatttccgttaaaggtgtaaccaaaatcaatcctacactggaacagctattcctgaaaatgacggaaggtgagatacttgaataacattttaccgctcgtacaaaatgaaacgctcaaaattatcaagaagaaacgattttatgtcattttacttgttttacttgtgcttgtgccgatttttacgtacgctcagatgaaagtggcagaaaacaatcgcgaaaaattcggcaatgattggcggctcgaactacgtcaggccattaccgataaccagaactcgctgggcagtgaccgggttcccgaggaatggaagacctatcgtcgggtttttgtgcagcaaatgcaatattatctggaaaatgacgtgaatcctaatgagccgagtggcgtcacctttaccagagagtttatggataattccataaatctgttcgttccgctgttgattatggccattgcctccgacttggtttctggagaacggacgacaggcacgataaaaatgttgctgactcgcccagtcaggcggtggaaaatactgctgagcaagctgttgacattgtatatgttcgtctcgctcatcattttggctgtatttataattagctatctcatatcaggcttgttttttggttttcgcggttttaatgttccggtatttaccggatttcaaattgttggatcgacggtggatttgtctgctgtacatgcgattccacaatggcattatctgatgctgcaagccggattgatctggtttgtcagtcttgtggtagcttcgttagcctttatggtatctgtcctggtacgaagtacggcggcaagtatcgtggtcatgatggctgcgcttatttcgggcactattttgacaaacatggcttcatcttggcagagtgctaaatatttatttatggttaacctcgaattaaccgattatttatctggaagccccgccccgattgagggaatgaccttacccttttctttagctgtactgtgcatttggggggctgcggcattgattgtttcattcgccgtctttacgaaacgggatatattgaattaaaatggacaaggtaaaagaaaacatctgtttgcatttttggtgaaaatcatcaagaataaggcaaaacacggttacgattagacaaagggggagcatgaatggtcgacaaaatcgacttgtctgcgggagtatccggcacacaaagcggagcttcagaatatggcgcggacgacattcaagtgctcgaagggcttgtggcagttcgcaaacggccgggcatgtacatcgggagcaccagttcttcgggactgcatcatttggtatgggaaattgtagacaacgcggtggatgaacatctcgccaagttttgctctcgcattgatattacaatgcataaggacggttccgttacagtatcagacaacgggcgcggtattcctacaggaatgcacaaaacgggaattcctacgcctcaggttgtattcaccattttgcacgccggaggtaagtttggcggttcgggatataaaaagtccgggggtctgcacggtgtaggtgcgtctgtaacgaacgctctttcggaatggcttgaagtagaaatttaccgggacggcaagattcaccgtcagcggtttgaatattggcaggacaagaagggcgtggagcatgtcggagaaccgaccacaggccttgaagtgctgggcaatactaacaagacgggctcgaaaattacatttaaaccggatattcgtgtttttcaggcaggcattcattttaactacgatacgttggctgagcgccttcaggaaattgcttttctaaattcgggccttcgtattcaacttaaagacgaacgcagcggaaagtcagatgagtatttttatgagggtggcgcgagtcagtttgttgcttttctgaatgagggcaaggatgtgctgcatgacgttattcactttaatgccgagaaagaagacattgaagtagagattgccatccagtacaatgcgggttatacagagacgattgcttcgttcgttaactccattccgacacgtggcggaggtacgcatgaaacgggattcaaaaccgcctacactcgtgtcatgaacgactatgcgcgcaaaacggtgatgttgaaagaaaaggataaaaacttggagggcaacgatctacgtgagggcatgatggctgtaatcagtgtcaaaatggctgaagttgaatttgtcggccagacaaaggatcagctgggtagcgcttcggcacggagtacagtggatgccatcgtatctgagcagatgcagcgttttttggaagaaaatccgcagatagcacaaactttgatcaagaaggcagttcaagcatccagagcgcgtgaagctgcacgtaaagctcgagatgagatgcgttccggtaaaaagcgcagtgaaagttccaatttgaatggtaaactgtcgcctgcgcagtccaaggattttacacgtaatgagttgtttattgtggaaggcgattcggctggaggatcagccaagcagggacgggattccaaaattcaggccatattgccgctaaagggcaagccgatgaatccggaaaaatccaaactggcggatattatgaagaatgatgagtaccgtgctattacagcagctattggtgcgggggtaggaacagagttttcgctggaagacagcaattattccaaaatcatcattatgaccgatgcagatacagatggtgcgcacattcaagtgctgttgttgacgttcttttatcggtacatgaaagagcttattgatgcaggacgcatatttattgctcaaccgccattgtataaaataactcgaaagtcgggtaagctcgaaacggtgcgttatgcttggactgacgagcaacttgataattatttaaaagaatttggacgaaattttgagcttcagcgctataaaggacttggggaaatgaaccctgatcagttatgggaaacaacgatgaatcccgattcacgcaccttgttacgcgttcagatagaggatgcagccaaggctgaacgcagggtgtccactttgatgggtgataaggtggatccgcgcaagcgctggatcgtggaaaacgtagatttcacggaatacgtagagtagtgctatcaaaagaggtgtatacatgagcttatcggagcagtttttgccagcttttctggaggaagtggtcggtgaccgctttggccgatattccaaatatattattcaggatcgggcgatacccgatgtacgggacggattaaaacccgtacaacgtcgtattctgtatgcaatgtacgattcgggcaatacgccggataaagcatatcgtaaatcagccaaaaccgttggggacgttatgggtaattaccacccccacggtgactcgtcgatttacgatggcatggtacggatggcgcagccttggaaaatgagtcacgtgctggtggatggtcacggtaactggggctcccaggatgatgatccggcggcagctatgcgttatacggaggctcgcttgtctccgatcgcaatggaaatgctgcgcgatattgaaaagcgtacggttttgttcaaggacaattttgataactcggccaaagagcctgttgtgttgccgtctcgttatccaaatttgttggtgaacggttccagtgggatctcggcaggatttgcaacagagatccctacacatagtttacgcgaagttattgatgccagcattgcggtgatggaaaagccggagattgagctggaagagattatgacctttattaaaggtcctgatttcccgacgggcggactcattatgggtggcgaaggcatcaaggacgcttaccgcacgggaaaaggacgcatttatattcgttccaaaacggaaattcagtctttgcgcggaggcaagcagcagctggtcattaccgagattccgtatcagatcgtcaaatcaaggctcgtaaccgccatggaaaatatccgtctggagaaaaaggtggaagggattgccgaggttcgtgacgaaagtggacgaaatggtttgcgcatcgttgtggagctgaagaaggaagctgatgcggaagggattttagcttatttgctgaaaaaaaccgacctacaggtggcatataacttcaacatggtagccattgtgaacaaggcgccacatcagcttgggctgaagtccattttggaagcgtatatcgcccatcaacgcgaagttgtcactcaccgtatccagtatgaactggaaaaggcagaggatcgtgcccatgtgctggaaggtttggtcaaagcactgaacattctggatgaggtcatcgcagccattaaagcttccaaaaatcgtcaggacgcacaaaataatttgcaatggatgtttggttttagcgaacgtcaggcagattctattttgactttgcagttgtaccgtctcaccaatctggaaatcaccacgcttgaaaaagaactgggtgacatccagaaaaaaatcgcgcaatatcgttctattctggaaagtgatcgcaagctgatcagcctgattcgcaaggaacttttggaaattcgcgaaaagtacggcattgaccgtcgttcagatatccagggcgaggtagaagagattaaggtgaacctggaagtcatggtgggagcagaggatgtgctgctgacactctcgaaagatggctatgtgaaacgtacaagtatgttgtcattcactcgttcaggcggggaacgttcaagttctggtgttaaagaaggggattacgttacccaattgcttgatgtgaatacgctggatgtattgctcgtcttcacccagcgcggacaatattttttactgcctgtacatcaggtgccagagtataagtggaaagagccgggcacaccaattgtcaacgtcattccgttatcgaaggaagatcgtattgtaagtgttattccgcttaaaaacatcgaggaaatcggcaaaagcctggtatttgtaacaaagaaaggccaagtaaagcgtacagaattgaaagaatatgctacaaaacgttctagtgccgtagccgcttgcaaagtagcaggggacgatgaagtgttatcagtaacgttaagcgagggtacccgtgatattatgctgattacccgcgcgggtatgagtatacgcttcaaggagcaagaggttaatgcgatgggccgcgtatcggctggtgtcaaaggtatacagctagcggaaggcgatgaaattatcgcggcgttatgggtagaagaggatgaaggagaagtgttggtgctgaccgagtctggttatggtaagcgtacgcttctgttggactatcctacacagggaagaggcggcaaaggtatcactacctttgagttcaaggaaggcaaacgagtacgttcgaatggaactcgaatcgtggctgccttctattgccgtgaagctgttcaattatttgcaatcacagcagaaggacaaacgatgtccttcctttcggaaaaggctcctttgaccgaccgaaaggatacaggcaagctgctggctccagtggagaagaaggacgaaattgtgaatgtgctgctgcgtagtgagccgcaaacttctcagtccatagaataataggaaagtcaagcgcttattagctcgaaaaagagaggtcctctcgtgccattccggcacgaatgaggacctttttgccgtcatggtgtcgaactctgaccagccttcaaaaccgaggtgagacttccttccccttttcatttgatgctccaaaaacggcaggaaaccggggctgaatggcgaaaatttaatgtgatgaaatacaatccggacggtggcccatacggtaactttgatgcttttactgaccctgttattcaaaggagtgaggcaaaatgcaaacgaccgaatttgcgaaaatctggtccagaatggctaaggattataaggttcatatggagcagcagctggctccatcactaaccgaagctcaacttacggtgctggaggttttgaacgaatacggccgtatgaaaccgtctcaactaatcccatatctcgccaccacaccagccgcggttacgatgctgctggatcggatggaacggaatcgactggtcacccgtttcagagacgtaaaagaccgtagaattgtatggattgtcatttcggatcaagggagagaagaagtagagcgtggattacgaatacgggatgattttctgggttctgcactaaaccgaatttctcagcacaatcaaaatttgctggtttatttgttggggaaaattacaacgaaggcgaagacttcagtatcggcaagtgagactgagggagtaaaggaaccaatagagcgagcagaataactagaatggtggctacatgaaaagtagctgtacgcagcagattatcaatttaaggcaaataggagtgcgcggatgtaaatacctatcgtggtattcataccgcgcttttttgtgttgaagtataggtgatatttgggtgaatgttgacatttacataagagatgataaaataatagttattaataaataacaattcgtgtacaaatagttgcttgtttaagttatatggattgtgaattgggtattagaaagaaggatggtttcagtgagtgacagagaggaagacagacttgaggtgtaccggattattcaatcggtaagggaggttaacaaaacgatattttatgccttctggaatgaggagcagcatttggatctgacggccattcagcatatggctttggcaattctgaataagcgccccaacatcgggttatccgagttggcagacatagcgcatgtgggaagcagctctatgagtggagtggttgaccgcttgaccaaggcgggatatattgctcgcggacggcatgagcatgaccgtagatccttagtgttgacgcttacgccggaagggaaagatattatgcaaaaagtagacgccatgtggatggagcgcgtcttgcccattctggacatcccgaaggagcagctagagatggtcctggatatccataaacaaatgatcatgaaattaacaccgaagggaatgaatcaacttgagcagtcctcaaatgacactaccaggtaatgtacgcagagcacccattgtggccgctctgttgattggcgcgattgtagcgatattaaatcagacgttgatcagtgtggctttaccgaaaatgatgagtgatctgaatatagatgccaatatagctcagtggctcagcacgggctttatgctcgtgaatggggtattgatcccggtgaccgcgttcttgattgcccgtttctccactcgtaaattgtttattagcgcgatgactattttttcaatcggcacgctgttatgtgctatagcaccaagcttcagcatattgctgatcggtcggcttattcaggccgcgggggcaggtatcatgatgcccttaatgatggtcgttatcttgaacatttatccaatagagcgtcgtggccgggcgatgggaaccctggggattgcgatgggttttgctccagccattgggccaaccttatccggttatatagtacagcattatgactggcgggtattgttctggatcatcctgccgatatcagtaatttcaattgtgatcggatttatttttctgaaaaatgtaacggagcagtccaagccaaagctggacattcccggcatcattttgtctacgctcggtttcggtggactgttatacggctttagtgatgcaggaacatcaggttggggaagtattcctgtcctgtctacgcttatcgttgggacaattgcgcttattttgtttattgtccgccaactgaaggcagatgagcctatgctggagttccgtatctttaaatacgatgtgtacagcttgacgacaatcattaatgtgattgtgacgatggctttgtacgctggtatgatattgcttccgatttatttgcaaaatattcggggttttacaccgctccagtccggtatgctgatgttaccgggagcgattctgatggggctcatgtctcctgtaacgggggctatttttgaccgaatcggagcacgctggttgtctgtaattggcttgctgatcatggttataacgacttgggaatttacaaggttgaccgaaacaaccacctatatgacactgttaattaattatacggtgcggatgttcgggatgtcgttgctgatgatgccgatccaaacggccgggttgaatcagcttccgcaacgattgaatgcacatggtacggcgatgagtaatacgctgcgtatgatttccggctcgattgggacggcaattctggtgacagtgatgtccacacaaagcagcaaccgcttgacatcgattgttacatctgagggactaagcgtgacggataaagcggggatgctggctgcaggtaatcaagctacgatttatgggattaactcggcttttatcattgcaacagcgttgagtgtggccgctctgattttagcatttttcatcaaaaatacgaatgcacaaaacgcccatccccgtcaacagctggtaaacagcaagaaggggcagtccgtggcttcctcgtcataaaaggatgagatgacgcattaatttaattttctgcaaaaaaaagaacctgcaatgcatggttgttcacatgcgttgcaggttctttgtgcaaatggggtcgaagatcgatattcagatagagcagggctttccgattcaaatttcagacgtaatcatgttctcataaagcgaccttggccattcattccatggaaattggacaggaggtaacgagtgaaatctcatatcgtccttgctaaccggatgcggtgctccagcgagtaaggaccagagcgccagctgttgaccggatcggctcagatgaccgccatatttttggtcaccgtagaggggacagccgatcgcctgcatttgcacacgaatttggtgtgagcgtccggtgtgcaacttaatctgcacgagactgagtccatctgcttgtccgatcacgcagtactccaaaatggcttctttcgcaccagctgtgccaggtcgaaccgcttgaaccgtgttggttcggctatcctttagcaagtaatgggttagacggccctgtgggtccgtcggaacgctattcagaactgcggtatacagtttgtgaaaatgacgacttcgtaccgactctgacaggcgagaagcagctttggacgtcttagcaaaaatcatggccccacctacaggccgatccagtctgtgaactaagcccaaaaaaacgttaccaggcttattgtgtctgatttttagatcttccttgagtaaagacaacagatcaggatcaccactggcatcctcttgcgttggaacattgacaggctttacaactgccaaaacatgattgtcctcatataggacaggaatgttgggcagtgcatgctcatgccgggtaagttcattttgagtcataagaggaatttaagcctcccagcgtccgagaataccacaaggcaaattcaatcccgagcgtgtgatcggcaatccgatttcaccagcgctaatttgtccgccgtacttttgttgcatggtcatgctcagcatattgcgcaatacagtaggcgaaatacctgtagtataggagttaatcagcatgaacagcggttgatccgaaatgatgctcatgcaggattcgagaaacgggtataagctttcttcaagcttccaagtttctccgttcggtccgcgtccgtaagaaggggggtccatgataatggcatcataacggttgccccgacgttgttcccgttgcacgaacttgaatacgtcatccgtaatgaagcgtaccggacggtcagccagaccagacaattgaacgttttcctttgcccactgtaccatgcctttggcggcatccacgtgaactacactggctccagcatacgcagcagcagtcgtggctcctcccgtgtatgcaaacaggttcagtacggaaatcggtctgcctgcgcctttgattttatccatcatccagctccagttcgctgcttgctccggaaaaagaccggtatgcttgaagctggtcggtttaatgtggaatttaagcggtccatagctaattgtccagcgctcggggataggttttttcatatcccagttgccgccaccggaggaactgcggtgataatgcccatgaacattacgccattcggctgtttcctgggccaaaggccatatgatttgcggatcgggacgacgcaggacaatatcaccccaacgttccagtttttcaccaccgcctgtatccattacttcatagtctttccactcttgtgctacatacatgtacaatccatccttcagcagtcaattcaggatttaggcagcaagctgcacagaaatccccatatggagtctattgtacaacaaacctcagcaacaatcgaatgattacataaataagtaagtagtcaaatggtctaaaatattttttctcggatgtacttgtaattatagcgcttccatattaaaatgaaatcaatcccacttgtacgtacaacaatccgtttttttattaaaataatgaaaaacggattggattgtacgtacataatattttttatcaacacagctgaaattctacttaattaaacaaggctctaatttaatgtgcttatccatagagattatcagccaacagtcgcatgtaatgcggctgttttgcgtatatctccccaagaataaagctagttttgaaattaatatttgacaatgagaatcattatcaaatattatttgagtaacagggagtgaaagcatcccatatttcaaataaaggtgagggatgaacttgggtaaaatcatgattgcttatgccagtttgaccggtaatacagaggaaattgcggaattgatcgccgagggcgttcgtcaggcagggcatgaggcggagttgaaggcttcgtatgattgcagcgcgcaagaactgctcgcatatgacgggttcctactgggtgtatatacatggggagatggtgagcttcctgatgaatttttggatttttacgaggaactagacgaacttgatttgtctggtaaaaagaccgcagtatttggcagtggagatacatcttatacgcaattctgtggcgcagtggacttggtagaggaaaaagtcaaagaacgcggtgcatcggtcattcaagagagtctgaagattgagttcaatccattggatgatgacaaggagaattgccgagcttacggaagacaatttgcacaggctggtattgaagtgtcctgagaagagagtgagggataggtatgcgcaatagcgatagcttaagcggctttcctcttctgcacgactatcagctggaggagatgtggagaactccacagccaatccgtcaatcacagaggaaaagagggcgtgagggctggaattggcggcaacgggttcaatatgcagtagggcatgcgcttaacgaatactttggaatggaagtaaaggtacggcgggaagtccctgtccagtatgtgctggagaaatggtggcccaagcagtcagatagctttgaatctttgttccattattgggatgtcaaaaataaagtgtcaggtgagttgtcaaaaatttgtggcttaaataatgacttgatggtgcctgtgatgctgtatgaacaattttgtacgtctgtgcctgagttagaggtcaatatttcgcttattgttcaggctgcttggcaactatcagcagaagcagattccctgctcattcaaaagtacatcgttgactataatcctaacgttgtcagtacattccaacatatgacaaatgtattttgttattatgcatttggagctcttcctcagcttattgaggtatactgtctgctggaaggcaaaaaggttcgcttcattccgggacctgcttctttacagcaatctctggattacgtacggctattacgggattccaaagaggatgtacatgggacggcagaacgctgcctttgcggggggtgcataggggagcaagtttctcagggaaacagaatgaataagaacacgaaggaagggcaggaggcgaaaaactgcaaacaacggtcagctgtacctacgcctttctcttaacgttactgtgtaaccctttaattgtaaactatcccttttcgtgaaagagccttggaaacaaggttcttttttatgaaaaaaaattatgaaaaaactgaaaatttatgttgcctgaatagataaatatatctataatatttcaatgtacaatagttatatgaaaatatttaaatataaaaggcggtttgtggaccatggatcagattgtcctatgtacataagatagtcctgtcttttgcatggaatgttgccatgtgtttatttacgttctctatttggtttaatggcctaatatttcaattttaaaatattagcgttgaataataaaaattttttggacaacaggggtggaagaagtgagtaagaaaactgtattgccaatcctcattgtactgctcattctgagcggtggagctattggctactattattggtatcaagcaacacactttgttaaaagtgacgatgcgcgtattcaagccgatcaatataaggtaatgccgcaaatctctggagaaattagccacattgatgtggaagaaggagatgttgttcagcgtaatgaaccgattgccgagcaggatgtatcggggctggatgcgagcatgatcagcaagtccgtactgcgcgcgccgatcaacggaaccgtcattaagatttattcgaaagaacatgaaatcggatcgccgggtagtgctgttgcaactatggtggatatgaacagcttgtacgtatctacgaatattgaagaaactgatattaaccgtattaaaccaggacagcttgttgatattacgcttgatgcagcaggtgaccaggtgattcagggtaaagttcgtaaagtgggcgaagcctccaacgccgtgttctcactcgttcctgcagtgaacacaagtggtaactttaacaaggtgactcagcgtgtgcctgtagagattgctgtgaacaagccgaaggatctgaaacttattcctggaacgaacgtggaagtaaaaattcatacaccttaaaaaggaggggtccatgtggctgccaatgatattgctgctgctccttcgacagattcttccaaagaacgctggcttgcctttttcgctatcgttttaggcgcctttgtcgccattctgaacaacagtctgatcaatgtcgccattcctagattgacgacagatttaggatctacgacgacacgtattcagtgggttattacaggttacacgcttgcatctggtgtaatcgtaccgattaccggatatatggagcagcgcctcggatacaaaaagtttttgattcttgcgctcagcgtattttcgctgggaacgggaatatgtatttttgcatggagtgattcttccctgatcgcagcacgggtgctggctggtctgggcggtggtgttattatgccgctgagtatgacgattatttacaaaattatgccgcgtgaacaaatcggtatgtcccttggtatatgggggatcgccgcaatggcagcgccggctgtagggcctacgctcagcggatatttaattgagtggtttaactggcgattcttgtttattgtcagtgtgccagttgctttatttgcaattttaatggttattcttctaattaaagaaccgcctaaagtagagccgaagccgtttgatctaccgggctttttgctggcggcaacttgtgccggaacactcttgtacgcattgacaaacggccagcgtgatggctggacttcctttggaattgtatccctgctgtttattgctttctgggcacttgtttttctgatctatgtagaaagcggcaaggataatgctgtaattgaaatctcattattcaagaattcaaagtatacgattagtgtaattgcctctagtctggtcatgatggggatgtacggaggaacgttcctaacaccgttgtttttgcaaaatatccagcgtgtgtcaccgattgataccggtattatcctcattccacaggccattgccatggcggctatgatgcctattgccgggaagctattcgataagttcggcattgtgcctttgggacttgtgggcctgacgctaaccagctttatgacctatcatcttcaccagcttacgccagatacttcgcatgcctggttggaaaccgtaatggcattacggggtctgggaattggtatttgtatgatgccattgtccacggtcggcatgaatgccgttcatccgagcaaggtagccaatgcgtctacagcgtccaatctggtacgtactgtggctgcatctatggcgattgcggtgttaaccgccattatgcaaagccgttcggctgctcatgcccagcaaatttcggagtccattacaccagactcggctcatgcgcttcaagcgacattgggcagctcatggatgtcatccataagtagtttaatcacactggatgctacatcaagaggaattggggatacgttcctcatttcatccataccgctgttttgcacaattccactcatctttttgtttattcagaggaagaaagcaaagacacagccggaagcttaataagtgaagtacaaaatatcgactggatgacttacattatttccacggacagaaagaaagggaattatcatgaaaatattgagagtagaaagtacattagcggctttagtgctcggcggcgcagtgctggcaggctgctccagtaatagcggggcggctcaggacatggtcgttccggttaaaatcagccaagcacagcaaggcatcatcggacagggaaatatttatacaggaacggtaacaccttcggagacggtgaacattgtgcctaaagtgggcggtaaagtggttgagctgcctgtggatattggctccgaggttaaaaagggtcaagtactgttcaagcttgatgataaagacatgcggaataatgttgcgaaagctcgcgccgcagcagctgcggcagcagccggagtaagtaccgctcaagcatcccacgaatctacgatggttcaagcaaactcgggcttagtgcagtccaagagcggcgtgattcaatcccaaagcgcaatcaatcaggcacagggggctattaatcaagccactacagccgtagaacaagcaacacatggtgtctcctcggcagccaatacggtgaaacaaacgcagcaagctttggcagatgcacagaagaatgtaacacgtacacaaagtctattcgatgcaggtgcgagcactcaagcacaattagaacaagccaaaacagcagttgtgaatgcggaagcggcttacaataatgcacaaaatgcgcaggctaatgcacaagatcagttggtagctgcgcagaaggccttgactacagctcgcaacagctatgattcagcaaaaaatagctacagtaatgccaatagtggctacagcaatgcgcaaaaccaactcaaagtatctcaaaatactgcggtcatcgagtccagccaacaatctcttaagcaggctcagctgaatgtaaacattgctcaggatgcattggatgacaccgttgttacatcaccgattaatggtattgtgggtacgaaaaatgcagaagtgggtgaaatggtatccgctcaatctcctgcgctggtcattgcgaatctgagtacggtcaatacattaatctatgttccagcggaacagataaacaatgtaaaagtaggtgacaaggtacaggttcgtgttgcagcgtccaacattgtaacaacaggtacagttaaaaatgtaagcccgttggatgcaagtggaaaaggctatcctgtaaaaatctcagttgcgaatccagacacaaaattgaaatccggcatgttggctgatatcagctttgtcgctgccaatgcacaagaaggcattgtggttcctactgcggcagttcaaaaggatcaaggtaaagaatatgtatatgttgtaaacggagaccatgcaaaacgtaaggaagtgaagactgttcagacggcaggttcacaaacactcgttaccagtggcttgagcaatgaggagaatgtgatcgtgaataatctggcattgctgtccgataactcaccgattacaattagccaataatttggttctagaattactactatataatagtagaagtttattatagacatatgcgcaagacagcctgcttagtgggctgtcttgttttgatttcattgagcacattttacataggattgatgtcgatataggactatttttgacgaacattggtagaataggatagactaaattggaaatagatagttttcaagatttattacattctcagataagtgatcggaggaattgtaagatggaagtaaaattggtagtggattttgaagcttatgagaatggccaaacgatggctaaattgcttgaggaactggcagccaagccggagagcgcggaagttacggatctgatcattggagattggggtggagcctatgagagctcaccagatgatttcatcccagtgttagtgaagcttaaagatcatttccctaagttacgcaagctgtttattggtgatatggaatatgatgagtgtgaggtttcatggattaaccagacgaatctatccccgttattagaagcgtttccagcgttggagtcctttcatatcaaaggaagccaggacctgagtctggaaccacttcgtcataaccaccttcaggaattggttattatttgtggcggcctgcctgtgagcgttcttcagcaaatacacaatgcagaactgcctgaactgcgcaagctggaactgtatttgggtgtcgataactatggttttgacggtaacctgaaagatgttttgccgtttttgaatagcaatcctttccccaaacttacatacttgggactgaaagatagtgaaatacaggatgaaattgcgattgcagcagctaatgcccctgtgattggacaactggaagtgctggatctctcacaaggtacgttgtctgataaaggtgcagaagcgctgctggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgttatccatcactgactgagtaatttgtacaaatggacttaaaacggactgttttcaaaattaaaatgatctaaagtgaggcggctctatggttagaatgtcagactgtaatgtcagcgagccgtttatcttgttcggtaatccgggtaatcgtcggactaccggattacaggaggcgcgaagcagattaatgcttccacccgctctggaggtttcctataagaatgtgctggaagctattcggcagaaacaaggtctgagcgagctgatggcgcgaatagctgcgcgagctacgcatgatagcgtgaatggcagttcctttgtgcaagagagcattgatcagttactggcggggcagatgaacagtggtccgctgcttcgtctggatgcaccgggcgaaagttttgaggtagagcgtgagttgattgctctgggcgcctcggatggtgagggagacgattctctgttaccatggcccgaatggacacaaggaacaggtatatcggcggcagaagcgcgacgtctgcaggagcagcacggtcgtatttggcacccggcacaatggttccggggctattgccgtctgctggcctggctgcgggatgaagtggctctgctctggccctcgtcatactggatgaacgatccggcggaagtggccgtgatgttcgacaaacggcgttgtagcgccgatttaagcaaggcagatataagagtcccgccagtgcttgcatcttcaggtggtgcatttcatgatgttgtcgatctgcacgcggcaataaaggagagcgggtttcaccgcgtatttgtgaaaatattttgtgggtctggtgcttctggtgtcatggcctatcaggtacatccccatacacacgcggaactggcggtgaccacgattggaacggaaatcatacgcggacagcgcgtgtattataatgccggacgactacgtcgttatacggataagcaggacattcatgctatccttaactggctatgcctggaaggggtacatgtagagcgctggattcccaaagcgaccctgaacgggcgtgtttatgatgtgcgccaactcgtgtgcggatcagaagcttgccatgcggttttacgtttgagccacagccccattacgaatttgcatttgcgtaatgagcggctctcgctgaaggaagccggattaccacagaatacggtggaatcgatccagcatacggcgaaagccgctatgagtgtttttccagcctccatggttgctggactggatgtgctggttccggctcatggcggtcgtccctatgtattggatgttaatccgttcggtgatttgctgtaccgggttgagcatcagggttggaatccgtatgaatgggaaatgcagcacctcgttaataggagcgtgggtacggaaaggaaagacagatatgattgatatgaaccaaattgtcggctctcatgatattgtcatgattacgcttgatactctgcgttatgatgtagcaaagctggaggaagagaactgtccgaatttgtgcggctccgggtcgtgggaaaagcgtcatacaccgggtagctttacctatgctgcacatcatgccttttttggcggatttttgccgactccagcgaatacggataagacttcacatatccgtctgtttcacacaaaggatacgggactgcgtacgcatccacatacctggctgttcgatgccccggatattgtgtccgggctagagggtgaaggttatcggaccatctgtatcggcggcgttatttttttcacgaagaaaaataagcttgccaaagtgctgccagggtatttccaagaaagctactggcgtatgaactttggcgttaccaacccccgttcgacggagcatcaggtgaatcatgctctgaaactgttggggaatacagacccgtcgcagcgcttgtttttgtttctgaatgtatcagcgatccatgggcctaatcattattttgtgaagggctcagctaaagattcagtggagtctcaacgagcagccttgcggtatgtggatggtgaacttggacgtttgttcgatgctttacgaaatcggggcaagacgttttgcatggttttttccgatcatggtacagcttatggggaagacggctatgaaggacatcgtctggcgcatgaggtagtctggaatgtgccttaccgcgaatttatattataaagcaaatagaaatatagattgcactagtaaaatatcaaaaaatcaatccagcgcgaggaaggagcagaaatgaaagccatgaatctgaatcactcacatccaacgggtgcggtagccccggagatagacacaaacttagcaccctctaggtttcagtggcctgaaactcctgctgaatgggcacgcacgatccgtgaagctccctaccgctcctatctgtactcttacccgcataaaacggcctatcgttcgtttgatacaccgctctcattgcaggagctgtgggagaaggaggagttagaaagctattttttgtatatgcatattccgttttgcgcggctcgctgtggattttgtaacctcttcactttgccggacaagcgtctggatgtacataaggagtatgtggatgcgctagaaagacaagccaagcaatgggcacccattatgggccgtcggcctttttcgcgttttgcgatcggcggcggtacaccaaccttactggaggctcctttggtggagcgtttgtttgacatagcggaaaatataatgggactggaccctaaacgagcttctatttcggtggaaacctctcccgatactgtgactgaggataggttggaggtgctcaagcgccgcgggacagatcgtgtcagcatgggaattcagagctttgtggaatcagaaagtgccgccatttaccgacctcagaagcccaaacttgttagaaaagcacttgagcggctggtggaatacaactttcctttgctgaacgtggatctgatctatggcctgcctggtcaaacggtggaaacctggctgtattctttagaggaagcactgtcttactcgccaggagagatttttctttatccgctatatattcgagaaaatacgattttaaagccaggctataccgggctggatcatgatattcgtcttagcttgtatgaagtggcgcgcgaacggctcaaacaggcaggatatgtacaatattccatgcgccgttttgcaaaaaatgatggtttatccagcaaagagcttttgccctacagttgtcaggaggaaggtatggctggtctggggtgtggtgcgcgatcctatacacgtaatgttcactatgccagccggtacggtgttagtgcagcagctacgcgtagtattatcgaagattatgttgctgcggaacgtcatgatctggctgactacggctttattttaaatgtggatgagagtaagcgacgctttatcttaaaggcgcttcttcatcgggaaggtttggagctatcggcctatgcagagcgcttcgatgtatccctgtcggacgattttacgggaatgtcattgctgctggaatccggtatggctgtcgtcgaggagggtaggctgcgacttacagaggaaggaatggcctattccgatgcgattggggactggatgatctccacatcagtacgtgagcgcatggaaggatatgtaggcgcatgagagcgaccttatattatcgtggttcgttgacctcgtgcaactatgcctgcccatactgtccgttcagtaaaaacgttgatagtcgggaaacgttgaacaaggatcgggcccagttggaacgttttgccgattgggtacgagaacagggcgctctggggcatcgtctctctattttttttaatccgtatggagaagccttgattcattcctggtatcgcaagaccatgattgagttttcccacatggcgcatgtggaaaaagtggcggtacagacgaatctatcgactaagctggattggacgcaagaactgaacccggagactgctgcgctgtgggctacatatcaccctggagagacgaaagagcaagtttttatatcgcaggctatgaagctatatgaacttggcatttcctatagtgtcggtaccgtcgggttaagacaggcatttccggctattcgttccttgcgatcgcaacttccaaggaatgtttatttgtggatcaacgcctacaaggatcgtccacattattatacagatgctgaggttgctgaattaactgcgatagatacctattttcaatggaatttaaaggattatagcagtcaggggcgggcatgtcgcgctggtgaagatgtattttatgtccagggtgacggaagagtaaaacactgctatcaggatcgacgggtgctaggacacttatacagggatggtcttgagggtctgagtggcaaacgtccgtgccggatgaaagaatgcggctgctatatcggctatattcatatggtggagcagccgtttcgagaaatgtacggtagtggcttactcgaaagggtgccgcaggtacagctatctccggttccatcatttagcagacaggctattcatagagcaaatgaatccatataacaaggtacgtccgcgtctaaatgtaatgctatagcaaccctaatgatctattggaaaacgagcaaaaaaaaccgacccttgccctcaagcaaaggtcggtttttctgttttataataagtttgtgcgacgatcttatgcgaaataatcaagtttggacaatagcagtaatttcttcatccagatccaatctgatttgttcgcgataggcacgaatattgtattcggaatacagatatctcagaattgcttcaatcatgttggcttccaccagatattgactacggccctgtacatggacttctgcggaataacctgtatcctcttcccagcttaattctactgttacatcagtgggctgtacacctttgcgttcagccatatgcaagcaaatagcgttgacaatttcatccatactcaaaatcatagcttagtaacgtcctccgcgggaatcatcgggtctgcgacgatttttaatagcacggtagatacctactccggccatgatcaggacgtaaatggcgagaacgttaacggccagaccaagcaagctacccaatgcgcccatgttgccgaacaatccgccgaagagcatacctgccaaaccgcccagcatcatacctttcaggaatccgccgccaccgccaaggaatccaccagttctgtttgtattcccagcagttgctcctgacttggttccgctatctgacttattgacgccactgctgtcatttgccttgcttggtgtagattggtatgatttaggcccggatttaaacccgccgcctcgccttgcatcagctgtagatggtgcgatcatagcaatgagtagggtaaaagccatcatcagcatcatcatatttttcaaagtaaatgtttttttcatgtaaatatatcccccttagtaaattttttttataggtcaaacaaccgctaatcagtaatacgaatggcatggaaaagggtttcaaagaattttaatttttaaaaattaaataataacgtcccataaatcctatgcatggattggtaaaagcattcagctttgcggcttaagtaaaaacggattagtatccgtactgacatcaccggcaagcagcatacgcagaaccatttggcaccattccagacctgctttagcattcaaaagtcctttttgtactaaaatatagtcaccaaaggtcttactgccaaaatgtaaattctctgctggaatgtcgttcaaaatatcctcaagatgctggattttctgaataaaatgacgtttgcgttcctccagcatacgattggcactacttttgtccgtcaaccaaagacagaacagtcgaagacttaattcatcccgtgtaaccggagcagctaacgcttcctgggaccattgctgaagcatatggattcccttgtcggtaatggtatacattttcttatcaggcttgtcggactgctgaatccaacgagaggctagcagttccttgctctccatacgggccagtagcggatagatctgactgtgcttagcctgccaaaaaggctgaatacgcaacatcagatcatagccggaggattcctctcttgcgagaagccccaacagaccatacgatagtaaattcatagatcttatctccttcatccatcatagtaacggttgtaacagcactgcggcaggtattctgcagcttcatgaaaagtgtacactgaaactgtatggtttgacaactttcagacaggtcgttcacaggttagccaaaattggctcctgtcattctccacgtatatgcgctttttttcataaaaaagggtagtttaggctcgtatgtacgagcttaaactaccctggtaactttctgccgaagcgtatcctgtttactgttcattcccgtcaacgacaagcgttaacgctcctgtatctggatgaataaccatgccgtgaacgggggcattaggggggagaagcgggtgattcttaataagcttcacggtagttcttaccccttcttcaatgttatcaaaaccttttaaccatttattcagcttaatgcctgaattttctaatgtgttcagcacttcctgagaaattccgcgatcgagcatttcattgaccatgtggtctgcatttaatgcagccataccgcattcataatggcctacgacgacgacttcgtctgctcccagctcatacagggcgactagcacactgcgcattacgcttccaaagggctgtgaaataatcgcacccgcatttttgatgattttcacatcaccgttgcgcaggttcatagcttttgggagtaattccgttagccgtgtatccatacaggtgataatgaccatttttttattggggaacttgcccgttctataggcctcgtattctttgttttctacgaaaacacgattgtactctaaaatttctttgatgtgatccacgattgttccctccagattctaataaagtttgatatgtacagtccaacgtttgttttaggtcttaggagctggtcgtacatgttgtgtgttgattatactttttaatataagtatcatcaagtataggtattgtaaagttttaaccattttaagttaaagaggtgacctcaaatatgacgcaacagacgttggatcaattgacggctttaaaggagcttgcacacaaaattagtagttatggcgaagcagtaggtctgctgcactgggatttacggactggcgctccgcgcaagggcgttgatattcggtcggagacgttgggtatgctgtccactgaaatgttcaagctgatgatctcggatgaaatgggacaattgctgcaattttttgccgtagaagacaagctgaagcaactggaggacaatgatcgcagattggtggaggaatgccgtaaaaattatgaactgaatcgttcggttccggcagaccgataccgggattatagcattcttgcagcacaggcagagagcaagtgggaggacgcaaaggaacatagcgattttgccggatttgaaccgtacttgtctaaaatcgtagacatgaagcgtgaatttatcggctactggggggttaaggatacagagtatgacacgcttttggatcaatatgagccggggatgacggttgaaaagctggatgctgtgtttgatcgtctcaagaagcgccttgtacccctattgtctaaaattcaggcttcatcgaaccagccggataagagctttttagatggtgtgtttgatgtgaagcagcaggagaagttcagcctattcattttaggacagatggggtatgactttgacgcaggtcgtttggatgagagtgtacatcctttcgcaacaggattaaatccaggtgatgtgcgtataacaactcattatctgcaagatgatgtaaccagtgctattttcagttctttgcatgaaggaggtcatgcgctgtacgaacaaaatattgctccagagctggcaggatcactactgtctggaggaacctctatggggattcatgaatcccagtcccgcttgtgggagaataaaatcggacgcagtcgtgctttctgggatcggtattacgatgatttgcaaaagcattttcctgatcgtttggcaaaggttacggcagagcaattctaccgggcagtcaaccgtgtggaaaattcactgattcgtattgaagcggatgagctaacatataatttacatatcattatccgttatgaaattgaaaaaatgctgtttaatgaaaagctggatgtgaagcgtctccccgaggtgtggaatgcgaaatataaggaatacttgggacttgttccaccgaatgacggactgggcgtacttcaagacgttcactggtccggcggtgattttggttattttgcttcctactcacttggcaatatgtatgcagcgcaaattttggcgacattacgcaaagagttgccaaatctggatgaattaattgctgctggagagcttgagccgatcaagcaatggctgaccggacgtatttaccgttacggcaagagtcggacgccgtccgagttgattgtagccattacaggtgaggatctgaacccggattatctcgccgactatctggaagagaaatatacctccatatacaagctgtaaatcatatagcatctaccccgcgttcccgggcgaacgtggtttttttttttgcaattaaccaatatatcgacaatggcataacaatatatgaagtcaaccgatgtaaaaaggtggggagggaataaggatgaaaaacggcgctcgtttcaaagctgtggtggctgcggcactactcggattactgttgctcagtgggtgcacccccaaaggaggggagcagacgattgagatcagattaggcgaggtagcccgtacggtcttttatgcgccgcagtatgtagccttgagccagggaatgtttgctcaggagggactggatgtccagctggcaacgattcccgggggtgacaaggcaatgacggcgttgttgtccaatcaggcggatatcgcgctgatcggcgcggaaacatctatttatgtgtatcagcaaggagcagaggaccctatcattaattttgcccaactgacacagacggatggaacctttttgtttgcccgtcaaacgcagaatagctttgaatgggaaaagctgagaggacaaaattttttggggcaacgcaagggtggaatgccgcaaatgtcacttgaatttacgcttcgcaaacacggcattgatcctcacaaagatctgaagctgattcaaaatattgattttgctaatgttgcctctgctttcggctccggtacaggggattatgtgcagctgtttgaaccgcaggcatctatttttgaaaaggaaggtcgtgggcgggttgttgcctctatcggtgtggagagcggcgagttgccgtatacagtatatatggctaagcaaagctacctgaacacaaatagcgaggctgcacagaaattcacaaatgctgtatatcgggcacaacagtggattgctacgcattcacctgaacagattgccgaagcaatcacgccctattttaaagatacagatttagctgttttaacgagtagtatcaagcgatataaggaacagagtacctatgctttgaacccgatgattgaggaaaaggaatggaagaacttacaggatgtcatgacctcggcaggggagcttaaaagtccggttgcactagataagctagtgaacccaagctttgcacaacaagcgatttcgtcaagctctaccgggaatactgaaccgcctgtgaaaaagagcacaactgaatctacggatgcaggtgtcggtactggaggttcatcatgatggaggaacggagtggcctaactttggacgcgaccatcccgatggtgagactggagcaagtgacgcatgtctatgtaacggatcgtgaagcttcgctggcggttgagaatattgatttttccgtagagacaggggattttgtcagcttggttggtccaagcggctgcggcaaaacgacgatcctgtccatgatcgcggggctactgcgtccagcggcaggccaagttatgttgcaaggtcagccggtaagtggtccgagtccagaggtcggttacatgttgcagcaggattatctgttcccgtggcggacgataatggataacgcattgttgggtctggaactaggcaacagagtagatgaagctgcgcgtgagcggacacggctgttactggaaggcatgggtctgggagggaaggagcatctgcatccgtcccagttgtctgggggaatgcgccagcgcgtggcgctggtacggacgctggcgaccaatccgggactgctgctgctggatgagccgttctccgcgctggattatcaaaccaagttacagctggaagatctgattgcggaaaccttgcgcgagcggaggaagacggctattttagtcacacatgatttggctgaggccattgcggtcagtgaccggattatagtgatgggtcgaaatccgggtcatatccgacgtaccttcgagattccggattgcatccgagaagctcagcctttttatgcacgcgagcagccgggttttaatgagctttttcatgaaatatggggtgaactggaggcttcgggagcaaaggagtgagttaacgtatgaaggacgaagcggatcagcttgagcaacgttggattcaaggactacatcaggcgtatttacgcagcaggcgttcgcaacgatggttagtgacaggtgtgcagacagctattttactgcttttgtttgtgctatgggaaattgcaggccgtttgaagtggattgatgtactactgttcagctatccgagcaaaatttttacccagatcggcaaggatgcggtcagtggtgaattatggggacatgtaggtgtcaccgtgggagagacgatggcgggttttttactcggtacactgttaggtacgttgctggctgtacttatttggtggtcaccgtttttgtcgagggtgcttgatccctatatggtcgtgttcaacagtatgcctaaggtggcgctaggtccaatttttatcgtcatgtttggggcgggatttactgctatcctaatgacaaccctctccattacggtcatcattacgacactagtcgtatacaacagctttcaggaagtcgattcgaatctgatcaaagtggttcgcacgtttggcggatcacgccgtgatacgtttcaaaaggtgattttacctgcatcctttcctgcaatcgtctctacgctgaaagtgaatgtcggtatggcatgggttggtgtgattgttggtgaatttctggtggctaaaaacggcttaggctatttgattatctatggttttcaggtgttcaatttcacgctggttatgtccagtctgttgatcattgctgtcgtagctacactgatgtatcaggcggtcgtgtatgtggagcatcgtctgctttctggtcgtcctcatcggtaataataaaatttctgaacatttgtgtaaaacgtgaaaataaagtaccatgaaaaatgaaaatacttaaagtttatgaaaatgaacattatgcataaatttcgaattatgcaaaatgctgaaacagatttcatctagagaggacagaattttttcatgggctttcgtacgattaaaacggctattgccgcattaatggccgtacttattgcggagggttttggcattcatggagccacctcagcagggcttttagcgattttgggggtggatgtcacacgcaagagaagtctccgtaccatttcggcgagattttttgcatccgtcgtggggcttctttttgcttgtgttttgtttgtggtattcggattccatgattgggtactggcattatatattttaacggcgtttccagtcattgtacgggtgggatttaaagaagggatcgtcaccggttcggtcgtagtttttcgcgtatttagcggcggcgtgattgatatggaggtactgctgacccagctagctctgctagtgattggactgggttccgcgatgattgtcaatttagcctatatgccgggttctgataatacaatgcaacaaattcggcaggaggtggatcggacattttctgttatattcagaaatatggccaatacgctacgtagtccagcatacatatgggatggcaaggaagttattgaagcgaacagcgtgatagccaaaggggttactgaggcggggcgttccttggaaaatcagatgcttcgtccccaagagggctggaatgtgtatttttatatgcgaaaagaacagctggattcgatccaaaatatgatgcagttgatcgcacaaatgtatcagcatatgccgcaggccaagcttctggccgagctgttcgatcagcttagcaatgacgttttggctggacattatacgggacaaaccgagaagctgctagagcaggttcgtgaagaatttaaagccatggagcttcccggaacccgggaggaatttgagattcgctcggcattattgcagcttacacatgagcttcatcagtatttgaaaattgcgaaaaaggacaaggcccctactccagtgaaaaactagagtaaagcccttgagaggctactatccatgacggacagtagccttttcttgttcagtaatggtagaagtcggaagattcaaagtccgtttgtgccgaattcggtctgtggtccataagacagcggtgatcaggcaagggtacagcatagcccatccgacaaaggggaaaacgatcgccgtagagatgaacgatatccagctgatggctacgccccagcgactaccacgcagaagcttaattcctgctgcacaaccaccgagataggtcagaataaaggtggcgttcgggaattgaatcagcttagtgagtgaaacagcgccactaccgtacaacaccataatgatcacaaagcacacgctaagaaaagcaatgcctccgataggggtatggaaacgttgcgataacctgcccatccagcgaaaggcctgtccttgccgggataaagcataagcgacacgtgaagcggcaccaacataagcaataatagtagcggtacaaataaagatacccgtcaagcctgcaattatcgcgccccatggcccgatagctcgactaatcacccatacgagcgaagcatccgaatcccctgcaaggtaactttgtgtgcccacagtagccagcgcagttaagaaataaagtaaaccgacaatgacggctgcaatggtcacacctctaacggccgcccgctggggattggtgaattcctctgacatatgggacacggcctcccaaccgataaagcaccaaaacagaatcgcggcggcttgaccgatagagagccagccatgtggaacaaacggggtgaagtggactgttttcatctgaggaagtgctgcggcaatggcgaatataaggacggcaacgatagctatgacgactgcgatctgaatacgtcccgcgaccttcatgccgatccagttgatgatcaggcccaccgccagcatagcaacggctaacattatgcggctttcctctccccagcccatggctgcggtcatatagccggctccggtgagtgcggcaacaggtgctccgatcggaaccgacatgagaaaaaaccacccgatataagcaccggcacgtggggaaaaggccaacgtgacaaaatgcgatacccctcccgcattcgggaatttggcagatagaagccccatggaaagtgccattggcaggatgagcagggtcataaaaccccatgccagcagcgatgccggccccgccatttgggcagcaagaccaggcacaatcaatatccccgaacccagtacagctccgatatagagtgcaatggcctgtggaagaccaatggtggattgaagtttactttcatttgtcatgcagaaaagccttctttctcttgttattttctccagcttatcagataatcaatctatcggaaaaacggaatataacgattgcttgcatcggaaaaaccgattgaaggagcggattatggaatcgcggcatttgtttacctttttaaatgtagttgaggcaggcagttttacgcgagcagcgcgtatactggattatgcacagtcgagtatcactgctcaaattcaagcgctagagacagagttgggtacgccgctttttgatcgcattggcaaaaaaatcatgctgacggatgccggacgacgtctgctgccctatgcgcaggaaatttccaaaatgcatgctatggctaaggatgcgcttcgttcagaaacggaattggcaggcacgctgaaaataggagcaccagagtctctggccgcttttcgtctaccaagtctgatccgtgagtacagagaacggtatccgaaggttaaaattgtccttaaacccggcgaatgctgggaattacgcgatttgatccgttccggtgagctggatttggcttttttgcttcagcctgagacggaggatagagaactgaatgtcaccacgcttattcatgagccgatggccttggttgctccacttaagcattcgctggttacctatacccgggtagagcctgccgacttgaagaatgaaactattttgcatacggaggcaggatgtacgtaccgtatcctttttgagcagtatttgaataaacacggaattttttcagaccctagcctggaattttggagtattgaagccatcaagcagtgtgtcatggctggattgggtatagcgctgcttccgctggtaacggtacaaaatgagctgcgagaaggtaaaatggcgcgtttagcctgggatgacagtgaacagcaggtggctactcaggtcgcttatcacacgaaaaagtggaaatctccggctcttagcgaatttttacagatcattgagcagcatgtaacacattggcgtgcatgagttcaagccatcgcggcatatgcttatacaaataatattttttccttttcgcctattcactcaacattcgcccacaacctgcatacatatgtatggaatgattgattgtatggaggaggttcaagaatggcattaagtcataaaaatcgtagagagattattaccaaagcgatctgtggtaaaggtcgcagattctctaccgtaacccataccgtaactccgccgaataatccaacgagcattttaggggcatggattattaaccaccagtatgaagctgtggcggcgggggacggcattgaggtcgtcgggacgtatgatatcaatatttggtactcatacgataaaaactcgcagaccgatgtggccaaggaaacggtgtcgtacgtagaaaatgtgccgctctcgtatcttgatccgaagcaccgggcgtctacagtggaagtatccgccgaagctacacaggagccgagttgcgtcgaggccagtgtgtcttctggaggtggcagcgtaatgatccgggtcgagcgggaatttgcggtggagctggtggcggaaacgaagattgttgtagaagtattcccgaatggtagcagcgatgattttgaaaaagactttgattttggagcggaagagggggactatgaggagctcgaccccgacctcattgacgacgagctctgacagaagtaaccaaaaagagggccgctttactctttgcgccggctgattctgcgcagggggcaaaggccctccttttttattgtttgggttgaaattggggtgaaatccgtacgtagtccgtagggggggatacgatgcagcagccgggacaggcgctcatacgcttcagacagatgccaaatgatgaaaaaaagcgtagactggagcgttcaggcatagcggtgcagtggatggatagcagtatagcagattttgcgataggctacgcggtgcaaatccatcaactgcgagtgttggaaattcgtagacgtgccatcgagggaccttccaaagtccgcgcatacgatctgtctgagctggatcaacattcaccgctctatgtccggatggagcggctggctgtacgtgcgttgtacacactgggtttggacagtggtgaggtggtactgacgccgctgggggagcgcagctgtcaggtgcgcgaagtctcggcacagccatggctgaacgatagacgtttggccacgttatatgaaattgctgcgcgtgaaggggatattgagggtgagaatctttcagcggaacgagggagagatcgactactcatcggaatggaccctgaatttgtgctggttcgtatgccagagggacgggtcgttccggcatcaagatatttgggtcgtctcggcatagccggctgcgatgcagttacccgccggggacgaacgctgtatccagtcgctgagcttcgtcctgcgccaagtggagatccggcccgtctgctgaagcatctgcgtcaagcttttgcaaccgcagcccggcgcattgctgaccgcacactcatctggcaggcgggggggatgccgcaaccgggttttccgctgggcggacatctgcatttcagcggggtttcgctaaacggtgccttgctccgggcactggataactatttggcactgcctttggcgctactggaagacaagcgtgcggcccggcgcagaccgtattatggcaatttgggtgattttcgccgtcagtcgtatggaggctttgaatatcgtacactgcccagttttcttatttcgccacagctggcgaaaggtgtgattggaatggcgtttctcattgcttctcaatatccgcgtttgcaatgtaggccgctgggtcaggaggaggctcacagagccttttatgaaggaaatcaatctgtgcttaaggagtatatggaacctcttattttggatatgatttcactagaaatatactcgcaatatgaagcttatgtagcgccattgctggacagcctccgtaaggggaaacagtgggatgaatcacgggatttgcgcccatactggaagcttacgtaaaatcaagtgtcgacacccggaatggtttcatgttatcgactgtcatttttgatataatgagagataattataagtttaaacggaacaaagtgtgggggttagtaaacggtatgtccaaatatacaccgatgattgagcagtatttatccataaaagagcaggctaaagatgcatttttgtttttccgtctgggagatttttacgagatgtttttcgatgatgcaattcttgcatccaaggagctggaaattacacttacgggtcgtgagggtggcgccacggaaaaaattccgatgtgcggcgtgccttatcattcagctgaaaattacatacagcgtctcattgagaagggttataaggtggccatctgtgagcaaatggaggaagcctcagctacgaaggggatggtgcggcgggatattgtccgcgttgtgaccccgggaacggtaatggaaggcaaggtgctgggtgacaaatccaacaactacatggtatgtgtcacagagacggacggaatgctggcgcttgcggcgtgcgacttgtcaacaggtgaattgtatgtgacttctgtgcctgattcgaaagaatggctactagatgaaattaacatttatgagccttccgaaatgttgggagatggtcatctgctggattttgtgacatcccgtatgtcccccgttggacggcgtgttgtgtatacggcctgggacaaatccaaggatgatttggttcgggatcaatttggggaagccacgtgggcaaggcttacggaggaacgcagacggtgcgtatcgcgcttgatttcctatttgaatgaaacgcaaaaaagatcgttaggccaattgacccaaatctcggtatatgagccaaaccattttatgattctggatccatttacccgcaggaatctggaactggtggagacggtacgagaacgctccaagaaaggctcgctgctgtggctgttggaccgcacagagacttccatgggagcgcgtctgttgcgtcgttggattgacaagccactgttgagcagcagtcttattgaggaacgcttggaggcggtggacaagctataccaccagtttattttccgagaggatgtacgtgctcagcttaaagagatttacgatctggagcgtctagttgggcggatcgcctttggtagtgctaatgcacgtgatctgatcgccctcaagctgtcgctggcccaaattccttctttacgcgagctgtgcgctgaatctccttcgaagacgctgagacggattgcacaaacgctggatagctgtacagacctgtgtgcgttgattgaggaagcggtggcggatgaaccgccaatttccgtaagggatggaggtcttattaaggaaggctaccatcagcgtctggacgaactgcgtgaggcgagtgtgaacggtaaacgttggatcgctgagctagaggccaaggaacgtgcagcaaccggcattcggtcacttaaaattggatacaacaaagtatttggttattatatcgaggtgaccaaatccaatttggcttcattaccagaaggtcgatatgaacgcaaacagacgttggcgaatgcggaacggtatatcacaccggagttgaaggaaaaggaatctctaattctggaagccgaggataaaatggttgatctggagtatactcttttctccgagcttcgtagtaaattgaacgctgaaattccccgtttgcaaaagctggcagagcaagtggctgaaattgacgtgtatcagtcgctggcatcggttagtgcggaacggggattcgtgaaacctgagctgactacaggatatgatttcgtagtggagcaagggcgccatcccgtggtggaagccgtaatgaaagatggcggttttattgccaacagcacgatgttggaggaaggcgatgcgcatattctacttatcaccgggccgaacatggctgggaaaagtacgtatatgcgtcaggttgcgcttattgcaattatggctcaaattggctgctttgtcccagctgcacgtgccaaggtgccgatgctggatcgcattttcacacggatcggcgcggcggatgatctcatcggcgggcagagtacgtttatggtcgaaatggcagatatccaagtaatgacggacaaggcaactccgcgaagcttgatcattattgatgaactgggacgaggtacgtccaccagtgaaggaatggcaattgcacaggcagtcatcgaatttgtccatgacacgatcggctgtaaggcgctggtatccacgcatttccatgagctggcgcatttggagcaaggcctgtcttcgctgcgaaattactctatggccgtgcaggaaagcggcgataaggtgaatttcctgcgcaagctcataccgggagcggctagcagtagctatggcatttattgtgctcggcttgcaggcttgcccaataacattattgagcgagcgaatggactgctgaatggttttgaacaggcagcagctcaagtaacggcaggtaccgagatagtagtaggagggaaggaagggactgaacctcgtacagcctcagggacggaagatatttcttctttgaccgaatataattcaggccagacattgcgagaaagcggagaaacagcatcatcaactcagtctttatcacagcaggccaccctggtaaaagaagatactctacagactgtggaggattccagcaggttggagcaaggagcaaccgaagtggtacagctgtccatttttggagagcaggagcttgccgtctccaagccccatgcagagacagtagaggctaatccgattgtgcgccaaattttgcgcaaggtgaaaaatgctgatgtcatgaatatgactcctttacaggcaatgcagctattaaatgatcttaaaaacaaggccaatggcctgtagttaaaataagtgacattattcttatttttcatcacactttgaagtcaggaggaggttaaaaggatgtctaaaattcgggtactggatgaacatattgcgaaccagattgctgccggtgaggtcgtggaacgtccggcctccgtcgtgaaggagctggtggaaaatgcgattgatgcaggcggtacgcgggtggacgtatgggtagaagaaggcggtctgcaaagtatccgggtcacggataatggaagtggcattgagcctgaggatgtggagacggcattctatcggcacgcgacaagcaaaattggacatggtcgcgacctgtttcagatcacaagtctcggctttcggggagaggcgttgccaagtatagcggctgtatcgaaagtagagttgcttacagcagccggagatgacgggcgtgcccgtaaattggtgattgagggcggtaagctggtgcttcacgaggatgccgctagtaggcaagggacggattttaccgtacgggagctgttctataatacacctgcacggctgaaatatatgaaaacaatccagaccgagctgggacacatctcggatgtattgtaccgaatggcgctttcgcaccctgaggttgccttcacattgcggcataatggcaatacattgttgcaaacgctgggtaatggtgatttgctccaggtgattgccgctatttatggaacttctgcggcgaagtccatgctgctgctggaaggagagagcctcgattaccgaattagcggctatatcagccgcccagagtggaccagatcgaatcggaatgcgatatcgacggtagtgaatggacgttttgtgcgtagctacgggcttaatcaggcgttgctcaaggcgtatcataccttgttgccgatcaatcgttttccgctggctgtgatccaactggatatgcatccttctttggtggatgttaacgttcatcctgccaagctggaggtaaggttcagcaaggaagctgaactgtttcagttggtcgaggattcggtaaaagctgttttagggcagcaagtgctgattccgaaggcagtcaagcgcgagatcggtggcaaggacagtggctcgtttgtgcaggagcagtttcacttctcgaagggaaatggtgcggaaggggatgctccttccggcaaagaccgggggggagcactgccactttccgtgacctcgccagagaaccaggtaccgggccaatccaattacttgaacagaaacgaagagaataacagaggtagccaggagcgtgagcaacgtccgagcaggagtagcctctcagccattggacgggcaaacaacctttcaggtaaaagtattagtgatgatgaactggatgcagattttgtggaagaaaacaacgggagtgaacttagaggggacgtgccgctccctgatggagcgactatacagtcgcccgaaggagataatgctgcaataggcacatcttctttatacagtggagggataaaggaaacggctgcttctgctgcttacccatcttctgtgccgccgattgcaggacacgctacggattcccgttatttcgcggatcagaagcctcgccagcaacgtctgaatgcagagcaattggcagcggtgtcgggaggagttccagagctgcccacttttcctgaactgaatttaatcggtcagcaccacgggacatatctgattgcacagaacgaccagggcttgtatttaattgatcaacatgccgcacatgaacgagtcaattatgaattttattatgaaaaattcggtaatcccgagtcagtatcgcaggagttgctactgccaattacactggattttacgccttccgagacagaaaagttgaaaacaaggctgcactggtttgagcaggcgggggtgtatttggagcatttcggcggtcaaactttccgtgtcagctcttacccgtactggcttccccaaggggaagaagcggatgttattgaggaaatggccggatgggtgctcgaggaaagagccattgatcttgcaaagctgcgggaagcagcctcgatcatgtgctcctgccgggcttcgattaaggcaaaccagaagctgactgaccgacaggctatcgtgctgctagagcgtttggcagcgtgcaaacaaccatatacttgccctcatgggcgacctattgttgtttccttttccacatatgatttagagaagttatttaaaagagtaatgtaagggagtatatatatgttgcaggatcgggaaaaccatgaagaagagcggtcgaggctacgggagaagaaagtcgaattactggtcacgacaggggattccccctcggctgaggttgtggagcgagcgaagctgcttgcagccgagttaggggtgttgtatgcccctcgtcgtggcatatcggtagctaagctaatcgcggctcacagggtccgccaagcattggttctggtgcagggcggagtgagactgatcagcccagaacaatcaccgatggtttttcatccgagtatgggcttcattcgcgccaaacgggtattaaagggtgaacctgacccgatgttggcggctgcccggatcgtcccgggtgatactgtgctggattgcaccgcaggacttggtacggattctcttctattttcaattggaacgggaagctctggacaagtcacggctgtggagagttctttccccgtctatgctttaatcaaggatggaatgaggcattaccgttccggcaacgctgaagtagatcaggccttttccaacattgacgttcgttttggtcatcatttagactatttgcgcagtttgtcggatcgcagtatagatattatttattttgaccctatgtttcgtgatccgttgctcgattccagcgcaatcggtccattgagagggctggctaatccagacgcgttgaatgaggaaagtattgttcatgcgaaacggattgcacgaaaaacaattgtattaaaagaaaaacggggtagcggggaatttgcccgcctcggcttccgtgtagagcagcggggcacaacgaaaacagtgtacggagtgattgatattgacagtggcacctaagcctaaattacttgttcttgttggcccgactgcggttggcaagacgaaactaagcatcgagatggctcgacaatttgacgcggaaattatttccggggattccatgcaggtataccgtcatatggacgttggaactgccaaaatttccgaacaggaaatggaaggaatcaagcaccatttaattgatattcatgagcctgaatacccatattcagtagcccaatttcaggaagactgtcgtcgtctcatacctgatattcaatctagaggaaagctaccgtttatcgtaggcggaacaggtttatatgtagaatcagtctgctatgaataccagttttccgaggtgggggctgacgaagcttttcgtcaggaacagcttgactatgccgaacagtttggagctgacgcgcttcatgcgcgactacaggcggttgatcccgaaagtgcacttcgtctgcatcctaatgatcgtcgtcgtgtcgttcgggcactggaaatttaccatgttagcggaacgacacttagctctcaacttgccagtcaaaaaaaggaatctccctaccaactctgcatcgtaggtttgacaatggataggcaaatgctatataaacgtattgaagaccgaattgacgggatgctcgatcaagggcttgttgctgaggtaacctccttaatggaacggggagtgcgaagcgatgccatctccatgcaaggtctaggctataaagagatatcctcctacctgcggggagaggtgtctttggaagaggcggtgacttggctaaaacgggatacgcgtcattttgcgaagcgacagctctcgtggtttcgccatatgaaggatatccagtgggtagatgtcactgatttcggaaatttttctgctcatgcagcccgaatacacgaaattatagcaggaaagttccggacagaccttgaatatacttcaaaacaatccaaatgattattgggggtacggctaaaatgaacaagtccattaatatccaagatacgtttctgaatcaattgcgcaaggattctatacctgtaacggtatacctcatcaatggatttcaggtgcgagggacgattaaagcatttgacaattttacgatcgttatcgactcggatggaaagcaacagctgatttacaagcatgccatctccacctttacaccgcaacgcaatgtatcgcttgtacagcaacaggataacgctagcgataactgattacggcttgacggtcgcccgggttcatgaaacttttcaggcgtccgtctcgtctaactgtataggaatgtgaccgggagcaacctgatcagggttgttcttttcattccgtttactttcatgctgccgacagcaagctttaggcttatgttaggtagtatatgattattcgcgaaagggagtcaggggaatgccaaacgattcattgtccagatccggcaatcgcaatagaaccacatctaaagagaagccgaagggcaagaaaaagaaaataacaggtaagcgagtggggtggacgctttttattacagcggcgttagccatattttgcgcacttggcgggtatttatttgtcatgataaatggtgaaaaaatttacgaagccaacaaggacaaaattacagtgaacgagacatcgaaggtttatgatcgcaacggtgtcctcatgggtgagttgtctgtgcaaaaaagcgatcctgtcaaaagtgaagaaattccaccattgctcaaaaaagcttttatcgcaacagaggataagcgttttatggagcatcaaggggttgatatttggtctatcggtcgggcggccgtaaaggatatcgtggctcgttctgcagtggagggcggcagcacactaactcagcagctggccaaaaacttgtttttgacacgtgacaaaacctttttccgtaaagcgaccgaggtatccatcgcaatggcgctggagcggaggttgactaaagatgagattattaccctttatctgaaccggatttggtttggacgctcgtattctggaattaaggcagcgtcggaaggctattttggcgtgtcagacttaaacaaattaaaattgtggcaggttgctacactggcagctattccgaaagggccatccaagtataatccgatcagtaacccggagaactcaaaggcacgacgtgcggtggttctccagctgatgtttgagcaggggatgattggaaagcaagagatggaagaggccaaagctgtaaattacaattacaaacaaccagaaaaagttcaaaagtatcaaaattttatggaatacgtcatggatgaggcagaggatgcactaccaggagttagcggcaatgatttgattattggtggttataagattcatacgacaatggatgcccaggcccaaaatgcgctggatcaggcgatggcagatgatgacatgttcgaaaaaagtcctgacgatcagcctgttcaagcctcgatggtcattattaacaaccaaacaggtggaattgccgcgatggcacccggacgagattataaaaagggaaccttcaatcgtgcgacacagagccgcagacagccaggatcggctttcaagccgattgtagcctatgcgccagctcttgaatccggtaaatttacggtggatacccctttgagtaacgaacgccagagttttaacggatacagtccgaaaaacttacatggttactcatcaaccatcagcatgctcgatgccattacgaagtctgaaaatattccgcctgtatggttgctgaaccaaatcggtgtggaaaaaggggttcaatttgccgagagcgtaggcattccgatggacaaaaatgatcactcacttgctatcgcattgggtggattaagcaaaggaacgaatacccttgaaatggcgcaggcctacagcgcttttgccaataaaggacaattccaaaaggcttattccattaaaaaaattaataatagtgatgatcaggtagtttatactcatgaagaggaatctaaatctgtaatgagtgaaaaaacggcttatgaaatgacacaaatgatgcaaaatgtagtcaatagcggcacaggtcgcaaagcacgtattgactggcctgtagctggtaaaacgggtacgacccaaagcggaattagcggtaacagtggtaaccgggacatctggtttgtcggttatacgccagaatataccggagcagtatggatgggttatgataagccggacagcaaacatatgctcagaaactacagtgggcagtcggcagcctttttcggaagagtcatgggtgaagctctcaagggacacccggttacgcaattcagcgagccgaagggatatgaaccaccagttgagcagaagccagaagagccggttcaggctaccgctccaagcgggctgagcgggtcttatagtcaggacacccaaattgtatcgttgtcctggactgcggcgacgggggataatgtacaataccgtgtgtatcgcaaagggacttctgatgcaggctttgcaacaatcatggaggccatgaagggcacgagtggtgaagatacgtctcctatagctggaaacacgtatgaatattatgtagtggcttatggagcggatggtaaagaatccgaggcttctaatacgatccgtgtagaaattccggcagagactactccggttgatccacaacaagggactgatccaaacgagaatggaaccttaccggataatggcggggctacagacggacaaaacggtacagatcagggaaatacagatcctggcggtaccaacaacaataatggctcaggtcaggttccggcatctcctggagatactagtgggaatggtgctggaggcacaggcaacaataatagcaattccggcaatggaaacgatacaaatcaggaaaatggtcagactactacaccggatgcaggtatttctgatgaaggtactatggtaaatccagaaaatacggatgcatctacgactgaagtcacaacggatggaactcaagaaggcaattctaacggtcattcgaactccaatcgtggacgtcacaatcgggattagcaagtattgctttatgtaagttgaatttgcttcaaatcaaaggtattttcggaccgtttcacggtctgagaatacctttttttgctttggtaaaggggttctttttgagtgtacagtttaaatatggtaagctggttttaccaatgttggagaggaacatcatttatgaagcgcaaattcggagaccgggccaactggcgcagaatcaccaatcgcaagtttgcttgccggtatgtagaaagtgacgcgtttacaggatatgtgaccctgtatacaattttgagtctcaaggagccgttatggaaaagttacggtggtcatacgttttgcatagccgataaaggatattcctggctacaatattatccaaaaggtgagcattatgtggtgactgctatgttcgacaaccgggagcaaatcgttgaatggtacattgatacctgccgaaatcagggtgtgaccgatcaaggagtcccatggtttgacgatttgtatttggatgttgtggtgcttaaaaacggtgaaatcttcctagtggatgaggatgaattggaggaggcgttacaacgggggcatatctcaacgcaagaggcagaattggccaaccgtacagcggctgatgtgttacatcagatagatgcccacgtgttcccctattttaaaatgtcgctgaaacaccgggcagaatggtttcacaacggtgatttcaagagagaacggtgaaagttttgcagtggattaaagacactggacccaaacgtcctgagtttaatagcgggcagagtcgccttaagaagatatctatggtatccaagcgtcttgtactttgtttgatgattttcattttggtcggattggtatgggcaggtatccgagtgtgggacatgaatacagccgcctctaccactccgctcaagcaagtgcaaattggtatcgtactaggtgcttctatgtggggggctgagcccagtcctggattgaaggaaaggcttgaagaagcattgcgcttataccgcaacgggacggtacagcgtctaattgtaagtgggggactggataaaccagattttccgtatacggaggctgagggcatgcaacgctatttagtagataggggggtccctgtacagcatattgtgttggaaaaccatgcgaccagtacttacgaaaatctgctctatagccagcgcatcatgaatgaatatggatggacctccaccgtgatcatcacacatagctatcatggccctcgggcgatggagattgctcaattcttgaaatttgatcatcctcagatggcactgacggaatccaaagtgctgaatatgccaattcatcaatcaagagaagtattggcatacgctaaatggacgctgcaacggtggtggatcagcgctcaaacttgggttgcctgaattaaagaaaaggctttgtgcacgttcccggtgcttttatgctaataaggacatgccagaccgaatacattaatagggtaagctgtgcctgaagaaatgttgaggtgatggatgcatgaacggacggggaatcgccgcgggcaagcggtcggaggagagaccttccagacaaattaatgtcgtgctgcgtagcccggagccgatagcttcggtgactgtggacgagacggaagcagtggcttcaaccaagtcacaggcgctaccgcagtatctcagtctttatcaggaaattcagaaagaactcgatcatctcgtcggcttggataacatcaaagacctggtatttgaggtatatgcctttttacaaatcgcccatatgcgtacggatgcgggattattgagcaatgcacacgtatatcacatgattttcaaaggaaatccaggtacagggaaaacgacagtagcccgcattatcgctaaaatgctgcaaaaaatgggtgtactgagcaaaggtcatctgattgaggtagagagggctgatctggtcggtgagtatattggccatacggcacaaaaaacgcgagatctggtaaagaaatctcttggcggcgtgttgttcattgatgaggcttacagtttggcacgcggaggggaaaaggattttggaaaagaagcgattgataccttggtaaagtccatggaagaccaaaaaaatcaatttattttgattctcgctggatactcgggggaaatggacttttttctacgaacaaatcctggccttccttctcgctttccaatccagttggattttcctgattatactgtggatcagcttatccaaatttccgagatgatggccaaggagcgggattatattctcatgcctcagtccataattaaaatgaaggagcatttgctaaacgagcgtaatgacagtcttcatgcatttagtaatgcacgatatgttcgtaacgtgattgaaaaagcgattcggcaccaagctgtcaggttgctcaatcagtaccggagcgggcaacctggcaaacaggaattgatgacgctgcgtccagaagatttgaaaatggacaaaagataggcgataataggaatctgaatcacatcgaatggtatgacatcgagcgggggccggcctgaacatcaggtcggtctctgttcgagagttgacatgaaaataaaggagcaaacaatatggcgaactccactcatgatacacaaaccgaaatgcaggacaaggcggtactggttagtctaattacggatgaagttaaacgatctggcatcaatacggaatactcgttggatgagctggtgaaactggctgagacagcgggagttgaagtgttgagcgtcctgacacagaataaggaagctaaggattcaaaatggtttattggcaaaggaaaagtagaggaactgcgcgcagttgctgaagaattgggagcgaatacagctatttttgatcaggagctctcgggggcccaagtacggaatctggaagaaagtctggatctcaaaattattgaccggacacaattgattctggacatttttgcacaacgtgcaaaaacacgggaaggtattattcaggttgaactggcgcagttgtcatatttactcccacgtttgtctggacatggaaaaaatctctcgcgtctcggtggtggaatcgggacacgtggtcctggtgaaagcaagctggagacagaccgccgtcatattcgtgatcgaatcagtgatctgaaacgccaactggaggaagtgacccgccaccggtatttgcacagggagcgcagacaaaagagcggcattgttcaggttgcacttgttggctataccaatgcgggcaaatcgacgctgttgaagcaactgacagcagccgatgtatatattgagaatcaactgtttgcgacgctggatcctacctccagaacaatggagctaccgagtggaaaagaagttattcttacggatacggtcggttttatccaaaatctccctcatgatttggtcgcttccttccgtgctactttggaggaggcgaatgaggctcatctcattttgcatgtcgtagacgcgtcttcggatatgcgagacgaacagatgaaagttgtagagacgatcttacaacagctaggggctgcggacaagcctcagatcgtattatttaacaaaaaagatgcctgtacccctgagcaactggaaatgcttccttctggggagggctatttgaaaattagcgcttttgatgaaggcgatttgctgcgcattcgtgaactgattcaagagcatctgagcggtgatacgctgagattccgcattcctgcggaacgtggggatttaacctcggtgctttatcgaatcggagatgtactgctgacagagtatgatggaaatgatgtcatttatgaggttgaaattcaaagaggcgagtacgaaaagtatggtcatgcactcagcgagttcacagaaggttaacatgtaatgatgtttttgggtcaataaaatgataaagctcatcgttcaaactgaacaataatataacatgaatagcctaaggctgcgtaagagagagggtcaagaaggtaaatggtagtttttagtccagaaattcagcaaattcaggaaacagcagagcataaaatacaagaacatatacagcacatagatcatattgtagattcaaatcagtggaaggtaattcaggcattccagcggaagcaagtgagtgattttcattttgcgggttctacgggatatgcttacaatgaccggggacgtgaggtgctggaagaagtctatgcggatgtgttcggtgcggaggcagcgttggtgcgtccgcattttgcctcgggtactcatacaattgccactgctttatttggtgtgctgcgtccaggggatgaactgttatacattaccgggaggccttatgataccctgcacaaagtgattggtaaggccggcgacgggacaggatcattgcaagattttgatgttacttatggagaaatcgcactgacagcggaaggtaaagtggactgggaagcggtggaggctgctatccatgccaataccaaagtgatcggtattcagcgttcacgcggttatgattggagagcttcgtttagtgtagcagatattgaagaaatgacagcacgtgtgaaggaaataaaacctgacgtcattgtctttgttgacaattgctatggtgaatttaccgagaagttggaacctactcaggtcggtgtcgatttgatggcaggttcgttgattaaaaatcccggtggtggcattgcagaaacgggtggatatatctgcggcaaacaaaagtatgtagaactggcatcctaccgattaactgcacctggaatcggtggagaagtaggtgccatgttaggtactacacgaggcatatttcagggactattccttgctccaacactggttgggcaagcggttaaagggagtgtattcgcagctgcggtctttgaggagatgggatttgagaccaaacctgcctggcatgaagagcgtacggatttgattcaggctatttcttttagcggaccagaacatctaattgcttttgtacagggtattcagcgtgcggctgccgtggatagccatgtggtgccggagccgtgggatatgccgggttatgagcatccagttatcatggcagcaggtacgtttatacaagggggaagtttggaactatctgcagatgctccgattcgtgagccttatattggttacatgcaagggggcttaacctactctcatgttaaatttggagtgcttatggctctacaaacgatgaaagaacgtaaattattgtgagtttttctaacatgtcattgacactttgcatcagctaaatgtacaataaggtgaataatagatcactggaaggttgatgacaaatgggcgacgaaattcgcagaaatatggccttatttccaataggtattgtcatgaagctaacggacttgtcagcacgtcagattcgttattatgaacagcataacttgatagttcctgcccgtacatcgggaaaccaacgtcttttttcttttaatgacgtagagcgtctgcttgaaattaaggcattgattgagaagggtgttaacattgcgggaattaaacaagtcatgaatccggttaccaaggaatcggaggaagctacggttattactgcagatacggaagtcaaacgccgtgaaatgtccgatactcagcttcaccgcttactgaaacaacaacttgttgcaggcaaaagaccaggacaggtatccctaatccaaggcgaattatcacggtttttcaataagagataatgctttgacctacctcttggtacaaggtcgccttactttaaaatcaggtctcatcatttaagtatttatagaacaactgattcgtatatagtcgttgcagaaagggagaggttagagtgagttatagcagagaagatattcttcggattgcgaaagaagaaaatgtacgttttattcgtttgcaatttacagatttgctgggcactattaagaacgttgaaattccggttagtcaactggaaaaggcattggataataaaatgatgtttgacggttcttccatagaaggttatgtgcgtattgaagaatctgatatgtatttatatccggatttggacacttgggtggtattcccttgggtaacctcggatcgtgtagctcgtttgatctgcgatatttacaagccggatggagttccgtttgcaggtgacccgcggggcatcttgaaacgtgtacttaaggaagcagaagagttgggatacacttcgatgaatgtcggaccagagcctgaattcttcttgttcaaaacggatgaaaaaggcgagccaactacagaactgaatgaccaaggcgggtattttgacctggctccgatggatctgggtgaaaactgccgtcgtgaaattgtactcaagcttgaagagatgggcttcgaaattgaagcatctcatcatgaagttgcacctggtcagcatgaaattgactttaaatatgcagatgcgattaaagctgccgaccagattcaaacgttcaagctcgttgttaagacgattgctcgtcagcatggtttgcatgctacctttatgccaaaacctttgtttggtgtaaatggttccggtatgcactgcaatcaatcgttgtttaaggacaatgaaaacgtattttatgatgaaacggacgaactcggattaagccagacggcccgccattatatggctggtattcttaaacatgcacgtgcaatggcagcgatcacgaatccaacggtaaattcctacaaacgtctcgtaccaggttatgaagcgccttgttatgtggcttggtctgcaagcaatcgcagtccaatgattcggattcctgcgtcccgtggtctgagcactcgcgttgaagttcgtaaccctgacccggcagcgaatccttatttggccttggcagtgatgctgagagcaggtttggatggtatcaaacgtcagttggctctgccagctccgattgatcgtaacatttacgtgatgtctgaggaagagcggattgaagaaggcattccaagtctgccagcagacttgaaagaagctttgtctgagcttattcggagcgaagttatctctgacgcactgggcgatcatgctctggcctacttctatgagcttaaggaaattgaatgggatatgtatcgcacacaggttcatcaatgggaacgtgatcaatatctgactctttactaaaatgggaaatcctttggcgctctaagcgttgagggatttttttatttgtggtaggtaaaaaaaatattaagtttatttataattgccccctaattgcccccaaaaattttattatcagaataaattttcggtaacagactcatagttctccatgctatttatctctatttttttggagatgtgtggataaacgtcggctgtgaaaagagtgacgagtcgagtttctgcattgttcttccttatagggtgactggttagatgagtaaatacaaagggagaaaaatgatctttatacttattatagcggcaggccggtctaagattaaggaagttcgattagtggaaactatggataagagacagatttctgtttttgaaaatatgctaaatgatattttaggagcttcagctaacagcaagtgtcttttggataagggtattttgaggattgaaaacagatagtagaatttacagaaatataactaaaagtccacatgttaaaaagaagaacccaaagagtatcgaaatagagcctctaaatttcatgtcatcaatgtaagcatcactcggttcagagtcacctttgatcttccaggcttcgtttgcacgccatccccaagtgggatttcgtttacttaaaataccaagcgagaaaaaaataattgcaataaaaataagcatgaatcccatttgatcagcccctttaagtaaactataccaaaaaagaacgacagatggaaagtatcgtctctcaaggacagatagaagaaaaataagagggctttgccctccatgtgatggttcaattttaatctgagtaggcaacagcattaaaactttctattcctattcgggtagcatctgctgtgcaaaatagatataaggtatacaccaattcatttgaaggtggtagagggatattgtaatcggaagcatttatggtgacgacctgtacagcgtttgggtttgcttcggagacacttacagagtaaagggcgtaagcaacaagcgaatcgaaattgcctctaacaatggaaaaagaaataacggagtcaaatggtggaggggtaggaaatgcaagctcagctatcccggataattgtacacgcatgttttcccctgcgcccgttacatctaagccaagctcagcaatggcaacgggtgtattggctggcaagggaatagagattgtattaccgtaacttgcgttttgtgatgttcgagcatctaacaatctagtcattatctcatctccctttttgggtaaaggatttgcaagctggaaatataaaaatacagacagtgtaggatttggaccggttgattgaactagatattaagcttcagaagaatgagctgtaataatgctaacacgatagggtcagacctatgcctattttcccgaaatgaagtcaacagcccaatctttttggttaattgcacaatatgctactttgactagactttggaggtgaccattaattatgtttcgacattattgttggcagaagaatatgcatcggagaaaatttagaagatgtgtagttaaaaaagtcaaagtgttaccgaaagttattgttaaagggatccgaggacctcaaggacctcaaggacctcaaggacctcagggaccgcagggactgccgggtccacagggagttccaggcgctcaaggccagcaagggctacaaggttttcaaggaattctcggaccaacaggaccaacaggaccagcaggagcagtagggccagcaggaccagtggggccggcaggagcggtaggcccagcaggtccagcgggggcggtaggaccagcaggagcaacgggggcagcagggcctgcaggcgccgggataacagacttcttaagtgttttccgagcagatcctggcacgggaactgacacagttccgggtaactcaccaattacctttacaggagttttagctaatgttggtggtgcatttactttcactcctccatctacaacgataacaatcaacgaaacggggagctatctaatagattttacaattcataaccaaggtaatgctgactttaaccttaccgtaaatggaatccctgttacccctgttcccttcacgggtaacggtggcggaccaatttcggcagaagtcattattactgtaggggtcgttcctacaactattcaattggtaaatgcaaatgcaaccccggcccaacttcataactttaccaataccactcttactatattaaagttgactgtttaagccattcttaatgatatatagaacattatatgtagccgccttagaaaagactgtacgatttccatcgtcagtttgtctaattacactcatagtaagcagacgcatttatgaggggattgtgtagcatggcaagagaacgtagtggcagtaataagatccattaaacactaccactactccaaagcctatcttcaaaaatgaaatggataactttgtaaaaagatgatattattcagacatagaaatatgaatgctaagaaggtcgggaaacttctcccaccttctttttgttgtgacaaatcggaactattgctttgatccgtcaggtacgacaactcatgagcggcaatcaatataaattttcttttttgattagtcgcgaaaaatggaagctacagaagaacgggccgaggtcgtttggcctaaagttgagcattgcataaggaagcctttaaccttgtgttggtagaaggactgacggaggaagaatacaagaatgtagacgaagagggcatttaggagttggatggcctcttagaacgatttctataaggagttgtttccacctaatgaagtttatgagcctacgacgaagaagaccaagaggttcctgaggatgatcggaaaataaactggatagaactttagctctatgcgtgagtaatggtatttctgattcagaatggactaatacgaccattccaaagattagagcgctcatgaaggccaagaacagaaaccgggaattcgaaatcattctccacgctggtaaggtggaaaataaaaagccgaagaaggtcaagtcgctatctgatcttggtttcttcgcaaagtaaattaagaagcatccgcaaacatgaagtgacccctgcaaagtaaacagctatcaaaaagcaataattaagtagcctgagaaggagtcaggttgtttagtttctcttgaaagcgttcatggttgtagaaatggatatacttttgaacggcatgctcccctgacccatcggcgaaccagcgaggggtcaatctccatttctcgtgccacggttttatatccgattccctttttgaggtacagatctactgtcttattcttgaagctcacatcgtaagtttttcttatttctcccatagaaaaatcccctccataatagacagattagatggcttgctcttttctgtctactatgaggggaacttatcacacttgatagagtcttttgtatgaattgtataagtacttgtttttatgatggaaagagagtttcggaatctggttctccgccggcaccaagccaacggtcagggcctgcaaatgagaaagtctttccgttcccggttactttgatattagcgagtctccaacctgatttatttccagatccatcagtcctaatggtaacttttctgatgtcaccaaggttgctggtactgattcttgtagtatcagaatctcctttttcaaagctgccagtgagtgcggcggtaacatagtcgccattagaaccatacagagttatagaaatatttgagtctgtacctgaatccgcaatactgcctgtgtttacggtaacaacatattcaacattagcaaaaggtgtaacagactctatgcttctattagagtcttgtaatgaactataagtgtcgcttgtgacctgatccgcgaaagaaggtgctgcgaaagctacagatgatatgagcattgctgatgctaataaagatacttttttcattaattagttaccacctttctagtatttgtatttaatgttatacatgtgtaatatgtttgtacatagttctttggttgtgaagaaaacttttttccttgtctttgtttgttgtatttcatatttatgtgtcgaatattcttatttttaatgaatcacggaatggtatgaatatttatttatagaaggtttttttgtgatttagccagaatagcttaattcgaggcgatcagcatgaaccacgctaatcaaatgtgtatttttcatgtcagacaaagctccccttactttgacagtcattaagctgtatgtttattgacgaagattaaaagaaggagaggagttattgctccgttgtcagcttctgcagatgcagcaactgtaacgcttgacacttacaaaaatttttcaaatcaagaaatagttttatcacaatcagtaatatttaaagatgacacggcatatacagatgtatctgatacagtgaaaagagtgaaattttcaattaatggtttggaaaatctttttaatgctaattattataatcggttggtctggacaagtgatgaaaatacaccgagtatagaaaatacgttatcagtaaaaattgctccaaaaatagggatctttacggttccagtagttatgagaacctttctctgataaaacaaaagatcaactccgattcaaaagtatatggatggattcaattagaatcaaaagagtggactaaagcaggatcagctaaaagctctactaaccttaattggtcggcagagcttttaactgttcacggcttttagaatatatccaggtattctttctggaatttgatgaaatcttgcacactgtcgtgataggtaaatctaccgccatttttatcaataatccagttgatcttctcgtcatttaacaagattccatacatacagtgatgaagcagctcaatttgcttttcatctctaattcggatcaaatgtttttcttcttcgacaatgaggtaccatttcgtttctgtttcatctacatctacgtctacatcagcatctacatacagtattgataccgacaaggggaatggccagtcaaaccaatgtcctcgtttgtcttctctataaccttcaaatgccatggttatttccccctacttggataatttcctgattagtttaaatgtatctaacatgctgcgattgtacgcttaattggaaactgttttacggaagtggcagctatcctcagcctttggcatcttggcaccaatctggtgaatgacctgctgtttgaggctggtactagctgggatacgtctgtttaggctgggctaacggagtgtgaactccggattttattgtaaatttctcatttgctcaagtttttaaagacaatgctggttcaaggaaacatttgcggcagccctttttgacattggacgacacaggcttttaggaatacacacattaagtttactgctagttcttgtcttatcctactggctcaggaatatcgcccccatattctttccatggcttcacgtacaccatcgtaagcttctgaaaaagttcagtatcacttgggcaaccgtctaatccgctattgttgcgcaatagctgtatcctcttttatcgttccttgttctgatctgtatagtatacggaaaacgacaggtaacaaagaagttgagcgctttgttacccgatatcaaaacgctactaccaatactctacagttattctactgagcaatgacgtgggcccaacatgaaggaactggagttgaaaacaggtagcagtgtagtggacataaaggcgcgtctgctggctttggaagagggggacaacaagagcgatatacgctctatattgtaatcatagagggctggaatggtgacccaaagatcattacattttctcgtatggaaataggcgctgtattaaacctccaatgaaatggagcttattatttgtactcggaatataatttgcgcataacacatcaggaggctacactcatgtcttgaattgtattttatttctggagtggtttgtttcttatatttaaaataaatggatggagaagatcggatatatattgctacatcgttacttacttcattaactttaaaggggatctgaaaaaagtttaaaattgtaattcatggattgttgcatttgtatatataattacatcttttcccattttagataaggtggtagaatgaaaaaaataggtatgggaggcgttttatttgaagtgtgataaatgtaattggggacaatttaaagagggggcgtatcattggccctataaactacgttaaccctcatttctggagggtcaaaattgaaaaccccttattcacagtctgttttacaccataaccaaattttaatgtggctttgtgttctttcattttttagtgtgttaaatgaaatggttcttaatatctctttacctgatattgctgatgaattcaataaaacaccagccgttacaaattgggtaaatactgcctttatgctaagtttttctataggaaccgctgtatacggaaagctatctgatcagttaggtattaaaaggttgctcctgtttggaatcatagtgaattgcataggatcattaattggatttatgggacatactttttttccaacacttatcttggggcgatttatacaagggattggtgcagctgcatttccttcacttgtgatggtcgtagttgctcgctatatcccaaaagaaaacaggggcaaggcatatggcctcatcgggtctatcgtagcaatcggtgaagggataggaccggttattggtgggatgattgctcattatattcattggtctcatttactgcttcttcctgttctaacgtttgtcactgttccctttctgataaaattattgaaaaaggaagtcatatcaaacggttcacttgacattgcaggaatcgtgcttatatctctagtcattgtaatgtttatgttgtatacaacgtcttacagaatttcttttctggtgataagtattctttttttcttgatctttttaaaacatatcagacaagtaaccaatccttttgttgatccttcattggggaaaaatactgcatttatgataggaatcttttgtggcggacttatgtttggtaccgtagctggatttgtttctatggtcccttatatgatgaaagacgttcatcacttaagtaccgcaatgattggcagtggaattatttttcctggaacgatgagtgttattttctttggtttccttggaggagcacttgttgataagaaaggttccttacatgtgctagcagtcggcgttgcatttcttgccgtcagctttttgatagctgctttctttattgaaatgacaccttggctgatgtctattattctagtctttgttttcggtggtctttcttttattaaaacagtaatatccactattgtttcaagtagtttaagacaagaagaagctggcgcaggaatgagcttgcttaattttataagctttttatcagaaggaacagggatttcagttgtaggaggcttattatcaatacgttttattcatcaaaaatttataccaatcattaattttccatctgcttatttatatagcaatatgttattgatttttacagtggtcattataattagcgggattttaactgttattgtatatagacgttcagtttcagattcctgataagagcagaaaaggtttacatgctgaaaatgatcgcatcctcacgtttgaagtaagtggatactctaaataattcaaaagctctgctaaccttaattggttggcagagctttgtttgctgatcagtttgattttaggctaatttgaatgcttaaacttataataccaaaaaattgctttttcatgggctgtggaaaagttagaatatagcatagtatcaactccgccgattacaaagttatttttagcatagaatcgacaagctaaaacattcacatcctgtgtttcaagcataagaccaacaaggttattctgcttagcccactcggttgctttactcaataaggctgctccgattcccttgtgtctccagtctttagcgacggcaatatcctcaattagagcatagccattccaattagtacaaagtttaatttgcccaacacagtcgttctcatcataatataaaaaaatagattttccttgttcatcaatataactgatgtcaacgtcatcatcctcatactgtttaaaatatggttcggggaaactttcttctatatatgtccaattatcgttctcgtatttaggtataatccttcctgacacaataaagccgttattctcatttgacttcttaaaatctcccatattcgaaagtgacattttaattatcatggcttgtctcctcctggtttaatttctctacgtacactattctaaaagagagccaccatttcctgtctgttagatttataataagagcaaaattgtagcgactgttcaactatgtctgatattctacgatctcgtccgcttgcttcaacgattcatagcagtagttaggtgtaccgtttaacacaaaaaaagcaggaagaatccttcctgcttttgcttgaaaacgattattaacgtctgcgttgtctatcattcacgctaaacagattaacagccagtgcgttacctcttgcacgcgcaacggctctttgattcgaacggatgtttgatcttcttcttctcaaatcacgtctgcaatgtcttctgctcatatgatcacctcccttcaaggaaatgaaggtacggatgaatcttagtggtgtttatgcttacgcttggaaattttgatattcaaggcattggttgctagtgcatttccgcttcctgttttagcagctgcggcttgaaagactttaacgaccagatatctgtttttcccgatgcgatgcttatacgttttaactctatttctgatcatctgcatatctcctttgcttaggtctgctatatactatgtcaattgtgatagtaatgtatcagcataaatctattaaaagcaaaaagaagctggtacctatattcctaatggttaacaaaaaaactcatgcgaacctgtcttcgccatttcaactttacgttgcaggagaatgttacaggcaggtcggcatgagtctaatagtgtagataaagataataaggagttagtatgaaaattatttactattaagagtgttaagttttttctcgtagtacgcctcttgagcaagaatatgattcagttgttcagagagcagtttatattcttggctgtcttctgggtaattgtttctttcggaaattacagcttcgagttgcttttctaaatacctgaaatggataagtatttgtatgtactgaatacgatcgtaggttgttatgtgtgatttcccttttgcatataaatgatccattgttggtattacacagcttatggcgataaatatcacaacaaacgctgaaattataatttttttcatttaattcctcctacagagctatgagtaattaatataccatatttatctaaaacaaagaaagatctattagttttgcccataacagtatagctgctcaagatcagtgggtgattatttgagatgaggaggctgattttatagtagaaacaataagaataggttgctgaaatgaaaaaaaagttgtgagatacataataacaatacaaaaccggcttgccctaggcagccggttttgtattagtggttagaataacggggaagaaagaacgagaaatcagtggaagtcccggaagagtcctacaaccttgcccaaaatgctgacgtgtgtcaggcgaagcggttcaaaggctgggttttcaggttgaagccggatatgatctttttctttgtagaaggttttaactgtagcttcgtcttcatctgtcatagctacaacaatatcgccattatcagcggtctgctgctgacgtacgattacatagtctccgttagcaatcccagcctcaatcatgctttcgcctacaacagataacatgaatattttatcctcaccaacaaagtgttggggaagaggaaagtaatcttcaatattttctgtcgccgtaataggaaggccagcagttactttgccgacgacggggacacgactaatggagtaattaatcaagttgctgttatccgattcgtcttgaccgagtaactcaatagcccgtggttttgtaggatcgcgtcgaatgagtccttttttctctaaacgatccaaatgaccgtgaaccgtagaactggaggccaatccgacagcctcgcctatttcgcgtacagaaggggggtatccctttagacgcacttcattgcggataaattcaagaatggcctgctggcggctcgaaatcttagacataccgtatcaaccccatttagtaacgtttgggaaaattatagcatagaacctccgttcgtacaaacataagttctaaataatccctaaaaataatcgcgaacttttgttctcttttctattgaacaaaacaaatgttcgtgttatattgtgaaaacataagaacaaacgtttggaggtcgcagccaatgatgaaatatagcacttatcaaagtatttttccgatgaattcagaaaatttgcaggagacccgaaaagagggtagagcgcattttatgcaaattattactaatagtcttttacttaagcttcttattttagtgattgttgcttggattgcaggggcaggtgtacttacggttttcgcggcaccctcagcttccaagggagaagtgactaaactgaccgtacaacctggagatacgttgtgggagattgccgcaaatcataaaccggaacgaatggatacacgggtatatatagaaggaattgtgcggattaacggtttggaggaccggggagtgcaggcaggtcaggtactcaagcttccgcacttctgatctatagacaattagagcttgtcagggagcgtaatgcgggagccttgacaagctcttttctacatgtcaaagtgtattatatctttgcttttatggaggggacacaatttggatatagacagcttggtacagcgcatcaatgaattagcgcgcaaagcaaaatccgagggtttgacggaagaggaagccacagagcgcgccaatcttcgggaaatttatttaggtaacattcgccgtaattttcggcagcagcttgaaacgattgaatttgtggacgatgatacatcgaagggaaatgacgggctgaagcattaatgttgttaaagcgcccaagcctgcaatttgccttttgttttaggtaccgttctcggtatctatatagattagctttgaggcaattgttttattgtaatatatctgggaaggaattgagagatggcccgatcatttgaaagaaaagtacgcaaaaacacagcgaatttaaataaatcgcgcaaaaagcaaggcattcaaaccattaacggcgcaggttctgcaatggatattttccgtggccgtaacattactgtgccaattatgctggctggtctctctgtattgtacatgcttatgagttactttttgactaagactggcatgcgagggatggattggcttgtattcggcctgtacttgatgctggctgttatctttttcatccgtcgtccttatctgaaagtgggaaaggatactctctatatgctgaaaggtggtagagaacgtccaatgacggcaggggacatgaaagccatcaagattgaaaagggttacgtaaccgttgaaagaaaaggtaagggcggtaatttcatattcacaaaatcattaggtcgctatgacacggatgccattgcagagcgacttgagaagtttgcgctatccaatcagatacaggtggacaagaaataactgatttagcctgtagctctttaacaaaggccgtatgatgttatttcatataacatgctgcggccgcttgcttaatatgggcacacataacgattcaaatacttaatcaagcaaataggtgtacatatactgtggaaagagagtggataattcagatgacgattcaggcggtaatgtttgatcttgatgatacccttttatgggatgaacgtagtgtagaagaggcatttgatgcagcgtgccaaacaggcttccgtgaagcaggcgttgatccgaaaactctggaggaagcggtacgtaaggaagcacgcgctttgtatgaatcctatgaaacctttagttttactcaaatgatcggcattaacccgtttgaaggattatgggcgaattttacagcaggtgagcaacctgaattccgccaattggaacagttggcccctatttatcgaaaggaatcatggcgcagaggactccagcaactagggatagataatgagaagttggcggaaaagctggctacccaatttgcttcggaaagacgcgcgcgtccacatgtatatgaagaaacgtttgagattctagaacaattgaagggacattacaaactgttattgctgacaaatggctctcctgatctacaacaggagaaactggatggagttcctcaattagctcctttttttgatcatgttgtcatttcaggttcatttggtcgaggcaagcctgatccgtctatattccagcatgctttggggcttcttggtattgagcctgaacatgctttaatggtaggagataagctgacgactgatattcaaggagcgttggcagcaggtgtacactcggtgtgggtgaaccggaacgctaaaaccaataccacagagatcaagccgaagttcgaaatcaagcatctgtctgaattggacggaattattcaaacgttaaagtaagaaatccatagtcttaagaaacgagtattaaaaaaactcccttcgctcgattattacagagcagagggagtttttttattcacacaaggataaattcgtaattatgctttaatgaaggttgggtcttcatacggttcggcaatccagccattttcttcgatgaacaagcggattgcgacgatcttttgattctccattaaagtgaagaagtgaggtatattttcaggtacggagataacgtcccccggtgaaagctctacgttaaaatagccgatctcttcagggcctttaatgatgaagatgcctttaccagcgacaatggcacggatttcatcctcggtgtgggtgtgaatttgctcaaacttggccagcagctcgtccaaattcggcgttgcttcagataaagtgataacgtcccatattttatatccgcgacgtgcggctaaatccttgatttcgggttcaaatgtttggagaacagcggccttttgatcatctgttaaggtaaagttctcttgcagctccccggacaatttggaagtatcccaatgttcatacaatatctcgtgactctccagaaattcacgtacttgtgcttcaccgctaattcgctcgttcgtattacgtattaagatttcggccatatatctattccctcttttccacttggattaatgatgtataaagaataccatgtcttgaaacgttgtacaatacaggatttcaacattttataatgcaaatgactatagctaaagggtcagggttaagtacgttctgtaatgctacaaactataaaaatggattagagaagtcgtttttacaaagaacaacctgtataaaacgtatgtttttacttcaatctatctaaatgatacggtttctgctaaactaggatttaacgttttgcgggggtgaagaaatttggataaagttagcttgcaggatgcattacaacgaagaatactccttcttgatggggccatgggcaccatgattcaacaggaagacctttcccccgatgattttggtggggaagagctggagggctgtaatgaaatgctggtcttaacgagaccagatgtcattcaagggattcatgaagcttacttggaggctggggcagacctaattgaaacgaatacatttggagcaacatccgtcgttttggcggattacgatataccagaacgtgcccgtgaaattaatctggtggcagccaaactggcgcgtaacgcggtggataaatacagcactgcggacaagcctcgttttgtagtaggagctatgggtccaaccacgaaaaccttgtctgtcacaggtggtgttacatttgctgagctgattgacagctatcaagagcaggctttggcgcttattgaaggcggcgtggatgtactccttttggagacctcacaggatacgcttaacgtcaaggctggaagcatcggaattcggcaggcttttgagcagacaggtatcgagcttccgctaatgatttcaggcacgattgagcctatgggaacgacgttggccggacaaaatatcgaatccttttgcatatcacttgaacacttacatccaatttcgattggattgaattgcgctacaggtccagagtttatgcgtgatcatattcgctctctgtctgaaatgtcctctgcagctattagctgttatccaaatgcaggtttgcctgatgaaaatggccaataccatgaatcgcctgattcattagcccgtaaaatggctgctttcgctgaaaaaggctggctgaatattgctgggggttgttgtggtaccacgcctgagcatattcgagttatgagtgaaagtatggcgcagtttgagccgcgtccgctggtaggtcatcatcctcctgccgtatcaggcattgagcctgtatatattgaacaggacaatcgtccgtatatggttggtgagcgaacgaatgttctgggctcccgcaaattcaagcgtttgatcgtggaaggcaaatatgaagaggcatctgaaattgcccgcgctcaggtaaaaagcggagcgcatgtcattgatatttgtgtgcaggacccggatcgcgatgaaatgacggatatggaagcgtttttgaaactggttgtaaacaaggtaaaagtacctttggtgattgataccacggatattaaagtcattgataaagcacttcaatattcgcaaggtaaggcgattattaactccattaatttggaggatggtgaagagaaatttgagaaaatggctcctcttattcataagtacggcgccgctgttgttgttggaaccattgatgaacgcggacaggctatttcacgtgaggataagcttgaggtagctaaacgttcttatgatctgttggtaaaccgttacggtttggcagcagaggatctaatttttgatacgctcgtatttccagtaggaacaggtgatgagcaatatattggttcagctaaggaaacgattgagggcattcgcattattaaagaagcccttcccggggttcataccatcctgggcatcagtaacgtatcttttggtttgccggaagcgggtcgtgaagtgctcaattccgtctatttatatgaatgcaccaaagcaggtctggactatgcgattgtaaacactgagaagcttgaacgctatgcatccattccagagcatgagcggaaacttgcggaagacttgatctataaaacaaatgacgatactttatccgcctttgtagcagctttccgtaacaagaaagtggagaaaaaagaaaagatatcaaacctttcgctcgaagaacgactggcttcctatgtagtcgagggaagtaaagagggactcattccggatctggagcaggcgctcgtgaaatattcttcgctggagattattaatggcccgctgatgaaggggatggaggaagtaggacgactatttaacaataacgaactgattgttgcggaggtgctgcaaagcgctgaagtgatgaaggcgtccgtagcctatttagagccgttcatggagaagaatgaatcctcagtaaaaggtaagattttgttggctacagtcaaaggtgatgtgcatgacattggtaagaatctggtggagattattctatccaacaatggttaccatatcgtgaatctgggtataaaagtaccaccagaacgcattattgaagcttaccgtgaagaaaaggcagatatgattggcttatccggactgcttgttaaatcggcacaacaaatggtgctgaccgcacaagatttaaaaaatgcgaatattgatattccaataatggtgggtggagctgctttaacacgtaagttcactaaaaatcgtatccgtcctgagtatgatggtctggttgcctatgcaaaggatgctatggatggtctggatattgccaataagcttatgaatcctgagtcccgcaaaaaaatggctgaggacatggaggctgagcgggaggcggaagcggcaatcgtcgtggaagccaagccgctccctaagctcactcgagctgtgcgctctaatattgctcaggatttgcctgtttatattccaccagatacggatcgccatgtactgcgcaactatccactgaattatattttgccttacgtgaatatgcagatgctaatggggcatcatcttggtttaaaaggcaatgttgaacagctgctggcttcggaagatccgaaagcgattcagttgaaggaaaccgtggacagcatcatgtttgaagctgtgacagacggaatcatccaggcacatgctatgtatcgtttctttccagcgcagtcccaaggagatcaaattctgatctatgatccctcggatgtgagcaaggtactgcacacatttacattcccgcgccagcaggtagagccttatctatgtctggctgatttcttgaaatcagtggaatccggagttatggactatgtaggtttcatggtcgttacagctggtcatgggattcagcagatatctacccagtggaaagataaaggagattatctgcgctcgcatgcacttcaagcggtagcactcgaagtagcagaagggttagcggaacggcttcaccatattatcagggatagctgggggttcccggaccctgccgatatgacaatgaaacaacgacacggtgccagatatcaaggcattcgggtatcctttggctatccggcatgtccagatctagaggatcaggggccgttgttccagttgttaaaacctgaggatattggcgttgagctgacggaagggtttatgatggaaccggaggcttctgtatcagccatggtgttcagccaccctcaggcgcagtattttaacgtcgaaaaggtttaacacctttatcagatgggacagcaaataccctccgagcttcggaggttttttgctggtcagcaggaagaaggttaaagttatggaattttattttctcggtacaaatgcaggggtgcctacgattcagcgaaatgtaacgtccatcgctcttcgtttgctggaagaacgaagaagcatgtggctgttcgactgcggcgaaggcactcaacaagaggtattgcgttcgccgctcaaactaagcagacttgaaaaaatatttatcacccatttgcatggggatcatctttttggtctgccgggactgctgtcgagcagagcgtatcaagggggaacgacaccactgacggtatatgggccgcctggaatccagcaatatatagagctatctttagggatcagccaatcgcgaatcaattaccaactacatattgtggagcatacgggcggggttctgtttgatgacggacaattccgggtagagtcagctttgctggatcatcggattgacagctatggctaccgagttgtagagatggataagcccggtaagcttaaccaagagctgttggagcgatatggtattaagcctggcccgatgtacggtaagttaaagcgtggggaaagcgtggaggtagagggtggagttattttgcatcctcaggatgtactgggttcgccgaaaaaagggcgtatcatcacgattttaggggatacgagaccttgtccgaatacggtagtgctggctcaagatgcaactgtcgtcgttcatgaagccacttttctgcatgaactggcagatacagcttacgagtatcatcatagtacagcgcttcaggcagcggaagctgcaaaagccgcaggtgcgggtcagttaatcatgacgcattttagttctaggtataaagatcaggagcagcttcagccattgctggaggaagcgcaaagcatatttcctaattcattgcttgcggagcagcatgtgttgttaccggtacccgatatcggttaataaacgattgcagaagatatgtgcatgggtgccggggcttgcctcggtgcctttgtttttcaccgaaattattttccgggaaagcgcaggatgcgacaagagatgagaacccgtgctgggtggtgggggatgaatttgttctaccacatatggaggcgtgtcatattcgagtttctatatatcgaatttaaaggattatatttcttgagcatgaccaggaaatacaggagatttcctttgaggaaatagcgccttcgatggatttcgacgaagaagtgaacttatgtcatgggaaagcgacggcttttagcgaggaatggcgctattttggacggtttaccagcaattcatggacttcataagcatttttgacttaagatagatgatatgaatagagacggtcgattattttatgacctgaataattaaggtggttaaataagaaggagaacatcgttcatgggatgaattatagtttttaatgctatgatgtgaatggatttgaagtaggggaggggattgcgataaaatcgttactaattgatctggatggaacactttatcatggaaatcggatgatcaagggtgcggatctgttcatatcccgattgcgtacagaccagataccttatgcttatgttacaaacaatgcttcacgtacacccgattcggtggctgagcatttggttggtatgggaattgaagcggccagccatgaagtctatacttcggcgttagcagctgcacaatatgttgcacagcaaagtcctggagctcgtgtatattgtattggtgaaacaggattacgcgatgcactcacaggagccggtttgcagcttgttgagaaccatcctgattatgtggtgcaggggatagatcgtcaatttacatatgatgcgctggccgctgccatgcgctggattcgggaaggagcaacttttattttgacaaacccggatctccaattgccttcacatgatgggctaacgccaggtgcaggtacgattggagctgcaattgaagcggcttcacaggtaaagcctattgtcatcggcaagccttcaagcgtattgatgaactatgcgctgaaccgcttaaacattagggcggatgaagctctggttgtgggcgataatatgcttacagatattgcggcaggtgcagcagcaggttgtaaaacagctctgatcctgtcgggcgtgacgacccgcgctaatatggacgagcatgtgcgtaccgttggagtgaaacctgacctgatgtttgacaatctcgctgaactgcaggactggatgaaagaagagctgaaataatagaaagtatatgtcttacaaaacttgcgagaattaaaagctatgtagctacgaaaggaaagatgttttatgccggaacttcctgaaatggaaaactacagaatcttattatcaaaacaaattttggacattccgattactggagttacggttagccgtgaaaagtccattaatactgaagtggaaacgtttgagaagcaattgcttggaacgaccgttgtatacttagagcgtcgaggcaagcatttgatttttcatttaaacacgggcgggcggctcgtacttcatctgatgctcggaggactgttatatctgggaacggaggagcagcgtccagatcgtacagttcaaatcgaattagattttagtggagtaaaactttattttatcggactgcgcttaggttatctgcacctgctaacggctaaagaaacagaagaagctttgtcagacctgggacctgatccgttagaccgtcgcatgacgttggaaaagtttacagcacggctgaagggacgccgggggattttgaaaacaacgctggtgaatcagcagattttttcgggtattggcaattgttattcagacgaaattgcttatatcgccggatttacaccgggttccaaagtacagaacattgtgcagtcgccagaaaaagtggaaaagctatatcatgccactcaatccgtactacgtgaagctacagcggaaggcgggtacatggaaatgcctctaatggagggggacacgctaacaggtggatttgatcatcagtgtcgagtatatgaccgcgaaggagaagaatctccaagtggcgggaaaattgtaagggttgaactggcggggaaaaaagcattttattgcccggtacagcagcatgatgcctaaattgctcatcggctcccatgtgagtacgcgtggtggcttttccaaagccgctatgcgtgcgcgagagcaggggggacgttcatttcaatatttcccgaaaaatcctcgtagtcttaggctgaaggaatggagtgctactgatgctgctacttgcaacgcttactgtttagagcaccagcttcaatccattgctcattcaccatatcccgttaatccagctcatgggtccgagcgtggtcaggaactttatgagctgacgattgcttcattacgcaatgatctggatattgctgaagcctgtgggtcaaaagggattgtcgttcattttggtcatatgcattcgttagaccctctagagggctaccgtaatatcattaactgttttaatgatgtgctggaaggctggcagggaaatgctaaaatattgatcgaaaatcaggcgggagatcatggacccatgggaaccacgcttgaggaaatggtgcagattcgtcagttgtgccgatatcctgacagtatcggcttttgcttagacacttgtcatgcatatgcagcgggattgtggaacggtggaatggacgaggctttgatcgaaaaagggaatcgtctcggctattggtcagctctgtgtggagttcatttgaacgattctaaatacccatatggctctaaaaaagacagacatgcccgtgtgggacaaggctacattggtactgagggcatgcgttggatgacagaacaggaggctgtaagaggtattcctattgttttggagagtgagacgggacctgatgggacacatcaggaggatattcaaatgattctaagctgggagtaaatcggtctgattgataataactatctttgaggcttgtgagcttgcatatatggaaaaaggaggagaagttgatgtatttgtttatggacgattatcggccttgtcctccgggctttaagctggcaagagatgcggatgagtgtctgctgctgcttcatgaataccctatttcgatactatcgctagattatgatttgggtccaggtcagcctacgggaaaggatgtggctgctgctatcgcagagaaacggttatatccacgtgaaatttacttgcattcgtccagtccagaggggcggcgagccatgtatgagctactctatgcgaataagccagagggagtcaccgtacataacgggcccatacccgaagagcgtatgcgagagatcagaaaagggtctgaacgatgaaagagatcggacaaaaagaggcgcgccgtgccatatgggagggatgcaagctggctttgtttgtgtacactcccatgtgcggaacatgcgcggctgcccgtaaaatgctggaggtagcagagcatttgctccctgaagaagcagtggtgcagagcaacattaactatattcctgaactggtacaggagtaccggatatccagcgttcccgcgcttcttatatataatggtgaaaacaaaaatcctgaaatcatctacaaaatggaatctgtagaacacttgttgagcaaaataaggagcatgatggaatgatatccatgaaaagcattacgttgcagcgggaagaaagacggattttggacgatgtaagcctggacatacgagaaggtgaacattgggctattctgggtcgcaatggttccggtaaaacaacattgctggaaatgatgacaggatatatgtttccaagtcatggaacggttgaagtgcttgggcaaatgtatggtcaatgtgatgtgcgggaagttcgcaagcaaatcggatatatcagccagaccttgttggaaaagctggcgctaaaagaccccgtttgggaagttgtcgctacaggtgcgtatgcttttttgcgcttttatcaggaaattccggcagaggcaaaagaaaaggccatatctttgctggagggtatgagtttaggcgacttgattcatcacccactggggacgttatctcaaggagaacgtaaaaaggtgatgctggcccgctcactgatggcagaacctcgtctgctaattatggacgagccttgtgccgggttggatctatttgagcgggaaaaaatgctggtcgagattgatcggctccgcaagcgagacttatcagtggtttatgtgactcaccacattgaggagattgtccccctctttacgcatgttgcattgattcgtgatggtaaggtcgcagcagctggaccgaaaaaagaagttttaacgaaagaattgattatgcacacatatgaagttccggttgagctggattgggatggagaacgtccctggattcgggtgtgcactggagggtaatgttattttggaggaactatatatgagtacagatgaacaaagtgaatctactttgtcatcatcaagatttgtttgtacggccaatcatggttttgcaccctatgctcaagaggagcttagaagattatttggctctgtaaaaagcacgatgcttttacctggtgaaatttttctggctacattacctgcggaagaaattgaggcagtgaggacaattacagctcagccgccgatgtttttacgtcacttgtttcctgttcattttcaggaagaaggaacggacctggttcaggtgcaggaacggctggttgcattcatccgtaaccgcaaggaactgatgaatcaacgtgtttctttacaagtgcgcaaaggatctaatagcagttggactgaaagcgcaggtgcgctcaagcaggctttgagtgaacaaataagtgatctacctatggagcagacagtacaaggcgccgatcttattgtgtccgtttttgcagatacagatacgtggtatgcaggtgtatcacgtcctgaggataacctatcggattggagcggaggcgcggttcgttttcaaaaagaagatggacaaatttctcgtgccaaattcaagctattggaagcggaagcaacgttcggcatagattttgctgctttccgtcagggactggatattggggcagcaccgggtggttggacttccttcttactggagcggggactgaaagttacagcggttgatccggcaaagatggagccatcactgatgaagtacgccaatctgacttttttgcgtaaaaatgcaagtgaagtcaaatttaaagagaattcgttcgatctgctggtttgtgatatgagctggagtcctaagcaaatggcaaggctcgttactgatttactatatagtttgcgaagtggtggtactgctatcgttacggtcaagctaatgcataaaaagcccttggcgctcattcatgatgtaattgcttcatttgaggagtccggcatgcagattcagcgagctaagcagctattccataaccgagatgaaattaccctgtacatgatcaagtatggaaaataatactttacaatagatacaggtgtgctatataataaatccaaattgttccttaaaaataataatcatgtttaaatcaagggaaagcatcccgcgaaaacggttttcatggcgacatggaaatttgattttgcggcagctttcccttttttgcgttgtctgctttagaaaggaggtaggagaataatggagcaaccatcacagttggaattcggatccattgtcggtgagcgttaccgtattgttcgcacattgggttcgggaggaatgagccgcgtgttcatggcagaggatttaaaactgccaggcaagcaatgggcggtgaaggagtcggttgccgggccacaagtgatgaagcttgtacgtacggaggcagagatgctgatttcgctaagtcatccacgtttaccgagaattgttgatttttttgagcatcctcgatctggtgcggtatacctggtcatggattacatcgagggaattacgctggaagcatacatgaagggctatgaaggctatattccacaggagcagatcgtcccattcgctttgcaggtactggatgtgttggattatttgcatacccgtcaaccgccagtcatttaccgggatctgaaaccgacgaatattatgctgacaccggaaatggaatttatactgattgattttggaatagcgaggagctataaggctgaactggatcaagatacggtaaagctgggcacagtgggcttcgctgccccggagcaatatggagcaggtcagacggatgctcgttcagacttatacagtttgggagcgctgctattgtatctatgtacaggaggcaaatatagcgagtggactgcgggagtagaagggtatattcgcggagaattgccccgccaattgatcccggtgattcgaaaactgctgcgtcagcatcctgaggaacgatttcaatctgccggggaggtcattggagaactgcggcacagtgcggattttcagcctgctcaacaaggaatatccgttaatgatgcctcaatggattatgcaggtacaagggtagtggctgtattgggtgtctcggccggctccggtgctactcatacagcaattgcggtgagccactatctggctcgaaggtcccgctccgtagctttggttgagctgcacagcacaaccaaagcatttgcccgacttcaagaagtcgtagaaggcacatccgttggacaatcgagttcaagtcggcgttttgaagttgatggagtacactactggcggcaaacatctcgtgcggatgtcatttctttgttgggtggttcctatagatttatcgtactggacctggggagtgggcaggacaatgaacgactggaagaattcttgagagccgattatccgcttgtcgttggctcaggggccgaatggagagttcaggatatagcagggctagcccgatctcttcagcgccacccacagcataaatggaattactgcttgccattggcaacctcggaggcggttcgcaggcttcgtaaggagctggatcacgataaagtatttgctttaccgttccactcagacccctttgaacgagatgatgaggtggatcaggtgctggacgagctgtttcgcggagtcattccagatacccggaaaaaacgcttcggattccttaaacgacagcgctaaatagaacggtatatatcaaaaagaggcaggggagaagttgtgtgtccaagctaagaaaaagcagtaaacaaaagctatacgccggttgtattggcgcagggattattggcactatctttgctggctaccttatgattaatatccacaaaatggatgaggtcaggaaacaggctgaagtagaggcagagcagaaatggaaagtgtatgaacaagagcaacgaaccgcgaaaaaaggttgggcggttgtccgtgacatttcctcaggcgaacagattgcatctaatgatttgaagggaattaaagttcccggttctcaggccccatcaaatttgctgacagataaaagtgaagtttccggtaccacagccaagattgagctaaaaaagggatctgtgcttacatcggccatggttactgctgatgagcccacacctaaagatttacgcaaccgtgagctaaaggtggtagtattgcccaacagcctcaagtcgggtgacgaagtggatatccgcattcaatttccaacagggcaggattacattctattatctaagaagaagatttctcgactggaaggtccaattgtctgggtcactttgaatgagcaggaaatattatcgctttcgagtgcgattgttgatgcttatctgcataaagcatctatctatgccctgacatatgtcgatccccaatttcagcccaaggcaatcccgacctatccgcctaatgcgcaggtgttagcgttaatgaatagtgatccgaatttgatacgcgtggctgaacaaaagctgtccaagcagctgcgggattcgcttgaaaatgcaattaatgcgtcaaacaatgtgatttcaacacccgtggaaagaagtttgagtgaggaaattgtagcccagcatgcgggtgctactatagaaaacccagcaagcgggatagatgatacaagaaatgaatatgagaacgagcaggatcatcaagaacaaacaaagattctgacgcagggcgaaagctctgatccgtatgccaaataaatgagagaaaaggaacggaagtatgaaaacatggatatttgccgggctttgtgacaaaagcgataccttgttatatatcagcagtatattagcagcttccggccaacaggtactgcttgtggatgctacgctgcggggacagtatcggtatagcatagggatgctcgacaaaccacttcccattacgcagtttagtggttttgatgtagcaattggatttacagcatgggaagacctgcataccgttatgatgactgatcaaaaggcggagcaggcttatgacattgttattttggatgtagagttacctgatttttgtccaatttctgtttggaaaggggcagaactgcgagtttgggtcagtgattatagccgtatgctaatgcacaacggacagaattggcttgagcatttattcagtcaacccgaattccccaaagatcttgtatttcacaagctatttttacaggctgtggattgtggtgtggaggagccgtatctgtgggaatacatgaaccatttcccggcttcttggcagcaagagccatatgttctgccatgggatgaggggctgcttgctctgaaactggaaaatgagcataaaaaacagctactactaaaaccgctatccagaatgtataagaaagaattatgccgttgtattggggaatggatgagttgggaattaaaagtgagtcgtcgtgcgctaaagcgtgcggaaaggagtagggcatgagtaccattttgttttggagccccattaagggggctagtggaagtagctctttggcggcagcaatagcaattaccatagggaatctatatagaggaagactattattgacacatttaggtcgtagatataccggtattgaatcaggattacctatacaagagtatggtatggacgatccaaccctacagcttcaggaagggggctgggatgctgccgcacgtttggttctgcgagggacactgtctaaagaaaatattcgtaattatacgacacctgtactcgaacatactttggatgtacttgagggaacctccacctttggagctgcaccgccgttactatctccagggcttgtacgggcagtaatagatacagcgaatcaatattatgatttaacgctgattgatgcaggaagtggagcagggtggggggctgtacagcatgaagcatgtgcacaagccaaactggccgttctttcactcactcagaatatgcgagaattagatgcttattttgaatccgtgtctccgttatctacctactcatcattgcccttattaatagtacttgggaaatatgatgtgcattctcaagtgaatgaaacgaatattcgcaggagatatggctacaaaggtgctttgtatacagtcccttatagcaccggatttatggacgcatggaaccgcagggatgtgatcggccatgtgcaacgtgaggtacgaagtggaaaagagcagcatcgcaagctttttatgcccgtaggatgggcgcagagtatacgacatatcagcaaagctattctggaggcgtcagagtccgatcttcgactcaaggctttggagaggggcgcttaaatgctgtccgctcaaatgatcaacggattgattcttacctgcatagtactgatgtgcatcgtactgattattgttaaatatcgagggaatcttcactcgcgacattcaacccttcgggtagaaaaaaagaacgaagatgccacattcgaaacattaatagagtatatcaaaaatgcacttcatgaactgagtcatagccagatggcggatgccggattgcatgaagaggaatatagacggcgtatccatcaaagggcggaactacgcagggcgttaaaggactgtgccaatggcagcattggagataaacgttttgttaaaaatctgatggctgagcttctgattaacggttacggcttgaacgagaaaatcgtcgatactgttatgccattctccagacctgagttgtttagcatacaggatcaattcgaaattatattttaccaataccagcagaagtttggcgctgatgcactatcacgtttattggatacttatgacttggccgaaatgaggtattcacagcaaggtgaagaagatggaagttatctcgttaccgcagaggatattcgttatatctatgactgtgagtaccgccctctttcctttttggagaaagtggatattattgtccagcgcatttatcagcattacaaaggcttttccgtcattgatgatattcgtgaccagcggatcgacggtgtaagtgggggtgtcagtggtatgccggaaggtgggattcctgcatcatcagactggccttcggatgggtatgcatttgaacaaacatctgcgtctactgccaatggttatgagagcgtgtggattttttataaaggtaaaacgatccatctttcgttcctttccttcggatctgagcgtgaacttaaaagggtgtgccaaaatatttacaaatacaattacccgggccagctttccgaagcgaatggttataaggtcaacgaaatgaaggatgggtcacgggtagtggtggtgcgccctcctttctcagaatcgtgggctttctttgttcgtaaattcgatattcaaagcgcatcgctggaacagttaattaagggacagaatgctgattttccaatccaactactttcttatttaatgaaaggcagccggattactgctattacaggcgcgcagggttcaggtaagacgacgttgttaatggcgatggtcaagcatatttatgcttcgtatacgcttcgtgttcaggaaatggcctttgaactgcatctgcgcagcatttacagtcgccgtaacattcttacctttcgagaaacggaccatatttcaggacaacaagggcttgacttgcagaaaaaaacagatggaaccgtcaatatcctaggcgaagtagcaagtgatgaagtagctgcttggatgattcaaatgtcgcaggttgccagtctgttcaccatttttactcatcatgccaaaacatttcgtgatctcgtgttttcacttcgtaattcattgctcaaaacaggagtatttcagcatgaaggcatcgctgaggaacaggtagttcatgtcattaactttgatgtgcatctcaaacgtgatgcggaggggcgacgctacatcgaacggatcacagaatgtgtgccgtgtgacccggatcgtacggatgcaggctccaatgcttcattgagctacagttatcgccacgttatggaatatcggaacggaagctatataccgatggagcccttaacagccaaaagtgcaaaagaaatgtgtgagcagatgaatgtaaaggatgccagagatttccgcagttttttgacccgctattgggaggaagactatgagtcttaaagaaatttcattatggattttacttatatcaggtggaagctttgcgcttctatatatagttttgtgggggttgcataagcgtagtagtcatgcagttcgcagaggacgaatttattctgtgcaggaaggacgtaagggaaaagcggtactgcaacgtgagctgcaagccttactgcataagttgtacacgctatgtatgaaggtccctttcttatctggctacatcacgagtgtacgtaagcgactagctggtcagcatgcctacgatgagtacaagcttcgcctacagactatgaagatgacactgttcatctggggggcttttgcttgcagtggcgttgtactggtcatgatgaagccaggaatagagtttgctatattggccgttttatgcggagtggtaatcaacagtcttattttggatatggccattagccggatggaaaaaaggctacttgcacagatgatcgaattattcgccaatgtacgtcattattaccatcagcacggtatggtggaggaagccatatccgaagcggccgatttggcggaggcagaggctgggagacacgcacgactcatccatgaggcgctaacagatgttgatccgcacgaagcattggaaagatactatgagtcggctcctaatcgatttttaaaagcatttgccggtatctcgtatatggtaatggagtttggtgatcggattgaggaggggggctccatttatttgaaggggctcggcagtctcgcacgcgaaatccagttggagttgctgcgaagaaataaactggactatctattaaaaagtctaaacgtgatcgcactggcacctgttttctttaccaccccaatcgagacatgggcgagatccagctttccatccatggatgagttttatcagggaaaattgggttatatcacgaaattgtccgtttatattgtgataatcgtatcttattttctgttacagaagcttcaacagaccgatgaaacaggatatcgtgcgggtagaggacggagggtttgggaacagaagctataccgttttcccatcatccgtaatgtggtggattctttaattccgcgtcagcatatatcttcttatttccagataacccgtctattaaaagaaagtggtgcggagataaagctggagtggctctacatacgcagaatagctctttttatcgtaggtttggtgctcagtattagtacgatattttttttacatgaagctgagaaaacgcatatccttcacgccccggtacaatcgggtcaaatgtttggacatttaagtccgatggagcaaaaagaagctttgaagcagagtgggattgatcgcaaaatcatgcatttgctgaacatgagagcggacagcacatacgaacgaacgtacgctgctttagaacataatgccaatggaactgttactcctgaacagctatccacaaatactcggcgtattctccaaaagctgaaagattggaatgatgaatacatcaagtggtgggaagtgctgattagtttgattgttgggtatgtagcctatcaaatgcctatgcttttattatatttgcaacgaaaaatgcgtcggttggatatgaggcacgaggtgtatcaatttcaaacagttatttccattttgcgggttatggaacgaatgtctgtcgaggaaatattggagtggctgaacagattttcagttatattcaaaagacctctgcaaaaatgtttgcttcattatgaacatgggccagaggcagctcttgacttattaaaagaagaggcacctttgccggagtttcagcgtctagtggacaagctccatttgtctttgggtaaaattacgattcgagaggcctttgatgatttggaatcccatatgtcctactatttcgaacaaagaaaacaggagtatgaaaaaataatagacagcaaggctatctggggaaggatgattggctttgccccgatgtatggtcttatctttttatatttggtgattccgttgatcggcatgagttttgttcaaatggataactattatgagcaaatacaaaaaattcagtaagaaagttctattatgactaatacaaaataacaagctgaggagagaaaaatatgaataacgcatcaacagctttaaaggtagccgctgggatatttttgaccatcgctctaattacgattgtagttatactgtttatttcagcccaggaggcgactaaaacggcacaaaacaattttgctgatatccagaccgaattgtctcaagcctcttttacggtatatgacggcacaacgattagcggttcccaggtgaccaacgcgctacggaagtttcaggggaaggaccaattcggcattcagattaaaaccggtaaaaatatggcaggccagtggtacggtaatgctctgaacattagcccagacagtgaacagtatggcgcagtgaatggtggcagtgataagactgggaaaatcacgaatacgcttaatgagaaagagaatgaatacgtaaatccaagtggcaaattcaaggctgaaatcgtaaaggacaaatcgaacgttgtccgtgggttgttgtttacccagtcctaagcactacagcaaagataataatcataagggggatgagagtatgtctgatcacgcttcaagtatgctgcggcttggtgtgtcagttattctgttcataaccgcatgtgtaacggcagcagacttgtccagccagctggatggtgcactggaattaagatcacagcaagaggagcattctgaagggcgaatagcccgtactgctggggtgggattgccggaacggattaaaggaactcaggtcatacaggctattcgcatgaacttacaggaggggatttcggttcaagtcgacgggacagagtacgatgtgtattctgaaccatttgagcctgatgtatctgccctggatgcttcctctttatattccatgtatccacagcgtaaagggaatggggacataacatctgtacgttttgagaaattgggggaagactgaagtggttcaaacaatatccaagttgttggggacgctgctcgctgtattgcttttgtacatcgtacccgcagttcaagctgctgaacggcaggatgatatatccgggttaaatacatatcattcaactgtacgttttgttgatatggtaagaacaaaaggttacattacaccgacgatgtataacgattttatgcgtgatctggaattgacaggcaatacgtacgaagttgacttggagcatatgcacaaaaagtatgtaccggactatgcagatgccgcgaagccagacagttttctgggcaactatgaaactgtatatgatgggtactataatccgcaaatcttggctgtactgtttcctgacaatcagcagccaaaatcagatcagacacgtcggtataccttgatggccggggattattttacggtccggttacataatacgaatcggactcctgcgaacttgtacaaatcatggcttctcggtggggcagatagcggcaagccggcagttacagcttcttacgggggcatggttctgaatgaagattactgattttgcagtcatatttatacttttgtttttgccctttggtgtagttagtgacttacgggtgcagaatcagcgtgaagtgcagcagctagaaatgaaatatacgtcggctctccgtaccgcagttcaggatgcaggggtcgtgctctcacagaatgaacgtcaggaacgcgaggccggatacggatcggataagttttttcgtgtagataaagaagcagcgctgaacacgttcctgcataccctttctcttaatgtaggcattgatgaggatatagtagcacaacgtgcattattggattatataccagccattgtaattctggattatgacggttattatgcgttcacttcagaagcctatacagacgagcgtggacaagctgctattgcccacaaatggagcgaaaaaaaaccatatgcttatgttgattcagtaggcaacagtgtggggttcagcttggataattatgtgcacgcatacgatgcgcggaatcacaggtgggtggagggctttcaaaaggaacttcaggatcagactcctatatctttactgaataattcagaagcttttgagcaaatacgtcgttccactattgttggcagcgttcaagaggacctggcgcgaattattaatgtccataacgaaaaagctgcacgtaacggcatatcctatacattcacactaccgatcattccgcaagaggagtggtacaacacgatagatgatgtgggtctgatcgcgtttatccaaggcattccggtcggagacaggtattacaataactatggatttggtggtgggagagtcgtcagaaagcaagacattatcggtggcatagaaccagaaactagaatgaaatatttttatagagattcatgtccagctccctttaaagcgagtgaacgttttacggatgaaaaatctgcagcagctgcgggatactttgagtacaaatgttataatggcttaaaataatcaccctcatgggtggtttttgtttttttaggcagatccataccaaaaaaccttaaaattcactgttttcaatattccgatatggttgtagaatgtgctacaataaagctttgaaagaaacgaaatgcatatgaaataagaacagtcggcagcgccgatgacaataaggagccaaaaacagcttatgagtttattgactgtagaaaatgtatcccacaactttggggaccgcgcattatttaaaaatgtttcctttcgattgcttgcgggggaacgtgtaggtttggtaggagctaacggtgttggtaaatcgacactcatgaacattctcactggaaaattgcttaaggatgagggtaaagtggaatggactccacgtgtacgttacggttatctggatcagcacaccaagctgacaccgggcaaaacggtacgtgatgtattaaaagacgcttttcttcctttgttggaattggaaaaggaaatgatgcagattactgacaaaatgggggatgcttctcctgaagagttggaagtgttgctggaacagatgggtgaaattcaggagcaactggatatgggggatttttacctcattgatgtgaaggttgaagaaatggcgaatggactaggtctgtcggccataggactggatcgggacgtatctgcacttagcggcgggcaacggacaaaggtgcttcttgctaaattgctgttggaaaagccgaatgtcctgctgctggatgagcctaccaactacttggatgtagagcatattgaatggcttacgcgctatttgaaggattatccctatgcttttatccttatttcacatgatactgagtttatgaaccaggtcgttaatgttatttaccatcttgaatttgccaagatgacccgttattcagctaactatgaaaagtttcttgaaatggcggatctgaacaaagctcagcatattgatgcttatgagaagcaacaggactttattaagaaacaggaagattttattcagcgtaataaagcgcgtgcttctacctcaggccgagcaaagagccgtgaaaagcagcttgatcggatcgaacgtattgataagcctgaagaagccgcaaaaccaacctttcaattcaaagaggcacgtgcaagcggaaagacggtatttgagggtattgattttgagattggttatacacatgctcttttgcctaaaatgtccatgacgattgaacgtggcgaaaaaattgcaattgttggctacaacggtgtcggtaaatcgacattgctcaaaaccatattgggaaaaattccgccaatcagtggaaaaacctatcaaggtgattttttgcagcccgcttattttgaacaggaagtaaaggcggagaaaattacaccgattgacgatgtgtggaatgaatttccgcatttgaaccagcatgaagtacgagcgcatttggcgcgctgcggtttgaaaaatgagcatatcacacgtccgctatctgcgcttagtggtggagaacaggctaaagtccgtctttgcaaactgttaatgcgtgaaagcaactgggtattgttcgatgagcctaccaaccacttggatgttaaagcaaaggatgagctgaaacgtgccttgaaggaatacaaagggaccgtattgcttgtatctcacgaaccggacttttacgaggattgggtaaccaaaacgtggaatgtggaagagtggtcaagtaaagttaactaaaatcagttaaatccagttctgcatatttcacacgaagtggggtttgcagaattaggaaaatatgctaagctatctatagcttatacaataaaatagtcacactaggggagccgcccatgcggctgagacggaataaatggatttcggaccctttgcacctgatctgggttatgccagcgtagggaagtgagcgccgtacaaacaaggcaacaccatctttattttgtttgtgcgtgggacgatacacgtatacggatatcatggtccgttcgattattggacgttcgttaaaccacttccttggggaagtggtttttttgcgtttcgttcattttaagttgttcgagcttccgtagacggattcacatacaatcccctttcattactgctggtagacgtggctgctaagcttagatcctttaatccaatgtgaggtgaagacaaaatcgaattacacgcaatttcgatggaaaagggcacttttgcacaagccgcccgagtggctgctatgatttgtccgtatgttcattatgtacacgcacgtttaaaacagaatggtgcctctgcattgctttctttgactcgcagcatggtggagcaggaagttcctttgcaacaaattgtagtaaatgatcgtgtggatgtagctttacttactttggttggaaccgtccagctaccagctaatggattacctgttgtggatgtgaaaagcctactttcaaagagtacacgctgtggagtgtctgtgcattccttggaggaggcgcagactgccgagcaggcaggagcagactatgtactttatggtcacgtatatgagacccattgtaagcccggtattgtaccgcgggggttagctcagcttgaacatatttgcaggctgtcgaacattccggtgatcgcgctgggcggcatacaaccgcaccatatcccggagctttatatggccggagcaagcggaattgcggtgatgtctggtatatgggaggctgagtcgcccattgcagctgcgatggaatataggcgaatggcagatcttgtagttcacagcttgtagcgagaaaacgagagtagaggcaagctgaaagcagaatggtttatggagaggagacacggaacaaatgctaaagatacacacagaggcaagagcgataggacatgctgaatgcttggtcataggtggaggtgtcatcggcagttccattgcttatcatgtggccaaggagggaagaagtacgatcatgctggaacgattgatcccgggtgagggagcctcaggagcagcggttggaatgctggcagcggaaagtgaagagttcaccgactctgagctggcacgatttgctcgcagaagtcgagatgcattccctgagcttgtctgtgatctggagcgtttgtcgggtatttcggtggaattccgtacagaaggatttgtgacccctttccgtacggaaactgaaggccaaaaacgctggaaagctgctaaaacgcgagaggatgattgtcctatctggtgggatgcgagggaattggcccgacgaattccaggtttggatgaacaagcgatcggagcaatatatcgttcaaaggagacacaagtggctcctgtccagctttgtcgtgcttatgcaggtgctgctgcggtgctgggagcaacggtatggtctggtacacgggcagagcaactggtcatacaggatggtcgagtttgcggtgtccgaacagatagcggctttttttcctgcgatcaggtcattattgctggaggcttggatagcatgaaattactggcgcaggttggatttgaatatccactttattcggtcaagggcgaagcggtagcggtctccttgaaggatcacccattagaatacaccatttatgctgatgatatttacctcgtgcctaaacagaataacgagctttggattggggcaacgagccttccgcatcaatatgacgaagaagtgaccgtaggaggcttggaggggttgctggcacgtgcctctgcctggctgccgtgcgtccgtgaagcttcttttatacgcgcttgggcgggcttacgtccgcaggctgcatcaggccatccttttataggtactgttcctggggtcgagggcgtatatgctgcggtcgggcattatcgcaacggtgtcctgctgagtgatgctaccgggcgtgcgatggcagctatgcttaatggagctggtgcagcagaacttgggataagtagtttttcttctgagctcctcaaggagaaaagcttatgaagctgacgattaacggccagagcatgaccttttctaatcgaatcactcatgtgaatcaattgctacatgagcttgatgtaaaggtgaaaaccgtagtggtggagctgaatcggcatatattgagccgtgaagatcatgatgaagcggtactgaaggatggagattgcctagaaattgtacattttgtgggaggcggttgattatgttaaccattggaaaagcatcttttacctcgaggttgttgttgggaacaggaaaattctctgatctggatatccaatcccaagccgtagaggctgctgagacggaaatattgacgtttgctgtacggagattgaacttggaggaacgggataagcagcattttctcgatatgctggatttgagccggtatacacttcttcccaacacagcaggggctacaacagcagaggaggcgattcgtattgccaaattggcaaaagcctccggcctgtgcgatatgattaaggtggaagtcattggggatagcaagacactgctccctgacccttttgaaacgttgaaagctagtgataagctgttggaagaaggctttatcgtgctgccctacatatcggacgatgtgattctagcaaagaggctacaagagcttggagtacacgccgttatgcctggagcttcaccgattggtacaggacatggtttgctcaatccgttttcattagggctaattattgaacaggcggaggttccggttattgtcgatgcgggtattcgctcacccggtgacgcggcaatggcgatgcagttaggggcagatgctgttttgttgaacacagccgtatcaggagcgaaggacccagtaaaaatggccgaggccatgaaactggctgttcgtgctggaagatatggttttgaggcggggatgattcctgtaaaacgttacgcttcagcaagcagtccgacagaaggtatggttcaggcatgaaggtaactgacaaatccgatgcaggagaaacacatccaagtgaccgttattccagacaggaaagattcgcgccctttggaccgacgggacaacgccggcttgcttcttcccacgtactaatcataggtgtcggagcgttaggtacaggtattgcggaaacgctcgttcgcgggggcgtaggtacagtgagcctcgtagaccgggattatgtggaatggagcaatttgcagcgccagcagctttttcaggaaagtgatgctgcgcaaagatatcccaaagcagtagctgctcagcgaagattaaaggatattaattcggaaacggttatacatgcacatgtactggatgttggggtggaagaactggaagagttgatcttgggggtagatctcatgatggatgcaaccgataatttcgatacccgacttcttatgaacgacatggcactcaagcatcggataccttggatttatgggggatgtgtgggcagctatggtgtaacctataccatcttaccgggtcaaacgccttgtcttcactgtctgctgggaactgtaccgtttggtggagaaacctgtgataccgccgggattattccgcaggccgtacagatggtcacggctaaccaaactacggaagctttcaaacttcttggtggatatccggaagatttgagaggaaagctgctttcgtttgatttgtggaaaaatgagtatgtagcaatagcggtagatagcgttaaaaaggagaactgtccttcttgcggcagccaaccgacgtatccctatttgtcggcctctcatcggcagaagacagatgttttgtgcggtagggataccgttcaaattagaccagcaaacccaacacatctgaatcttgcagaaacagcagatagatttgcttctttgggagaaggaaaagtagagcggaatccgtttttggtttcctttaatacaagcgagcatcgcttggttgtttttgcagatggcagagcgttgattcatgggacaaaggacgtggcaaaagcaagaagtctgtatcatcgctatttgggttaaactataaaagcagaaagccattctttggagaatgattttctgcttttttgttacaataatatagatatgctttaatggcttacaacacaaacttgttcgtatccaatatgtaatgctatgtccaaaccaggtgggtgaaaagatgagcccgttaattctacttgtgaatgtaaatgaagcgtctcccgtatttgttcatccattggagcaggcaggttatcaggtggttcatgttagcaatacaacagatgcaagctcttatgtagcccataatcctgtggatttgctactgctcaatatagaagatgaaccgacggattcacatggcttgcttcgcacattgcagcaataccatcctcatatcccgctatttgttatgacttcatcagatgaggaggaccatattgtttcctgctttgaacaaggagcacatgacgtgatcgttcggcccttttatcctagagtttttcaggctagggtggctaatttattgcggatttttggtattgaacgtgatgtgaaaagggcaatcgaggcgggggatttacatatagacaatgcaagcagaatggtgagcagaggggggggaaagctggaattaactccgaaagaatttgatcttttgcttcacctggcgatacatcttaaccaagtttgtagcagacagcaaattctgaaggatgtttggaaacatgattatatcgttgatacgaacgtagtagacgtctatatcagacatttgagggttaaagtagataaaggatataagtttaaaatgatccgtacggaacgaggaattggctattcactcagaacaccaaccgtatcagaatagcataaggcatataaaaaaaaccggaactttcgtcccggctcgcatatttcataatgagtttcaaactacagcacgcggcgtgctttaatgtatgttcttttccagttgccagagttcaaatcggagatagtcacgccaggtccgccgtaagtgtgtagaattttacccccgcccatatagactgctacgtgggtaatgttgcgacccgtggcacggctaccgcttgaaaagaacactaagtccccttttttcaaattggacttggatacagcatgtccaactttggactgttgaacagaagtacgcggcaaattcactccgtatttcttgaatatgtgcttcatgaaagaagaacagtcaaaattgcgggtcgtgcttgtggaagctccaaacttatagggagtgcccatatatttttcgccgtagttaattactttttggccaacagaagtagtagtggcagcctgtgccgtatttgttccctcaattgcaaaagtaccaaagccgatagtggctgcgacccctgcgataattaccttttttatgattttctgcatattcatgttgtaagtacctccagaaattgatttgtgcaatattttgctgagttgctaactaactgacagcgttgagtataacagttttgaagccgcctaatagttggaaaagaactctcaaatgcttgagggacaagacttacacagtgattattaaaaaacgattaaaaattacaatttgttaaaaatatatcgattcatagatctctacaaacggaaaaacccttatgaatcaagggttttgagtgaaaaaacaatttaaacaatggttacaacaatgtcataattaatccttgctttgaataacgagtagaagaccgcttttgatggaaatcgtaccttttggagccgttagcttattactgacagcacgtgattgtcccattttgagggtggcattatgtaatggatacataaatccttccagttgtatgcctgttacttcggcagtcataggaagcagcgatgtatatgtataacccataggctggatctcaagcgttgatccggtgagctcaatataattatgtgcgtccataatagcgcaactaatatgatgctgcattgcacgtaccaatatttgaacattagccaatgtgtggtccatccgggtgccagtcacaccaagtagcagtacatgatctgcctgttcgtccatagcgatttccaaagcaagctcggtatctgttaagtctttaagtactggatcgcacgcaatcatacgttggcttgctgattctaccttttctttttcctctggtgtgatcgaatcaaaatctcctacagagatatgtggtgtaataccgtgctcgatcaggaaaagagcacctttatctgcacctataataaaatcatcgggttgtatttgatgtaaatcttcttcattaagacgaccgcctgaaaatacaatcgctcgtttttttgtcataatcaacatcctttctttctgatacgatcctatatataccatcgtttttaagtataccgcgttaaatatggcttgcacaattttggaggacatggctacaatgaaacagaaaaaaaggaagtgtaacgtgtaataggaaggagaacgaaatgattaacgttttgtttgtgtgtttgggcaatatttgccgctctccgatgggggaggcaatactgaggcataaagcgcaggaacggggattgggcgcagaaatcggggtggactcggccgggacaggcgactggcacatcggaaatcccccgcatgagggaacattaaagcaacttaaactgcatggaatcagcgaacaaggcatacaggcgcggcaaataacgggccgtgattttgatgcgtttgattatattgtgtgcatggatgactctaatgaacgaaacatgcgaaagattgcaggtggagcggaggctgatattctaaaatttatggatttgcttcctcaagaaaaattaagagaagtacccgatccatattttacagaaaattttgaagagacctatcgattaatggacgcaggctgcgacgccttgctggacaagatcgtagaagaaaagctataatgtgaacgacagatgacggcgataattgccgtttttcgttatacttttttgaaagcgcaatcaaaatgcactaaaaaatgaggaaggagctttatgacctagtaggtcaatgctccattccctatagaagaatttatactcaggcgcgatccaaaaaatacattagcgcgtcaggcaactcgttttgccaaaagccccacaaatgtttgccatccttttcacggtaagaaacttcagcgttccgttcgcgcagcaaatctgcacattgacggttaagttctacaaagttgtaaatgccagtatcactctcaaatgcatcttcctgaaggccaaccgtcatccacacccgcatatgagaaagatctttctcacgggcgatgatttcctgcgaagcttcatagtaagcacctgagaggctgataatgcggttgaacagctgaggatacatcaaagccaaatgcagagacacactgcctcccagtgaatcccccgccaaaatgcgggacgctgcatcttttcttataggatacttttgctccacatagggaataatctcttctgcaaaacaggtggtatacgcctcaaaacgattgccaaagggagcgtactcctgagttctgattttggtattcacttccacacctacaataatgaagggttcgacgccctcatctagaatgaggcggttggcgtgagttgcaatgcggccaaaattgaaaaattcttctccgtcctgacagtatacgaccgggtagctcaatatttcattatagccgggcggcaaatatatccggagagttctgatctcgctaagaaagcggctatttacttcgtctttaaggatggttcgttttaaataccgagaatccgtcatttttcgtcacctttcttgggtattattttgcattcgggatcacaataagttaagattaccctgattgcaatagatgtttaaaatttcaatcatgtactaagctgttatagtaaaaaacataccctgttacatacacaaaaatgtggtaaactcaaaaaaaataactaaatctttgacgcgagcgatataacaggtgtataataatcctataacagcggaacttgatattcaaatttttttgttgaggtgaagaaaatgagcaaggttccttatgaagtttacacagaggaagttgaggcgctgtccgtactttctccggatggtgaaattatcaataaagatatgttgcctaaacttacagatgatcaattgaaagaaattatgtatcgaatggtatttacacgtacttgggatgaccgtgccgttaacttaggtcgtcaaggacgtctcggtttctacgctccggtatccggacaagaagcaaccatgattggtagcgaatatgcgctccaaaaagaagactttattgctccaggctaccgcgatattccgcaaatcgtttggcatggcctgccattataccaagctttcttgtattcccgtggtcatcaacacggcggccaagtgccggacggtgttaatgtactgatgccgcaaatcatcattggcgcgcaaattttgcatgctatgggtattgctatgggttacaaactgaaaaagcaaaaacaagtcgccattacatatacaggtgacggcggttcttccgaaggtgatttctacgaaggtctgaactatgctggtgtatacaagttgccagttattttctttgtgcaaaacaatggttacgcgatcacgactccattttcaaaacaaacggctgctctttcgatcgctcataaagcagtagctgctggtattaaaggcgtgaaaattgatggcatggacgtgcttgcagttattaaagccgttcaagaagctgcagagcgtggacgtaatggtgaaggtgctactttgattgaagccgtaacgtaccgtttccgtccacattccctttctgatgatgcaacaaaatatcgttctaaagaagaagaaggcgaatggaatgcgaaagatccaattgcccgctttgcgaaataccttgagaaaaaaggtctttggactgaagaagatacagctcgcgtaaaagaagaagctaaggcaaaagtgaacgaagagatcaaaaaagccgagaaaacagagaaaatgacaattcctggcctgatcgatagcatgttcgaaacaacgcctaagcacttggaagaacaaaaagctgattttaaataattgaacttgaaagagaccgggcggtaacccgatccggtctgcttttcgattgacctgaactgaaattgatctgtcaatgtttaaggaggaaatgaagcaaatggcacaaatgaacatgaaagaagcgattcgtgacgcactgcgcgtagagttgaaacgcgaccctaacgtcctgcttttcggtgaagacgtaggtcatgtaggtggcgtattccgcgctacagaaggtctgcaaaaagaatttggcgaagaacgtgtattcgatactccgctggcggaatccgcaatcgggggtcttgctgtgggtctgggtatccaaggcttccgccctgtagctgaaatccagttcgtaggctttatctttgaagcactcgatcaaatggcaattcaagcatcccgtatgcgctaccgttccggtggacgttacaattctccaatcgtattccgtacaccttttggtggcggtgttaaggcggccgagctgcatacagattccctggaaggtcttctggctcaaacacctggtatcaaggttgttgttccttccaacccttacgatgcaaaaggtcttatgatcgcgtctattcgcgacaatgatccagtatttttcatggagcatttgaacttgtatcatgcattccgcgctgaagttcctgagaatgattacacagttgaactgggcaaagctaacgtagttcgtgaaggttccgatgtgacgatcattacttacggtatgatggtgcacacttcggttaaagctgctgatgagctggaaaaaacaaaaggtatcaaagtggaaatcattgatttgcgtaccattagtccgattgacattgataccgttgttgcttctattcaaaaaaccaaccgtgctatcgtggttcaagaagcgcaaaagagctccggtgtagctgctgaagttattgcacaaattaacgaaaaagcaatcctgcatctggaagcacctgttctgcgtgtagcaggcccggataccgtttatccttttgctcaaattgaagatacttggttgccaacgccaacacgtatcattgatgcggttaataaagtattggaattttaattaaagcacaccgtaaatttgggaggttttaaacgtggctaaatttgaatataaattcccggagctaggtgaaggtcttcacgaaggcgaaatcatcaagatgcacatcaagcccggcgacaaagtaacagatgaagatatcatcatggaagtacaaaacgataaggctgtagttgaagttccttgtccggttaatggtacagtacaagaagtatttgccaaagacggtgacatctttaacgttggtcaagtcgtagctgtaattgatgcagaaggtgaacttcctgaacaagaagaagcaccagaagcaccagctgctagccctgagccaagtgctgctgcacaaagcggagctgcaggtacagctagatttgaatataaatttccagagctgggtgaaggtcttcacgaaggcgaaatcatcaagatgcacatcaaggccggcgacaaagtaacagatgaagatatcatcatggaagtacaaaacgataaggctgtagttgaagttccttgtccggtcaatggcacagtacaagaggtatttgccaaagacggcgacatctttaacgtaggtcaagtcgtagctgtaatcgctgcagagggtgaacttcctgaacaagaagaagcaccagctgctgctaaacaagaacaggatgctgcacaaggcggagctaacactaaaccagctgcaactcctgctgcttctaacaaagatgtactagctacacctagcgtccgcaaatttgctcgtgagcaaggtgtaaacatcgctcaagtgagtggctccggcaaaaatggtaaaatcaccaaagaagatgtagaagctttcaaaaatggtggaggccaagcggctgcaccagtagcgaaagaagctgcaaaagcacaagagcctgctaagaaagaagcgaaagctgcagcagcatccgcaccagcagcagatccacgtgctgaggaagagcgcgtaccatttaaaggtatccgcaaggctatttccaatgctatggttaaatcggcttatacggctccgcacgttacgattatggatgaagtagatgtaactgaactggttgctttccgtactcgtatcaaaccaattgctgagaagaaaggcacaaaagtaacatacctaccattcatcgtaaaagctttggttgctgcatcccgtcaattcccggctctgaatgccacaatcgacgaagaagcaaacgaaattgtctacaaaaaatactacaacatcggtatcgctacagatacagacaacggcttgatcgttcctgttatcaaagatgctgatcgtaagagtatctggatgattgctgattccattcgtgatctggctgtgcgcggtcgtgatggaaaattggctgcgaacgaaatgagaggaagtacaatttccatcactaacatcggttctgcaggcggtatgttctttactccaatcattaacttccctgaagttgcgattttgggtactggccgcatcagtgaaaaagcagtcgtgaaaaacggtgaaattgtagccgctccagtaatggctctttccttgagctttgaccaccgtattattgacggtgcaactgctcaaaacttcatgaactatatcaaacagctgctcgctaaccctgagttgcttgttatggaggtgtaatcaatggtagtaggagacgcttctctggatattgacacattggttatcggtgcgggtcctggcggctatgtagctgccatccgtgccgcacaattgggacaaagcgtattgatcgttgacaaatctgagctgggcggtgtctgtctgaaccgtggatgtattccatccaaagctttgatctctgcagctcaccaatacgaagcagctaaacatggcgagtccttcggtattacggctgaaaatgtaaaagtagactttgctaaaacacaagaattcaaaaacggtgttgttaaaaaaatgacaggcggcgtaagcggcttgctcaaaggcaacaaagttgaagttttcaatggcgagtgcatgttcatcaacgaaaacgaagcgcgtgtattcaacgaacacgaatcaccacgttatcgttttaaaaatgcaattatcgcaacaggttcccgtccaatcgaactgaaaccattcccatttggcggacgcattctgtcttctacagaagcattgaacctgtctgaaattccaaaaagcctgatcgtaatcggtggtggatacattggtgcagagcttggacaaatgtactccaaattcggttccaaagtaacgatcattgaaggtatggatacagtgcttcctggtttcgacaaagatatgacttcgatcgttgcgaaaagcatgaagaaaactggcatcgaaatcttcactggcgctaaagcggaaagtgcagagcaaacagataaagacgtaacggtgaaattctccgttaacggcgaaagcaaagaagtaactgctgattatctgcttgtaactgttggacgtcgtccaaacacagacggtgaactgggtctggatctgatcggcgtagaactggatgagcgcggaatggtgaaagttgatcaccaaggacgtactagcattcctcacatctttgcaatcggcgatatcgtagctggtcttgctctggcacacaaagcttcttacgaaggtaaagtggctgctgaagcaatcgcaggcgagccgtctgtagtagattacaaatgtatgccagctgtcgttttcacagatccagaatgctccagcgtaggctacacagagacagaagccaaagaaaaaggctacaatgtcaaagttggcaagttctcttatggagcaaacggtcgtgcggtttccctgaacgctgctgaaggttttgtgaaaatcgtagctgacgctgacacaggtctggtactgggtacgcaaatcgtaggcctggaagcctccaaccttattgctgagctgggtctggcgattgaaatgggtgctacactcgaagatatctccttgactattcatgctcaccctacattgggcgaaatcgttatggaagcagcggaagtcgtgctgggtcatccgatccatgcattggcaccacgtcgctaataccatttttcattatctcgtttttggttttcatacatgacaaagagaggcaaggagcgctatatctgcgctctttgtctcttttttttcaaactttagggttttcaggactactatgaaaattcacacagtacatggtcaacgaagcaccgtacatgataaactaaatatagatattggtgcagaaaaagaattttaaagattagaatctggcgatgccaggtttttattcatgctcaaaggagaggaataacgtgcgcaactatttggaactgctggaggatattttagagaatggagtaaaaaaagaggatcgtacaggaacgggtacactatctgttttcggaagacaactccgttttgatctggccaagggcttccccttggtgaccaccaaaagagttcatttgaaatccgttattcatgagctgttatggtttttgcggggagataccaacatttcttatctcaaggagaacggagttaccatttgggatgagtgggcggacgagcaggggaatctggggcctgtatatggatcgcaatggcgctcgtgggaaacaacagacgggcaacatattgatcaaattgcgaatgtcatagaggctattaaaaacaatccagactcacgtcgacacatcgtcagtgcttggaatgtggcagaaatcgaatccatgaagttgccgccatgtcactttgtatttcagttctatgtagctggaggaaagctttcctgtatgctaacaatgcgttctgtggatacctttttagggctgccgttcaacatcgcgagttatgcattgcttacgcatatggttgcacagcagtgtggtttggagcccggcgaatttatttggtcaggcggcgatgtgcatatttattcaaatcatatgcaacaagtgcatacacagctggaacgtgatccttatccgttgcctcagttaaaaattctgcgcaaaccggattcgatttttgattatacctatgacgattttgcttttgaaaattacgagtatcatccagggattaaggcgcctgtcgccatctgattagaggaggtggaaaaatgggcatttcaatgatatgggctatggcacaaaatggtgtgattggccgggataacaaacttccctggcgcctccctagagacatggcctttttcaaagagcagacgattaataaaacggtactcatggggcgcaagacgtgggaatcctttggaggaaaaagcctgccaaaccgacgtaacgtcgtcttaactcgagatcagtgttatcaggtgaaaggtgcggaagtgattcattcactggaagaagggctccaattagcaaagcaggaggagctaatggtcattggaggagcagaaatttatgcactgttttggccacatgccgatcggttgattgtgactcggattgaggagacttttgaaggcgatacaacgttccccgagctggattggaacggttggaatatagttagtgagactccgggtatcaaggatgacagaaatccatatgagtaccgttttgttgtttacgagaaaacggaataagaatggactgtatccgaccccactcatttgaaaaattaataaaccatataaaaaatccttttggtgttgatgcaaaaagttgcataagttttcattacttttacgctgtattgtgatacaataaatcaaattcaacgagaacagaccctttcataatacaagcagacaaattcgaatttgacttaaattctgaatggatgatcggggttcataagcgaagagatgggggaacgtaacatgtctacaccaactggatttatggaatacacacgacagcttcctacagaccgggacccggcagagcgtataaaggattgggaagaattccataagcatatgtctgaagaagagctgcgtacccaaggggcgcgttgtatggactgcggaactccttattgtcatacggggatggatatcatgggagcaactttaggctgcccggttcataatctcattccggaatggaataatctcgtataccgtggtttgtggaaggaagcgctagagcggctgcacaaaacaaataacttcccggaatttacaggtcgtgtctgtcctgcgccatgtgaaggttcgtgtacagtcggcctgatcggacagtctgttacaattaaaaccattgaggaagctattatcgaaaagggttttgaggaaggctgggttgtccctaatccgccagaaaagcgtacaggcaaacgagtggctgttgtcggttcgggtccggcaggtttggctgcagctgcacagcttaacaaagcagggcacagcgtgactgtgtatgagcgtgcagatcgtgtgggtggattattgatgtatggcataccgtccatgaaattggataaaaaggttgttcagcggcgtgtggatttgctggaggcagaaggtattcaattcatcacaaatacggaaatcggcaaagatatccctaccgatcagttaattgctgaatatgatgctgttgtcctatgcggtggttctacgaagccaagagaattcaacattgaaggtagcgatttgaagggtgttcattatgcgatggattatctgaatggtactatcaaaagttacttggactccaatctggaagatggcaactatttgtcttcccaaggtaaggacgttattgtaatcggtggcggtgatacgggttcggattgtgtagctacttctttgcgtcatggatgtcggagtgtcactcaatttggcacacacaccaaagcgcctatggagcgtgacccgattgccaatccttggccacaatttccaaacgtgtattctctcgattatgcacaggaagaagctaaggcgttgttcggagaagatccacgtgagttctccatcatgacgaccaaatttgtaggtgatgagaacggtaatctgaaagagctacacaccattcaaattcaacggattgttgatgaaactgggcgcaaaatctatcaaccgattccaggtacggagcgcgtattccctgcacaaatcgctcttattgccattggatttgatggtcctgagcaaacgattgtagagcaaattggtttggagacggaccgtcgttccaacgttaaagcacgttatggaaaatatgttactaatgtggataaggtttttgctgcaggtgatatgcgtcgcggacaaagtcttgtcgtgtgggctattaatgaaggtcgagaagctgcacgagaagttgataaatacctcatgggcgctaccgttttggtgtaattataaatttcatgttacggatcagtcaaagctccatcttcggatggggctttattgtatttcaagctgagtctgccagaagcgaaaaatgaataaatgattattgagctgtgaaacattgtgaaatatatgttatataatataacttaaattcaatcgtatcaccatatatttcttatctaaattgatcataacataaaaatgggtgtttagtgtagatttttttatagaaaaaaggattattccacaagaaaattagataaaagctgatttttatgttatataaattaacatatacataactttcgttgactgtataaaatcatgacctgagagaaccatggtatctatggtataatacacgtatattgttgaagcgtttgactaaatgaatttacaaaggagctttcgtcgggagaaggctccttttgcatgaggccgggatacctgtgttttcattatcattccatgtatatgtatgattcatggaggagaaacagaaggccgtcaggaaggaatggagtatgaatgaagacgttgattattgctgagaaaccagatatgggacggacgattgccgccgttatggagccgcgggcaaaaaataaccgtacctatttggaaggggagaaatacattgtaacctgggcgatcggacatttgctgggtttggctgagccggatgcatacgatactaagtacaaacgatggaatattaaggatcttcctattatccctgagcagttcaaaattgtaccgaatccgaaaacaaaggatcagctgaaaataattggtgaactggctaaacgctgcaacgccatcgtaaatgcttgtgatgctggacgggaagggcaatatatttttgcgttgattcaacagcaattgaagttgcatcagccagttaagcgactgtggatttcagatttgacagcggagagtattgcgacaggctttgaacgattgcgagatgcttcagagtttgaatttctgactcaagctgcaagggcacgaagtgaagcggattggctgatcggaatgaatgcttccagagcgttcacaacacgacataatacactgctgtcagtagggcgggtgcagactcccgtgctggcattgattcatgaccgggaaaaggaaattgaggcatttcagtctcaaaccttctatgatgtgtgggctgaattcaagcaagatcagatcaagtacaaaggtgcgtggcagggggatcggctgacgaagccggaggaggctgaggcgatcgctgcggccgttcgcggaaaaacgggtaaaatcaccaaatatgacacaaagcagacaaaagagtatccttttaaattgtacgatttaacgttgcttcaacgcgaggcgaatgccaagtacggttattcggccaaaaaaacactagatgtggcacaagcgctttatgagcgtcacaaggtcatttcttatccgcgtaccaattctaactatgtgacagagcaaaatatagacggcatgcacaaggcgctacggatgctggggacaggtccttatgctgatctggtacaacaagccaaccccaacttggtccataaacagaataaatcggtctgcaatccagctcgtgttgaggatcaccatgctattctgccaacgttaaaaagaccaggtacgctaagcaaggaggagcaaaatgtatatgacctggttattcgcaggtttttgtcacatttttttccgcctgctgaatataaaatgcataccgtaatgacgcaggtggacaagcatctgtttaaaacaaatatcaaagagcttctttccttgggatggaaagtggttttaagtaaggttgaccaggataaaggtaaaaagagcaaatcatcgaaaaaagaggatgaagaggaaacggacgagtggacggacaagaagtttgagattgatacgggacgtccggtggagtgtgttcgtgctgagatgaaagaaaaggcaactcagccccccaaaagctacacggagggtacattgcttaaggcgatggaaagcgcaggcaaacagatggagaatgaggaattacgtgaggtcatgaaggatgccggcttaggcacacctgccacacgggctgccacaattgaacgattgaaaaaggttggctatattgaaatgaagggcaaaaagattcttattacggaaaagggaaagatggctattgatctgatccgtcatgccggggttgatctattagcctcgccggagatgacaggtcaatgggaacgtcgtctacatcaaatttccaagggtgaggcggctcaggagaaatttatggataacgttaaaagatttacgttgtccatcattgacaaggtgaggcagcagccaccagctccggcagatgcctttggcgaggaagcaagggggaagcgtgcggctggaaaagaaggcgcacgtagcgcacgtgcgagtggacgcaccgtcgccaagggggtggggcgtgctacatcaggacgcggtggtaacgctggaagcgcaacgctggagcaagcagcaccaccagcaagtcgtgctgcgggaacagcaggttccgttgcacgcagctcttccgacggaccctcaggcatttcagtgagccaaaggcaagctttgggtagctgcccatgctctaattgtggcggaagcattattgaagggcgtaaagggtatgggtgcagccactacaagcagggctgtggttttgtcgtctggaaggaatatgctggcaagcagattaccgaaacgatgctcaagtctctgttgacaaagggacagacgcaattgttgtcttttaagcgtaaagatggatcgaccgtcaaagcgcgaattattctgaatgaaccaggtacaggacaacttagcgttcgagaggaatcctgagacagggtttagacaactattttggctgaatcaaaggtttaataacaattacatcaacaaaaaannttttttgttgatgtaattgtatgctttcgtggataacccgtggtacttccgtcagcttctgtatcgtatacatcacggagttcacgtttttttgcaattcaaccatattgtaaatccattccttaggctgcttgagatagacagcatgaatacctgcggcaagggctggagatacatcagtgcgcagagagttcccgatcatccaggtgatgcttcggtccaagcgattcatctggatgatttcttccagtgcttcaacatttttatgctgacgaatgtagatgcggtcatcaaagtaggtagccagtttcatttgttcaatctttctttcttgaatgatctgctcaccaccagtataaaggtgaagggaatgccctgctttttggagggagttcagcgtttcgaccatgcctggatacggttcgatttcctgttcgtatacacttcggccaagagagcgaagctcctgctcttcccgtgaatcgagacggcgtccgaattgttccgagaaaaattggtacgtatctatcagagattgtgggaaatgctcgctggcaaagcccacctgatgaactccagccacatcaatttcgatttgtttttcacgaatcgtatttttcgttaggttatgagttgcaaaccattcctgaagcaaatcgaaaaagtggttgaggataaggtcaaaatacttgttgcagtggactaaggtgtcatcaagatcaaataaaatgtgctgcttcagatacgacatgatgcatactccttccaagccaaagctttaacgctgctttggttataactaaaagtacaattcaaattacaatccaatataggattccaaaaatacctgtaaatcagccgcgccatcgggacggatgctgaatttttccttatgataacgtccgatgtgaatacggagcagaccagccactcgtaaaatcatcatatcagacatgagtgtatcttccaaacggctcaaatcgtggcgcatgtcttcgagagacttaggaccttgagctacataacgtagaattcgcagtcgctgcggatcattgaccgcacgagttagccgtagcagaagcgtaggcggttcttcctcgctctcctcggggatatctaccggatactggatcagaagtgtgcgggtataaaaacagtatgaattaatcgggcgattatggacaaccggaaataggactactgtatccaggtcttccacgtgtggcacgactagtccagctgtcgcatattcaaccagtgcttccggttccatcttactcagcagcatgcgtttttccgcagcgtcttcttctgccaacacacgtagttcgccttccaaggcccgaaaataatcacgatcccacaatctgaggagtggtgcgtataccttgcgaatgcgtaaagattcttcaaaggttaaaaaagggatatgcggaacgagcaactcaaacatatctttatccggaccgtggtccaaataagagatataatcagatatttcatccgattccggtcgaagtaacgcccaggcatagagtgcgtcataatcgctaaaagggcaatcctgagctgtagcaagctcagtacgaacttcatgttgtagtcgtgcatctaccttgtcgatccattcatggcccaagtccatatcttggacccactttttagtcacataggccatgaagctgccgagcaattcataaattggagaagtgtctattttaatttgataactcatggaactaatgcctcctattctgtcttctagcccagagcggtgaacgtaattaagcccgtccataagcaaaacatgagcattttaataattgctcacttatttattatggcttgttctgccagggattgtccactataatatgaaatagtgcgttgtgacgtgaatgggttcggattgaacatacgaggctccttaaccgaaggagtcggatacataccagacaagctctttccgtaaaatcgtcatctcagatggcgatttttttcttctattctttaatacactaattacacctgaatttgtatatgtgatttgccggttttgcaggacggcatgaaatacatagtgataagaattattattgattatggaatcaaatgcaaatcatttcttaacattgattttaattattttatttgttcgatcaggaggagctaggatgtcgtcgtcgttacgagttcattattttattttaattgctgttattattgttgccggattatgccaaggtttattattacctattctgtctatctcgttggaacaaatgggagtttcatcttcactaaacggaatgaatgcggctgccctgtatattggttcattcgcaatgacgttggtggcagaacggacattggggtggttagggttcaaaaagctgatggccggagggcttgtgctagtgctcgttacgctgctgctattcccgctaatccctgatattcgggtatggtgcatactgcgtctgctagtaggtattggtgacagtgcattgcactactctgcgcagctatggatattgctggtgactccagcagagaagcgaggccgcaacatttccttttatggtatgtcatacggtctgggttttgcattaggaccattgggattatggctactcgattatggaatgctggttccattcgctgcgttggccttattatgtttgcttgttttgttattggtgttaataaagctgccggactccagaccggagaagctggagtccgaggcgcgtcccactcaaagatttcgtcgcagctacagctgggcatggtacgctcttttacctgcatttctatacggctatatggaagcgagcctgaacagtaactttccagtctatggcctgcgtattggctttcataccgatgaaatcgctgccttgctgccgttcgtcagtttgggagggttagtgctgcagctaccgctagggatattgagtgaccgttggggacgtaaaaaggtgctaatgagcgtaggtatagcagggggaatgacctttatgttgctaccttggagcggcaatcattttatgttcactttgatattgctgaccctagcaggtggtttagtaggctcctttttctccctcggtttggcctacgccgctgatctgttgcccaaatcatttttagcagccgcgaatgtactggcatcctttcattttaatctgggaagtgtgatcggacctaatattagcggagggttgctggactttggaactcaaggcagtatgtttcttgtccttggaggtagttacgttgttttcggattgttaggtttgttttccagaaaaagagtaacggcggtttaaaactgcggtttgcatggtatttgtttcacatttactataaaatataaacagtattgatggcgcgcaaaggggaatcacttagatgattaaaattcggaagctgaccaagcaagtggggcctgaacggacccagctacttcgaggaattgatgctgaaattcatcagggcgaatttattgccatagtggggccaagtggaagcggcaaaacaacgttgcttcgctgtcttgctttacaagagccatgggatgaaggcagtttaattgtaggtggcaatgatgtgctgaaatccgggtggacgggcaagaagaaaataaagcgggaatgggcatacctggagcaaaacccgcatctaaatatgaatcgaaccgctcttaaaaatgtgctcattggcagatccgttcaaactccgatgtggagaatggtgacggggatggtgcgttccgacgattatatgggagcgatggacgtactggaggatctgggtctgctggataaggcgcatgataaatgtgacaagctcagcggtggcgagcggcagcgggtagcgactgcgcgtgctctcgtgcacggagctaaagttattttagctgatgagcctgtaaatggacttgatccaacttcggcagcgcatgtattggagacctttcgcaagctgtgttctgacgagcgggtgacgatcatgactgtattgccgctggaaatggctgaacgctttgcttcccgtatatgggggttgaatgatggtgaattggtgtttgatattcagggaagacgattgacacaagcagaaaagaacaaattgtgaaggggacggcaagagaagtgaatataatgctgttgagaatggtggctggctgctgttccttgctgctccttgctggatttttaagcggctgtaatgttattagcgatcccatttcgctgatggagacaccgacgatgtctgacgagaaacagcagttgaatggtgcagtgaatacgcaactaggggcggtacagcctttaaggccgaatgacccagatgacccgacgccaattcggacgggtgatctgaacaatgatggcacagacgaagcagtgctcttttatgaaacgccagatgagagcgtaaaaatacatggtgccttgtttgaagatcagggcggaacatgggtaaagaagctgacgtttgatggggaaggcactgtgctggagtcatttaagctcgtggatttaacgaatgatggaacactcgatattgtagcgggtttttccagcggagatagtggcgatggcggggatcagaagggactcatcgtgtattcctataccggaggaacgctggagaaaatatatgctacaggttatacagacttcgtcgtagatgattttaaccataacaagatggacttgaacggggataatttgaatgatttgacgattatcacgctgcgacgtaatgaattctttactgttaaaacgtttcaattcagtgggggaacctttaaggaaatcggatcgttggatttggacagtcaggtcttaggtgtctataatgtcgttgctggcaaggtagccgagggtaggcaggggattattatagacaccaaaattgcccagaccactaccgtgtccaatgttattgtgatggatcacggcaagctcaggaagcttaatcttatggatgtcaccttcaaggatgcgaccatcgccagtggtgatgtggatggtgacggcattctggaatttggtaatttggagaagcctaaaggttggagtaacaagccgctggacgaggttccatattttgtgtcgttctatcagtgggacggggcgaaaggaacgatttttaagcagcagcagtatcgtgattctaatgaacaggtctacttcagattaccgaaagagctgcatggcaaggtgactattgatccgaaagtttcgaagaaggacagctatttgcgcttcattttggatgatacagacaaaacgatagcggaaattaaatttttctcgttgtcacaatgggagcgaaacaacgaaggttatagccaactgtggagaacgaatgcgcaggtcattggcattaagcgatccagtgagctggaaccgcgtaaaaccattaaaaacaagatgggggaaaggcaggtagagtagagtgagtaaagttttaatcatggaagacgaggaatccattcgcagctttatcgtcattaacttgaagcgtaacggttttgaggtgttggaggcgtcggaagggcatgaggctctgaatattttgaacacggtgcgggatattgatattgcactgctcgacgtaatggtacccggtatggatggttttgaggtctgtcggagaatccgggaaacgaatgagcgcatcggcattatttttctcacagcgaaagtacaggagcaggataaggtgtatgccttgtctgtaggggccgatgatcatgtgagcaagccttttagcccgacggagctgattgcacgtattcaatcgttattgcgtcgggtgaatgtacatcgtgaaacagcagccaaagtatccttccaatccggaccgttcacgctagatttgattgctaagcaatttaagaagagcgggcagctgatcgagttgacaccgactgagttttccctgattcaattttttctcgaaaaagaaaacacgccgctcagccgagatgttctacttgaccacgtatggggcaaggaatatatgggcgatccgaaaattgtggatgtgaacatccgacgtctgcggcagaaaattgaaaacaatccatccgagccagcttttttacaaacagtctggggacatggatataaatggaaaggtcagtctcaatgatcaaaaaggggattcgccgacagattgtgcttcactattttttcgtagtgttcttggcgcttctgttagtagaagtcatttttatgtttgcactccggtcgtactattatgactccatttacaaacatgtcgaaagccgtatcgaatcggtaagtgaatttgcacccaaattcaaagagccggaacagtctttgcaatcgtatttgttaaatacattttctctacccttcactgaactgcaattgctcgatgaacagggaaatgtaattgataactcgacgaattttgcagcagatctaagtgtgcaaacaagtgatgttacacaagcattagctggagatacgggcaaatggatcggaaagcaaccgagtacggggcagcaggtgatggcggtatctcaaaaacttgacaatatcgtcggagaccaggtgtatgttattcggtatacgacttcgctggaattggtaaatgataagctgtttacgattacgctgttttctcttggcatcatggcagctgtactggttattgtatttgtagtcagcacagggctcgcgaattccattgttagaccgattaataatatccgcgatgtatctgctcagatggctcaggggaggtttgatgcacgcattgaaggcgattatcgttatgagttgggtgaactggcttcgactctgaactatatggcacaggaaattgtcagaacaaatcaaatcaaggatgattttatttcatccatatctcatgaattacgtactccacttacatctattaagggttggagtgaaacgttaaattctggcggatatgacccggaagagacgaaaatcgggatgaagattatttctaaggagaccgatcggctgattggcttggtagaggaaattctcgatttttccaagctggagcaaaatgccatgaagcttgtgatgggaacggtggatctacgggagcttttacaggaaattatgctgaacgtatgggccaaagcagaaatgaagcagataaaacttcagctggattcggaggaaacggcatatctcgtccatggagacggtaaccgtctaaaacaggtgtttttgaacattgtggataatgctatcaagttttcgcatgaaagttcgattatttttctgtctctacaacggattgatggcaatatcgagatatccgtacaagacacagggattggaattagtgctgaaaaccttgccagagtcagagatcgctttttccaggtagaccaccaaaatggtggtactggactgggattggcaatctcgcaacagtttatcgagcgccatcatggtcagatgctcatcagaagtgaactgggggctggaacaaccattacggtttcattacctgctctgcaagcagagcaatccgtggaaccatcacaacttactgaaggacagatttaaagcctacttataggtgtaattagaaaaacagccagtcctctcaaatcgggagggctggctgtttttaatttggggtaacgttatgaagtaaaaccttcggcacgcaagcgtgtattgcgctcgtaagcttctttcagcatacgtgtagtttgcggtcgtaccgccattttaccaaataccgtttcattgggtccgatgaccataatttcgcccggtttacctttaatgacagcaccatcgcgaatcacagcaccttcaccaataatcgcatgttcaatatggacgttacgtccaatgcgtgtgtcaggcataacgatactttctttaatggctgaacctttacctacctcgacaccactaaatacaacggagcgttctattcgaccctctacttggcaggaatcatgcaacaagctgcccaatggttgtgtttgacggttaggtaccttttgtgcgctcaaccttgtgcggcgttcacgtgtatacatcggccagtccttgcgttgaaggtcgatcgcacaatcttcgtgtaacaaatccatgtgtgaatcccataggcttttaacggtacctacgtccttccagtagccctggaattcataaacgtacaaggattcttggtccgccaacattttaggtatgatatctttaccaaaatcatgactggattgagcatcctgtgcgtcttctaacaggtaatttctcaagtaatcccatttgaaaaggtaaatccccatggaggccaaattactttccggtttctccggcttctctgcaaattctgtgacacgcagatcttcatcggcactcataacaccaaaacggtgtgcttcatcccaaggtacctccatgacagaaatggtagccgcagctcctttttccttatggtagttcagcatttcacgataattcatatagtagatatgatcaccggataaaataagcacatgctccggattttggctgtcaatatattcgatattcttatgaatagcatctgccgttcctaagtattcagcgttacctgtgttataagatggaagcagggtaattcccttgtcatctgtttttgtaagaccccatggtgttccatccccgatatgttcgtgcaaggattctgcctcatattgcgtcaagacacctacagtatcaatgtctgaatttacgcagttactgagaggaaaatcgatgatccggtaatgaccgccaaaaggtacggcgggttttgcaatcgttgaagtaaggggagcaagacggcgtccctctccgcctgccagcagcatggcaatgcattctttattaaacatttcgtttccctcccggtttagttgtcagtgtagtacatacataaacggtatggggtactcttgaaaccataaggtatataagattccccaaaactaaggtttatttttttcctagtcatttttctgttcaatgtggctagaatggggtaataactcaagtcagctttgacccaaaagcgaatgcattaccgattcatacatttttacttacaaaacatataagggtggtgacgtgatgacagaccaaactcttccgcaacaggctatttcatcggaagatatttatttgtttcatgaaggaacgctttatcacagctaccgatctttgggttcccaccttactgtggagaacggagaacagggcgtccgctttacggtctgggctcctcatgctctccatgtcgggcttgctacagatcgcaacaactggaatggggaacaggattccttatatagggttcccaaatccggtttttggagtcgtttttttccggggatatcccaaggaactttttacaaatacgacattacgggtgcaaacggtgaacgatttctgaaagcagacccttacgcggtacgtgctgaagtgaggccagcaacggcttctgtggtagcttctatagatggttatgcttggaacgatgcgatttggcgccgaaaacgtagagcaccttatggaaagcctctgcacatatacgagcttcatctgggcacttggaagcaaaaagaagatggtacgttttatacatacagggaaatagctgagcttctagtgccttatgtgaccgatatggggtatacacatattgagctgatgccgctgagtgaacatccgtatgatctttcctggggctaccagcttaccggatattttgcactcacaagccgttatggagagccgcatgattttatgtatttggtggatcgttgccatcaggcgggaatcggagtgctgatggattgggtgccagcccattttgcaaaagatgctcatggattaaggctgtttgacggatcgcccctgttcgaatacgcggatccgctgattgcggaaaagcccggctggggaacgctgacgtttgattacagcaagccggaggtgcgttctttcctgatatctaatgcgctattctggatggatgtataccatattgacggcctgcgcgtagatgctgtgacaagtatgctacggctggattttgaaaagcaggacggtcaatatcgttttaactctaaaggaggcattgaaaatgaggaggctattgccttccttcaacaactgaatgaaacagtattccgctattatccgtatgctctgatgatggcagaggagtccagtgcctggccgatggtgacttccccggtaagcgatggaggactcggttttaattacaagtggaatatgggctggatgaacgatacgcttgattatatcgaaacggatttcgatcaaaggccagagcgccataatttgctgacattccccatagcttatgcgtacagcgagaattttacactgccgttgtcgcacgatgaggttgttcatggtaagaagtcgctgcttgataaaatgccaggtagctatgagcaaaaatttgccgggcttcgagcgcttctcggttaccaaatcacctcaccgggcaaaaagctcttatttatgggaggggaattcggccaattcatcgaatggaaggatgaagagcagcttgactggtttctgctggattatgacagtcaccgttcgctgcacgcttatacgaaagcgctgaatcatttgtatattgaggaaaaggcgttatgggaactggatcattcgtgggatggctatcagtggattgaagcggaggaccgtgggcagagcgtaattacgtatttacgtaaaggtaaaaagccgggagatacactggtcgtgctaattaactttcagcccgtgcccagagagaactatcgaattgggctggaaaaggccgggagttatatcgaactgctgaacagtgatcataaggactttgggggaaatggccagctaaataccggagtgatacggaccgcctccattccttgccacggacagcttcacagcttggaggtgaccataccacccttaagcatcgttgtactcaagaaagcgcctcggaggcctaaaaaagcagattaaacacataaggaggaagcacatatgaacattttgtttgcggcagcagaagcacatccatttattaaaacaggcgggttggctgatgtcattggcgcactgccgaaggcacttcgtcaggcggggtgcgacgtccgaatcattttacctaaatatgcggggattcccgatacttataaaaagtctctgcgtccggtagcggtgaagcaagtagccgtaggctggcgtaatcaatattgtggaatagaggaactgacattagacggaatcaaggtttattttatagacaatgagtattacttcggtcgtgacggtatttacggttatatggatgatggcgaacgtttttccttttttaaccgggcgattttagaaatgctgcctgaactgaactttcggccggatattttgcattgtcatgattggcatacggcaatggttccgctgcttctgaatgccgattatcgacatttgcccttctacagcgatattcgcacggtgtttacgatacataatctgctgtatcaaggggattttccgtatgaggtcttaactgagctgctcaacctggatggaagctatttcacccccgagggtgtggagtatcatggcagactgaattttatgaaaggtgggcttacgtactcggatcatgtcacgaccgtgagtccaacctatgcagaggagattcaaaccgaattttacggatacgggctggagggtctgcttcgtaaattgggagatcagggtcgcttaacagggattgtgaacggaattgacaccaaaagctacaatcctgccacggacaatcgtatttatacgaagtaccgcacgagtctgacaaagaaaaaggaaaacaaaattggcctgcaaaaagagttgggtctgccggtgcgaccagacgtacctatgattgccatggtaacccggcttgtagatatgaaggggctagatctggtaacgagagtgcttgacgaaatcctgtattatgatgatatccagtttgtcgtgctgggaacaggggatccggcttttgagcattggtttcgtgaggcagcgggacgctatccactgaaaatgtcggcgcagctcgcttttagcgaacctctgtcacgaaaaatatatgcggcaagtgatatgtatcttatgccatcaaggtttgagccttgcgggatcagccaactgctggcgcttcgttatggaagtatccctattgtgcgagaaacagggggtcttaacgatactgtgcaggcttacaatgagtccacaggggaaggaaacggatttagtttcacgaactacaatgcacatgatatgctgaacactattcgtcgtgctgttcatttttatcgccaatctgagcattggtcgaaacttacacagacggcttttgcaggagaatatagttgggatgtttcagctaaagcgtatatggatatttaccatttgctaaaaaagacggactgaacagagtaggaacaccatagtcatgttaatgaaaaagggaatccctttagccagtttttggctgaggaattccctttttgctatgatcagtcgcccccgccaccacagctgctcccacatgaagagccgctgctacacgaagaatgactaccagaatcgcctgaatcatggtgagaagagcctccatgatgagaactgtcatgggaggaatgatggtgcgagtgatgtgtatcccagttcgagcaaccgcttgccgagctacagccggatgagctagctaatacggcattacctgtagcatccgggtgcatgtgtatggcaaattgttcaggttgataccatgaataccacacaacagctaataataaatagtcgacctgtaaatagttgaccttaggcaattgcttcccctcaggatcatccaccgctttattcacccgctcgcgcagacgttgtacaatcttatgaaccgcttgttgggcctgatgtgaaatggctgtattctcctgtgtattccagcggtcacctgctggctgcgccgaagttgcgagtttataatagcgcgaaagctcgtcgttcggtaatggatgattaaaaaaagtaccccacaaactggcgctatagcggttccagccaaagcattccacatacaaccagtcaaaccacgcccgctcctcaggcatcggcttagagccgccggaatggggcgcatggtgaagcatacgaccaaaaaaagcttccgagaattgctgatattcgcgggtaaacatcaacatttcgtgccataattcatccacatcactactgaacataggcactctattcataatcgcgcatagcataaaatatcgttttagctcatgccagcgccaatcatattcttggtccgtcagctctgggtgggcttccattacacgacgccttacgctttgagcataggaggcgggaatggattgctccaatagctgcatcagctccgtaatctctaaatgacgctcctgcgcaatggacgaaggagacggggagctgaggaaaaaagcattccggcgccgtgcttttctgtttccccggttcctgtgtattgcacggaatataaaccaaacaatgatgaggtcaaccacaataaacaacgtccaaaagctattcatactattcatgatggctgctcctttcagaaagaagacggaattaagattttagctttcgttaatcagcagagcgaattctttttttatctgggctagcagtctaggattcgtgattacatcgcaagcagtccatgccaaggttctcgcagccagcagcattccttccatggcccggtcctgcatcgccaaatcgcggaattcaggtgtatgcaaggcatgcttctcgtcaataacttgaatgtacggatggatagcagggcaatgaagcgatacatttccgatatccatggagccgtgatcttcaccttccgttatatcttcttgcgaaatgccagcctgcaccaaatttgcggtaaaggcatcggaaagtacgcggtttgtgaccatttcatcataagatgtctcataattggaggtctccaaacgacatccggcctgtaaagcagctccttcagcaatttgaataacacggcgagtcagcgggttcagttcttgacgtgtagcggccctcacataaaattgggcagaagcataatcaggaataatattggctgcttgcccaccctgattaatgatcccatggatacgcactgtactttttacttgttgacggaacgcattgatgccattgaacgtttgaatcacagcgtccagcgcgttaatgccctcgtgcggactggcagccgcgtgggcggattgaccaaaaaattcgaattgtacagcatcaatcgccagtgatttgcctgatttttcgtaatggtcataaggatgcgtcataagtgctatgtcgcaatcatcaaacaacccggcagcggccatcgggacctttgcaccgcgtgtttcttcggcaggtgtgccatatacccgtacttctccaccagtttcgtcgatgatcgacttgaggccgacggcagcacctgtactcatcatacatatcaaatggtgcccacaggcgtgtcctagacctttcagagcgtcatattctgccagaaaagcgacaaccggtccgggttttgcagatttgtaagttgcaataaaggctgtttctatgcccaatacgggtgtctggatctcaaaaccgtgaaaaaccagttcttcttttaaacgggcagcggccagaaattcctcgtttccaagttcaggatttgcgccaatatataacgaaatgtccttaaaccgtggggaatgctgctcaattgtcttttgaatggtctgcttaaaatccatgctgaaaactcctttatataaactgtaatgtaggtactgcgttaggtatgctgaaattgtactataacattcattgcataatcatgcatattcatttataatgacacaatcttatttattataaagaatttaaggagagaaaaaaagattgaaaaaggcatatcgttttaccgccctggttttgtcggcggttatcttgctgttgactggtcttcccatgctcactgcatacggaacggaagcaaagccacagaaaaaacttgtagtgggcatgagtgccgactttccgccgtatgagtttcataaagtcattaacggtaaggataccattgttgggttcgatgtggatatcgccaaggaaatcgccaaagatttggatgcggagatggtccctgaggacatgagttttgactctttgctgcctgctttgcaaagtggtcgtgtagacttggtactgtccggtatgacaccgacggatgagcggagaaagagcattgatttttcagatgtatattatcgctccaagcaagtcattatggtacgtccagaggataaagacaaatatcctacgatggatgctttgaaaggcgagaagattggcgcgcaaaaagggagtattcaggaagaaattgctcaaaaagtgcccaatgccactgtaacctcactggacaaaatatccgatctggtactccagctgcggacccagcgtatcaacgctgttgtgatcgaagatacggttgctaaaggatacacgttagatggtaccgtaacacttgccaaggccgtgcctgaggatgccggagcagaaacagctgtaggtttacgcaaggggaacgcagaattgcttgcctctgtaaataaaacgttggctcgcctgaaagcggacgggtcgattgagaagttttccacagaagcgagcgcgctctctgcagatcgacaggtttcttctaataacatcgtagatattttttggaaataccgcagtttttacgctacgggtatcggctacactctgttgctgtctgcactcggagtcctgtttggatttatcattggtctgatcgtatccttgctgcggatgagcggtatacgcatcattgagtggttaggtaccacttatgtggaaatcctgcgtggcacacctatgctggtgcaactcatgatcattcactacggggttgctttgacgctgggtgtcaattttaccccactccagtctggtataatcacattgtctctgaatagttcagcatatctggctgaaattttccgtgcaggtatccaggcagtagaccgtggacagatggaggctgcccgttcgttgggtatgggacgcggtaaagctatgcgtcatgtcattttgccgcaagcgtttaaatctattttgcctgctatcggtaatgagtttattacgatcattaaagaatcatccattatttcgaccattgggatggtggatattatgtatcaggcccaggtcattaagaacatcacctacgaaggactaagtccgttcgtaatcgcagccgctatttattttgtaatgacattcagcttgtctaagctgctgggtttatgggaaaggaagttgagagccagtgatcaccgttaaacaactgcgtaaatcgttcggtaagaatgaaattttaaaaggcattgatatagatatcgccaaaggtgaagtcgtcgtcatcatcggccccagtggttcggggaagagtacgtttttgcgttgtatgaatctgttggaacagcctacggacggggagattttatttgagggcgagccgattacagctcgtggccataatattaatgtaacccgggagaagatggggatggtgttccagcattttaatctgttcccgcataaaacagtgttgcagaacctgacacttgccccaacacaggttagaagacagtcagggaaggaagcggaaaaaatttcgctagaacttctgcgtaccgtagggcttgaggataagaagaatacctatccgaaccagctatccggaggacagaagcaacgtattgcgattgcgcgtgctttggccatgcagccgcacgtaatgctgttcgatgagccgacttctgcattggaccctgaaatggttggagaggttctggatgtaatgaagaagctcgccgaaggcggcatgacaatggtaatcgtgacgcatgaaatgggctttgcccgcgaggtaggcgatcgaattatctttatggataacggtcaaattgtggagcaaggtacaccagagcaggtatttggcactccaagccatgatcgcacccgtgattttcttgccaaagtattgtaagaaagtgctgatataatctataaaaaaaggccctccgtttgacggagagccttttttctttttgtcaccatttccccatactttcgtaacaaatatcgatttcttgatgacaaaattgtaatgagtgtagtatgatgttcgaggttcccaacattttcatgcggataaggttacaaaattgtgatattatgcagtaagccaaaacttaccgggacagcatgtggttatgacaaccgctgaaactgggcccaaactatgggaagtgcgggggacgtaacaacggcagtcattccgatacgtcataagacgatgtggaatatgcctaggggtgaattgcacaagcatagggcttctcctgagtccgaatccgacagctaacttcgcaggcataacagaggaggtacatatctttgaaacatctaaaacatattggtaaaacgatgaaatttgcggtgcttgccgtagctattgcagggctggcacagacagctggagtagcggatgctgcttcgcttcacactgccaaagagggcgataccttctttttgcttgctcaacgttatggagtatcggtagacgggctaacgaaggcgaacccaaacattgcctccaacaatatatatgcaggtctgcaaattaaggtgcctggcgaaaaaagtgtgaaggcagcttcggattcgaagccgcagcttcttacggagaaagcatcagcgaatgaggggccaacgattgaagcatggggcaaaacattcaactatagcaaaatagttgacgttaaggcttctgcgtattctgccgcagccgatgagaatggtaaatggggagcagtggactactacggcaatccgcttaaactaggtacaattgcggtagacccgaacgtcattccgatgggcacgaaagtgctggttacaggctattcccacccaggtttgccggatcattcttttgtagctgtcgctcgcgatcagggcagcgccattacaggaaagcggattgatatctttattccaggcaacaaatcatttgtgaacgactttggatttcaaaatgtgaagctgtacgttattgataaatagcattgtacgtatatacgatttaattaaacataatatatattatgtaaacttaatgcctgtatcctaccgcatataactaggtcggactcttatcaggtcttatccataaaaaaaggctgtcttgacgagcagaaaacttctgctggtaagacagcctttttacgttgctttagcttgtagctcaatcataaacatatggttatttccgttccgatgtgtggagtagccgggggactgtcacaaatttgtagcccttagcttttagagagtgaattagacccggcagagcttggacagtgccttgcaagttggaactttgacctccacctgcgtgcattaaaataatagagccaggcccggtagctgggatcacattgcgttgaatttgtgttttacttaatcccttccaatcgagagagtctacattccaattgacaatcatatagccatgacgacgtgcccattggatttgaggctccgtgatttcaccgtagggtggacggatcaacttggggcgaaaacctgcgctggcctgtaaaatacgttctgtttttgtaatctggttgcgaaagcgttcgggtgtggccttcctaaaatccggatgagtataggaatggtttcctatagcatggccttcacgaataatacggcgtatgatccccggatgcttttccgcacggtgaccgacgatgaaaaaggtggctttgatgccattggcgtgtaatacgtccaaaacctgcggcgtatacctagaatcgggcacatcatcaaaggttagggcaatttggcgggtgtgtgggccgcacattttaaaaatgtccgcatgtttttttcgcagcattgctaatgtaggagttgctcgatctgtgctctgatgtacagaagaagcaacagctgtttccttgggatggggcgttccggtgttgggaggcgcatccgcgtgaacgggtaaacttgagaatgctagtaacagtgccaagcatggcaacactcccctgtacggcatatgtatcccccctttccgtgcagtggtacctagtggtgctctcgactattatgtacctgtcctattaaaaatatgctgttaaccaagttcggctcataaacgaatggaaagaagcccacgatgaaacgattatcaatgaagatgatggagctaaacgtacatattctcttaaacatgaccgataacaggagcattttcgcaagttttagccttacaacgaattcggtatactagtgacagctggtgtataatggggatgcaattcataattatacagacatggaattgaaggaaggatggataaaagtgaccgacttgtttactccttatcaattaaaggggctttctttaaaaaatcggattgtcatgcccccgatgtgccaatacagcgtggaggccaaggacggaaatccaacggattggcatcatgtccattatgtgagccgggcagtaggaggcactggacttattattgtggaaatgacagcggtccatccagatggacgtattacggatcgtgatttgggtatttggagtgacgaacatatttctgcatatcgtaagattgtagaggaagtccacaagtatggtgccaagattggtattcaactaggccacgctggacgcaaggctgaagatgctgagcaacctgtgggtccgtccacgattccttttagcgaacgctttaaaaagccgcacgccttaaagacagttgaagtcagggaactggttcaggcatacaaagaaggcgcacgccgcgcgatggaagccggttttgatacggttgagatacatggcgctcacggctatctgatccatcaatttcattcgcctttaacaaataccagagaagatgaatatggacaggatttgtcactgttcggtgttgaggtcatacatgctgttaaagaggttcttcctgctgacatgcctgtgcttatgcggatatctgccaaagaatacgtcgaagatggatataacgtggaatacataacaggcgtaggggaacgatatcgtgatgcaggtgtggatattttccatatctcttctggtggtgagggtccgattggttctggcggaggcccgtctgcgcgtgccggctatcaggtggatttggctcataccatccgtgaaaagctgaatgtacctgtgattgctgttggcttactggatgattatgaggacgcccgccgggttgttcagcaaaaagaagctgatctggtagcaataggccgtgccatgctgcgtgatccctattgggcgctgcatgcatcgcgggagctaaaagtacaggccgacatcccagagccttacttgcgcggtttttagatatttttgaaaccctctttgcaaagcttgcgtaaacatgtgtacagagcttaaaatttaagcattcaactctaggaggaacttcacatgtctattttcaaacgattaagagatcttacgatgtccaacattaacgccattatcgacaaggcagaagatccaattaaaatgacggatcaatacattcgtgatatgcaagaggacctggaagatgcagagaaagcggtagccgctcaaattgctattgaaaagaggttcaaacagcaatacgaagaacaggctgctttggtaaagaaacgtgaagaacaggcacataccgctgcaaaagcacaaaatgtagatctggcccgtcgtgcgctggaagaaaagaaatctgctgaacaaaaaatgaacgagttcaaagctggttacgaacagaacaaagctgcagccgataatctacgtggcaagctggatgaaatgcgcagacagctgacagaaatgaaaaacaagcgcgaaacactggttgcccgttataatgcagctaaagcgcaaaccgaaattaacaaagctatgaacggttttagctctgatacggcaactgccggattgaagcgtatggaagaaaaaatgttgcaagcagaagcacgtgccgaagcgagcaacgaaatgtcctctaaggaaaaatcgttggatgaggagttcaaagagctggataagaaaagcgccgtggacgatgagcttgccgctttgttaaagcaatacgaaaataaataagaacattttagcaatgccaccaagtgtgattgctcaggaagcgaaggagaaacgttttctccttcgcttttccctgcctggaggcgcaaaacattatatgaaggtcaagaagatgtggaggatggtatgaaatgcattttttagaaacgatgaaagcaatgcttgtatggactggtgcgggggctattttgatcttcgtattaatgtatgtcgactctttatttacgaagtataaggattttgccgaagtgaaagctggaaatatggccgtaacggtacgaatgattatgaagctggttgcacaaggctatattttgtcagggtctatcgctacagctaataatttgctcgaagcgcttgtgtattctgtgatcgcctttgtcatcctgcttgttttggaagttattgtacgtctgctgttgcggtactgggctcagtttgacctggataaaggtacacaggaaggtaaaattggtttcggtctgttttcaggagcgctgcatctagttggcgccttgatcattacagcatgcttctaggctaagaaaggcaggaatataaccatgggtgtgtggaaacgaatttcaaatctatttgctaagccggagccgccaaaagcagagaaaagcatgcttcacttaaatccaggtgatatctgtgaagtgtcgcttgttacctatgaagtggtaggtcgtgtacataatcgtgcccggaatgccgttgttttgacgcttcaggatggtaatcaagtcagttatcttcatattgaggaacgggaaacactgcaattcggactatatcaggccatcgacggcagacttgacaaccctgaggaagtgccgaccattttagagctggatgatacaacgtatcatttggaggagcagtattctgggcatgttaccgtcatgggccgtgctcctttccgacagggtggagagcagcatgtttggcagtaccagtctgatgattatcatctgttgcgggtagagtggcaggacggtcgctttatgctttatgaaggagaagaagtgattaccggagacgtcaaggttattcgggcaagctaggagagggttacacatgagcaaacgcacctggcagtatgcattaaagatcatggtggcgctgagcttgttcgtatccgtgttaagcggctgcggcgcgccaagtgtaaaagatacgtatccgctggaatcggttagtggcagcggaaactcgacctcgtatgtataccgggcagctggcaagacagttccggaagtagcggaggaattgaaagaacagcgtacaccggaacaaatgtcaccgcagagcaatgagcggatgtttctggtatatagcgatgagtggtaccatttgcagcaagatccagctaagaaggaagatacactcattgagattgacagtaaaaagtatgtcgaacaaaattacagttcaagctttctaaaaggatacttaaccgcaactgtgctggatgctctgtttgattcgttgcgtggttcaggctcctatcggggctactccagcagagatgtataccgaccttctcagggccaatatcgtgcccctacggtgcaggagaaaaaagcgatcccgccgattacggtggagcgtaaaggctcggttacccgtagaggaaagaactcggattccagtgttggatcaagcggaagtctgttcgacagagggtccagcagttcaccgagcagaggctcgatttcacgtgaccgtagcgacagcggtggttccagcatatttgattcgccgcgtagatcttatagtaagcccaaaacacgtagcggttcaggtaaaatcagccgacgaagtcgacgatgacgggtatcgtcaatttatttgaaaacaaaagattcgcggaactgtggtactgatgcacagttcctttttttatttttagagatgacgttggtgatcatctagcggcacagccatcaagtagaagtggactgataagggaaagcagccgcaacctacacctttatggatataataatgtagagataatcaaaactctgtttaattgaagggattgaaaattaaatggtactatctatttcttggccagatctttcacaaagaccatttaatctaatggtggaacgaaaaatggagtgttctccgaatgtcctgtatcaggcgtggacgaagcagtttgacagttggtttgcagccccaggatcagtattaatggaggctgaattgaacacgaccttctttttcgaaacgcattttgaagggaagcgtcatccacattacggaagatttctaagacttgagcaaaacagacttatcgagctgacttgggttactggcgaaggcagcaccaagggagctgaaacagtggtcaccgttgagcttaaacctcacggtaatggcacgcatctttacttaacgcatgcaggttttccagatgagaattcaaggaaccaacatgagcaggcttggccgcttgtaattgagcagctcgacaaaaggatgatgccagatagataattcagaaggttacaggctaaaactgcaacaagaggacgattttaaaatcgttcttttcatattttttgacgacaaaaataatatttaccttacataaaaacaaatattaccagtttactagattatttcattgccacatctattagtaaaatatacaattacaacaggcgaaataagaggatggtgtatctgtgttatctgcttttttatatatattacttggtgtattcgatgctttggccgctgttattttggtcttaaagctttatatgcttcccgtgagggaatatcgcacaaaaatattattctatgcaatgggcatagctttgttttcctttctaatgagggaagttataggcttgcctaaattagatttgccgcttcagtatttgttaatggttatcttttttagattcggtttagggatcaaaacccatctagcagctttttctgctggttctggtctaacagcctacattaacctacaactttttgtatttctgtttgcaaattttttcggagtagcagaaccaggtgttattaatgatacttctggctcttctatttacgttattcagttatcttctattattattgcgtactttatttcttttgtgatgggaaaatataactttggattctcgtttataattcagcctccacatgattttttaagagctgaaaattacttatcgtctctaaataagctgttgattctaggtgctctaatatcagctgccaccatttttattactttgtatatgctctatagctcaaataccataggattactatccatttcattgcttactttcggtttgtcgtatttcttttcagagagaggagattacgagggtgctagaagcgctatcaaggtacatcgcaacggaaataaaaaaagctgatcctgatggcccaacaagtgtagaagtgatggagtatgcgcttggtataaaaattaccgaagtatcgtcgatactaatggttgcggttatcgcttggatgaccgggcatttttggggggcgttattagctctagtaactatcatgtttgtaagaaaattttcaggaggggcacacttcagtaatcttacattttgtgtctgttttacaacggcaatatgtgtaactatacccttcgtctctttaaatttatcaacaatttcgattattaatgcttgttcaatattagtgtttttagtttatgcacccaatcattttatttatattcataagaccaataaccacaaatattataaaactgtatgtgttttggtatgcgcagtgaatttttttatacagtcccacataatatgtttagctttagctattcaagcattcagcattcttcctttatggaaaggaggtgaacgaaaatggataaaagattggcgagagctttaaatataagactgggaaaatacgctaacgaatctaccaaaaatgaaaaaacagtatttggtgctaaaccgataccggctgagcttaagaaaaaagaaaagaactgatgaagtaccgcgttttcaatttggggcattgcttttatacgatcgggctaaccgcacagacttgcaaggaagcttttcagctatcacgacttggttttgtgagatcgagtctaacgcatttggaggtacgattcgaagaatctgacttcacttgctctatgtctcataataagcttaaagcacttaaaaagttatagaaatgacccgtagaattcacgggttatttttattgccatacatacttagacaccccccgatttgccagataacggttttagcgttataacagaaagagggcattttagaagaacggagtgaaattatgaatcatacatcattaaacgcagaaaaattccagcgtaaagcagttcaggtggaagaggcgcaaagcaggatagctagtcatgttaaacagggtgaaagggaagacgtagagctggagcaggcgcatggacgttctttggcaatggatttgaccgcaccacacccgtatccccgttttcgtcgctcaggtatggacggttatgcgatccttggctcggacaccgaagtctgctcgtccggtcaggaaatctggttacatgtgattgatgaaattccatgtggcaccgtatcggacaagcgggtggagactggaatggctgcccgtatcatgacaggagcgcaattacctgaaggggcggacacagttgtcatgctggaagcaacacagctgcgtgaggaaaacggacagacatatgtcggcttgaagaagcgtatggagattggcaaaaatgtaacacagattggtcatgagattcaggaaggtcagcttttgcttagtaagggaacctgcctgggagcagggcacatctcggtactggctacttttggagtacatcaggtacctgtttacagaaagcccagggtggccgttttttctacaggatcggaattacttgcagtggatgagccgttacaaccggggaaaattcgaaacagtaatacatatatgctggcttctcaaattagagaggcaggaggagagccgttcattttacaagccattcatgatgatttgagccttgcccgtacctctgtacgtgaagcgatagctgcctatgatatcgtggtcacgagtggaggagtatcggtgggggattttgatattatgggtgacctggtacgacaggaagatgtgaatatgctgttcaacaaggttacgatgcgtccaggaagtgtgaccacagccgctttgattgacggcaagctgttatttgcgctttcaggcaaccccggtgcgtgctttgtaggctgtgagctgtttgtacggccgacgatccaaatgatgttatcttcggcacatccatatttacaaacctggacggcgaagttaggcgcagattatacgaaggtaaacaactatacacgctttgtacgcagctctctggagatacgtggtgggcaagtatacgcgattcctgcgcaagtagatgaatccagtgtcatggtgaccattaaggacagcgactgtctgatcgtgattcctcctacaacagaaggattacgcaaaggtgaagaggtgcgagtactggtattacaaggtggacaggtaacgtgaatacgaaacatccatttgtatgtcaaatcgtcggattcaaaaatacggggaaaacgacctttctcggagggttgattcgttatgtgcagaagtcaggtctacgcgtagcagtgatcaagcatgatggacatgaatttgaaatggatcatgagggtacagatacgtacaagcaccgacaggcgggtgctgaaggcgtagctattgtttcggctggaagaacagccattttagaagagcatagtcagcctgtcaccagtctgatccggcattttcaggcctatgattgtgtgttgctggaaggcttcaagcaggaggattatccaaagctggtcatggtgaaggaacaatcggatgctcagcttaccggtaagctgacaaatgtacagggagtagcggtttgggagcatcaaatggattgggctcaaggtcactactcagatgaaatgatacagatatttcctgccgaggccaacggacccgcaggccgctggctactcgaacagattcaaaagcagatagaagaaatgaggaataagcaggggtgagacatcaatcggctgagtcggttagagtgtctacccgccgttcgatcgccttggacatggttttgtcagtcaggtgggcatacacttctgttgtttctgtcgaagcgtgccccagttgttcctttgttttgtaaatatcattttgtaaataataatcagtagcaaaggaatgacgaagcttatgcacggtaaggtaaggcttgccgaaacgcttggcgtacttgatgatcattgcctgaatagctcttttggtcatccgtttgccttctgtactgccgttaggacgtgcgacaaagagagctttttctttttttggggcgcggtaacgggtatgtcttagggacaaataaagtatgagatcatctttggattgctcgcggaaatacaccggcgttttaaaggtttcgtcgttattgcctttgcggtacacatataataatttattgtttatgtctaaatcatctagattcagattgacgatttcagatacgcgcaggcctgagttcaaaatgaggctggcgatgcaggcatcccgttccttatttagttcataggagtataacgcctgcttgttatcggccaaatcgtgaccatagccttcataaatataaccgatgaattcaagcagttcttcctcttccagtattttacctttaagcttggccgccgtatccttgggtttatgtatacgcttgatttcgaccttggccataatgttgcgtttgagcaatggataaaaattttcatcctcagcgatctgactcaaataatgaaaaagcgaacgcagggacgatagcttacgtgaaatggtaatacgggagttggagccttcgcgcttcgtagacaggaataatcgaaagcctgtaatactgtccatatgaagtgtctccaattcttccagtgtaacttgggcatttgtttctccagtagacaagccttccgagcgaagccatgaaaagaaagcttcgtaatcccgcacatattctagtaatgtggaaggggacaggtcgggcagcttgtaatccataaattgctgcacgtaccatggtaatcccggcattttttcatctagtttgcgccggtcgatgatcttttgtatattcattgggttccacctcgtccggtcataatatatatgtattttagcatattttgcacagcactggatgggatgtaattcgaagttaaagaacagattgaaccgccaagagaggtgaaagtatggggtataatatcaaatcggaactgaagctgtctattaagagtgtaccggagtcgcaaaaggacattattgtacagctcatgcaattttatttatatgattttacagcctatcttcgaattgatgtcactgagaaggggacattcccggcttatccagacttgtatcaatattggacgagcggtgaacagaagctgccttttctaatttggagacaggatattcctgtaggctttgcactcgttgaccgaatgtccagcaatcgagaagctgactactacatggctgagttctttgtacttcgtccttatcggcataatggggttgggacttgggcggctcatgagctgtttggacgttttaacggacgttggaaggtgacccaaatgagcaccaataggccggcacaatctttttggcgaaaggtgattggaagttatacgaaaggcgagtacaaggaacagacacatccggtaagagggaatataagtcagtttttcaatacctgaaaaattcgaaatagaaaatcagtaatgaaaaagagtcggggagagtatcctgtcggctcttttttgttgtcaattcaagtcttctaagagaccagttggacccgaaaagaaatgcaaattagcaacaaaaagcctattcttaaatgctatagaaggagggagtccgtttgtcatcattgctgtagattgaacatttatacggtcgaatttcacactaaaaaaggtttactgcaagcactcgacaacgtatcactaacgatcaggacgggagaaatggtctgccccaacggtgaatccggcagcggaaaaacgattacccccaagtcgattatgcggctaaccgattatgaaaacggacgaattgcccaaggacaaatacggttgcagtacatagatttgaccgttttgtcgcagcaggaattaagctcacttcgcggcaaaaagatggcgatggtatttcaggagccgatgtcggcgtttgatccggtgatgtggtcctgatctgctatggttcgcgatttccgtatgagtttttgggaggacgcgccaacgaatcgggatagcccgtgccattgctctgtatagtggttatgtacttgggggaacttgtagaattgctccaagtgacgagttgtttcaggcatcctgcctatccgtatacccgagggcttgttgcctcgatacctaatccaaatccgaaaaaccgccgggagctaattacgatacaaggtgagattccttcgcctgcgaagcctccatccggctgtcgttttcatacccgctgtccactagcgacctcgcgttgccgtgaggaagaagtgccaggactgacagcgattagcacaggacattatgccgcttgtcattacccgtcctaggttcaagacaccgctttgatctactatcagcatgataaaagaactacattctacaggccgttcatggtaagataaggatagaagcatataaattcaataggaaaagagggtattatgctagaaaaatgggttcaggaattaaaagatggtgaacaagagctgattgcgtggagaagacatctacatcagcatcccgagctttcttttgaagaaacgaatacgtctgcatttatcgccgatcaattgcgctcttttggcattgaggtaagaacgaatgtgggtggaaacggtgtgctcgggtttttagaaggcggtcagccaggtagaacgattgcatttcgtgctgattttgatgcgcttcccattcaggatgaaaaggatgtgccttataaatcgaccgtttcgggtgttatgcatgcctgcggacatgatggtcacacggctgcgttacttggagtggcacgcgtattgagccataaccgtgaggccttgaagggaaagcttgtgtttatttttcaacatgcagaagaaaaaccgcctggtggagccaagtttatgattgaggatggctgtctggatggggtagaggcggtatacggtattcacctcgcctctgaaattccgcttggtaaaattggattaaagagtgggcctgcgatggcggctgtcgacgcgtttacgatccagatcaacggtaaaggcgggcatggcgcacgaccgcatcagacggttgactctattgttatcggcagtcaaattgtgaacgggttgcagcaggtggttagtcgcagggtggaccctattgaatcagcagtgttaacgattggggtatttcaagctggaactgcctttaatgtgattgcagataaggccaaaattgaagggactgtacgtacgtttaataaggaagtgcgtaaggaagtcgagaatgaaattcgcggtatcgtcaagggcttgactgaggcttatcatgccggatacgaaattgactatttgaatggctatccttctttggtgaatgccgaagccgaaacggaacgtgtacgcgagctcatcggcagactgtatggagtagacgcttttttggatttgaagccagtcatgggagcagaggattttgcttattatttggagcagcgaccgggagcattcattcatgtgggtgcacgcaatgaggatgaacgaacgcattttgctcatcaccatcctcactttgattttgatgagcgagcattgctcgtctcaggacatatatttttagctctggcgcttgaatacttgcaataatatgcatatgtttatgactgatgacagtattaacggaagcaatgtaagctggaaccgcgcatagcgcggttttttgttgtaaatcaaagtattttgacatccataaagaatgaaaatgaagtaattaattcattatatgaaaaattcataatagagttaaataaaaggtgttaaatcttaaggaagtccaaacctcatattataagctgaggagcacgagataatattgcattatcttgatttttcgcacaaggaaatgagaaaaagatgacgaatctattgagcaagacaccgatgtaagcgctaacaaaacgagtatcgcaccgtatatattggttgaatggaggtgagcctgagaaaacatttgtcagatttgtgagaagcaacgataacgataggaacgtattcagaatcggctgattactttgatctcagaatgactcgcatattcaaatgataatgaagaaggaggttgaattcattgactaaggcaaaaaacaggttgagaattgcttgtttggcgcttgtggtagcgggtgcttcctggacaggaatgatagcaccggctcatgctgctccaagtgacgattacagttggaaaagtgtcgtaacaggtggaggtggtggttttgtacctggcattatttttaatgaaacggaaaaagacctaatctatgcccgtacagatattggaggagcttaccgctggaatgctgccaatgagagctgggttccgctgacggattctgtgggctgggaggattggaacaaaaatggagtcgatgcactggcgactgatcctattgatccgaatcgcgtatatatagctacaggcacgtatactaattcatgggataaagaaaacgggcagattatgcgttccaccgacaggggcaatacgtggcagacaaccaagcttccttttaaggtggggggcaatatgccggggcgttcaatgggtgaacgtctgacgattgatccaaataagaataatattttgttctttggagctcgaagtggtaatggactatggaaaagctctgacttcggagcaacttggagcaaggtgagcagtttcccgaatccagggacgtatgtacaggacccttccaatgaatataccagcgacattgtcggtttggcctggattacctttgacaaaaaaacaggctcttccagtaaagcaacgcagacgatctatgtaggtgttgcagataaaaagcaaagtgtctatcgcagtacagatggcggaacaacctggtctgctatagcgggacagcctacgggctatttgccacatcacggtgtgttatcagcggacggcaacttgtatatttcttatagcgatggagctggtccatatgacggaacaaagggtgaactgtggaaattgaatacagcaagcgggcagtggactaacattagccctattggtagcagcagcgcggacaatcattttggatatggtggactgacggtggatgcccagaagccaggtacacttatggttgctaccttgaatgcctggtggccggatgaaacgatttaccgcagcacggatagtggggcaacctggagtcctatttgggaattcgatggttatccgtctcgcaagctgaaatacaatctggatataagcggtgcgccttggctgactttcaatgccaaccctgctccaccggaagcatcgcccaagctgggctggatgatcggagatctggagatagatccgtttaattcagaccatatgctgtatggcaccggagctacgatttatggctctaaaaacctgaccaattgggataaaggaggaaagctagatatttcggtagccgctaaaggggtagaggaaacagcgattttggatttggtgagccctccagttggcgcgcctttggtgagcgcagtaggtgatgtctctggtttcaagcatgacgatctgttcaaggctccagctaaaatgctggataatccgacctttacaagcagcgaaagcatcgattatgccgagttgaatccttcttttatggcccgggtaggtaaagcggattataaaaaagatccaaatgccaaatccatcggtttttccaatgatggcggagccaactggtataaggcaaatagcgagccttccggtacaacaggaggagggagcatcgccgtagcggcagatgggaatggcttgctgtggagtacatcggacaaaggtgtgttctactccaaaactggcggcaacgcatggacagcaagcacagggattccagcgaatgcaaagatcgtctctgatcgagtgaaccctaataaatattacgcatttgcctccgggaaaatatatgtgagcaccaatggaggcgtatcctttacgccatcagcggtaactggcttaccgacagcaggcaatgctgatattgacgctgtacgaggagcagaaggagatgtatggttcgccggaggctccgaggatggagggccatatggcttatggcattccaaggattctggcgctacgttcaccaagctctctaatgtgcaggaagcggattttgtaggctttggtaaggcagcgccgaaccgtacgaatgcagcggtatttatcgttggtaaaattgatggtacacgtggattttaccgttcggacgatgctggcgcaaactgggcgcgcattaatgatgacaagcatcaatatgctcgagtgaccaaaattattggggaccctcgggtttacggacgtgcttatctgggaacgaatggccgcggcattctggtggcagatcgtgtgggtggtgatcagccatctaccgggcaagcaagtattacaccaacgactgcaacctatggagtagataacagcaataccgatattactgtcaagcttacacttaacggtaatacgctagaagcgatcaagcagggaagcgtggtgctgaacaagagtgaagattatacggttagtgaagaaacggtcgttcttactaacaagtatttatcgaaacttcctaaaggagagaccacgctcaacttccattttagtacaggcactgatgcgttgttcacgattacggtgaaaggagatacgccaagtgagccgggaacaggcgagggcgttctgaaggtgcaagccttcaatgggaatgtatccgccacaagcaatacaatcagttccaaatttaaaataaccaatacgggaacctcatcaatttccctagcagacgtgacattgcgttattattacaccattaacggggagaaagcacaaaatttcttcacagattggtcgagcgtcggtacagggaatgtgattgctagcttcaaaacattatccaatgcgaagccaggggcagattcttatgtagaaatcggctttaactcggctgcgggttctttagagcccggtcaaagtgtggagttgcaaacccggatatcaaaagaggactggagcagttacacacaaaccgatgattattcatttaatcccacagcaaacagtttacaagattcttctaaaataaccgcttacctgtctggaagcaagcaatggggaattgagccctaaccttaataaggataatcctaagtcagccactctaatgagtgagctggctttatttttgatgaccttgttgtcctgcattctttttttggggaaaatgcaacgacaagttgaaaacagtaactaatagagattcaaattaaattatataattatttcactatatgaaaaattcataatagaaaaaaactatttctcgcatacaatctccacaaaacaaacacaccactttaagtagaaaaagaaacactgacgggaacatatgttcttttatctcgaaaaaggaaacgctcctgtccttagacaaaaagcgtctctaatccattttttatattgatcatacacctcaaacaagatgccgggatgctgaaattaatagggtcatcgtaatgacattcacaatcgtggaaagtaatactgtttgtgcggcaaaatcgggttcgtttttatattcttccgccaaaatactggtattaacgccggtaggcatacccgatgcaatgagcaaggcttgagcgggaattcccttaagacccagcagcaagacgagcataaaaccgaccattggaccaacaatcaggcgtagtaccatactgatgtacacggcagtccggcgcaaacgaaagggatattgcacaatttgtgctcccaaagtaagcagagccacggcaaccatcgactgactaatataattcaaaggttcagctagtaaattaggcaatggactatgcagcagatttaggagcaaacctagcgcaagcgcatagggaacaggcatttttaaaaaattaattaatatttttcgagtattggccttgccgttttgcacaacaaaagtgccgtatgtaaatgtgacaaagctttgaaaggtcataatcagagcttgaacggaaatggccaaagggtcacctttgaacaccaactgattgattggcagaccataatttcctgaattatctagcattacactatttgtaaaagctccacgcattccgggactgtatttcagagatctggcgacggtagtgctgattacgtacagaatagctatgtacaaggcataaaaaagtgaaacctcacccatgagcattaaagaaatttccgagttataaagacccgtaaacacaactgcgggggtgatatagtaaaaattgattttagctaaggtatacaaatccagtcgaaaataatattgcatgatacaaccaaaaccgataagtacaaaaataggtaaaacaacgtccaaaagaatggtgccgaacatgtctgtttcatcttctttctattatgcgaatgtaaaggctgatacttaaaaatgcatgtgtaattctcattatactgtgtaaataggttaggcgtataataaaattttatagtggttttggcaatctggactgcggctatattggtgtcccacacattagttaaagaaaagataaaaaatcagcttagagaagccgttaatacatctagggacatttgagcccggtctttactataaggaggaatcgcatcatgagaaacacttggacagctttattagcgtgtatactggtcttgggattggcagcaggaaccgctgaggccaagcagggacgcggaaatgatcatgagaacaaacaggaagcaaagacgtctgttaaagacgggaatgaaaagagtggggaagagctaatcaatccccatgactcagacaatgatcagtccaaaaaacaaaaggacaaagcatccggtaaaaaggatgaaaacagtaaaaaagaaaaactcgcagaaatcagaaaaaccgaacctgttgcagtaacggatgatacgtacgaagagtccaaagaccataatggtcacaagggacgcaacggttacaagggtctgcttcacgcggtagaaaatacgaaggataagccggcaggagcggttattgcgaatctgctgcttacgaaatacccggaccgtttgactccagagcaggttgctgaacttgaattgatccggaattctggtaaagcactgactgaggcagctgagctactggctgaaaacggaaatgtgacagatgccgtttacatgcaggaggaggcggtactggctaatgtgtccgatctggacagctacaaaaagctcggtgaattctcgaagaaggctggacggccgtcgggtatgaagctgttcgtgaatggtgaagaatacgatgccaaaccgattaaccgcaaggggaccacacttgttccgtttagaacagcttccgaagctttggatgcaaaggtttcctgggatccgaaagaaaaggctgttacagtcacccgtaacggcgtgtccgtcaaattatttgttaatagtccgaaagcatatattaacggtcagccgtattctatcgagcagccagcatccatagtggatgggacgacaatggtacctgtaagggtaatcggagaggccttggggacaaatgttaaatgggagcctgaaagccagtccgttgttgtatacgaacagccaacaacaactactacatcaacatcataacgtgttgtaaacaaacaaaattttgaaagcaaaaagggcccctgactaaatgtcatgcctttttattttaccttgcaattaatgatttcgtattcatgatactaccaagctattcgcattatgtgctggtcatgtgtacaattaaatagagaacactgagaaaagggagtgttatagatggatttaggattaacgggaaaaacagcctttgttgcaggttccagtaaaggactcggcaaagcaagcgcacgggagctggcacgcgagggtgcgaatgtcgtcatttcaggacggaacgaagcagagcttcagcggacgcaggcggaattactggaaacagcgagtggccgcgttgaatatgtagtttgcgatgtaacaaaaccagaacatatctcccaggccatccgccgtacagctgatttgtttggcaccgttgatattttggttaacaatgcgggtgggcctcctgccggtacctttgatgattttacagatgaagtgtggatgcaggcctttgaacaaaatttacttagtcatatccggttgatccgtgaggtgttaccttatatgaaaaaacaacaaaacggtaggattttaaatattgcttcttcctcagttaaacagccaattccggggttaatcatttcaaatacgctacgtactggagtcgctggattggcgaaaacattgtctctggaattagctcctcataatattctggtacatactgtagcaccagggagaattgcaaccgatcgcgtgcgtagcttggacgagcatcgagctgagaaaactcagcaaaccacggatcaggttcgtaaacaagcagaagagggcattccattggggcggtatggagagcctgaagagttcggtaaagttgttgcttttctggcgtcttcagcttcatcctatttgacagggagcaccatccttgtggatggcggaatgattaaatcgttataaaataaagatgcgtgccagctcaggtttaattgggtgctggcacgctttttttaaatttatttagggaatagataatcttcattcacgtcctggaagctcacaaccctcatcggtacatataccacctgcatcttgtttggacgagctgccgcttatcatggtgaaaggtgaacgttcatcccatgctttttgaagcgcatcatggaatacttcctccggctgggcaccagaaacagcaaattttcgatcaaatacaaagaatggtacaccctgaacacctaactcagcgccttcggattcatcagctctaacttcgtcggtaaagcggtcactggctaatatagcagccgcttccttttgatccaaaccaacctcagtagccagcgctaccagcacttcatgatcccctgtatgcttgccttcgatgaatacagcctggaataaacgctcgctcagctccagcattttgccttgtgtttgagcccaaagtgttaagcggtgagcatcaagagagttcgtcggcaccatggcatgaatattataatcaagacccgcagagcgtgcgttttcgttcattcgatcattcatagcctgagcctcttgcagactgaccccatatttagcggatagttcttcattgatcgttttaccgctatctctcacagcatccgggttcaattcgaaactcttgaatgtcaattgcacctcattgcgatgtggaaattgctgtaatacttgctccaaacggcgtttgccaatataacagaatgggcacatataatcagaccatacttcaatattcatcaggaaaaagcctccatgtatacgtattttattgagtaaccgggagtagtgctccccactttagaatgtgcataaaggtggaacttcattagttacaacaagaattataaagctaaagcattcaacgtgcaaataattaatgcttgtcaaaaaattaatgctatgatattttatatgtgtaaccggttacacattggagttgaacctacactatgacaacaattaaagaagtcgccagctttgcaggtgtttccgtagcgaccgtatccagagttattaatgaaactggatatgtacatgaggatacacggcgaaaggtagaggctgctgtgaggcagttaaattacaagcccaatgaagttgcacgttctttgtataaaaagaaatccagattaatcggcctgctgctgccggatattacgaacccttactttcccttgttagctcgtggggtggaggatcgaatgcaggaaaatgattttcggattattttcggtaatagtgatgaagatcgccaaaaagaattggattacatggatacttttgttcaaaataatgtcgttggtgttatttcttctaccaatgatcccgatgccgactgttacgctaaactgaagatcccggtcgtttttctcgatcgaacttccagtgacagcctctccgtatttgcggatggagcccatggcggttgcttggctgctcaagaaatggttgcccgcggcagcaaacaaattacagtcatgcagggccctgcacatattcgtccagcacaagaccgttttcgcggggcggttgaagagcttcggcaatccggaattgcttaccatgtggtcgagacaacttccttttcgttcaaggaggccgagtcgtgggccaaagagctgtttagcaagtacccggatacggacggagttatcgcaagtaacgatatcgtggctacagcggtgatgcatgaggcacatagattaggaaagaaaatcccggatgatgttcaaattatcgggtttgatgatataccattaagcagtttgttattcccgcctttgtcaacgatccgacaacctgcttatgaaatgggctgggaagcagcaggactactcattcagttgattgagcagtcgcaagtaacgaagtcaagcgtacctaatcttcattcgaaagtacttacctattcaagcatacaattgcccgtcaaatttatagaacgggaaacgacgagaaaggtggattatgatggctaaaatttcgattatcggaagcagttctatggatctcgtagttacttcgtccaaacgtcccggtgctggtgaaacggtattgggtgaaagctttacaaccgtacctggaggtaaaggagccaatcaggcagtagccgcagcacgactcggagcagccgttacgatgattggacgtgtaggggatgaccattttggagaacagattttacgaaattttgaagaaaatcatgttcatactggctatgtgaaaccggttacacatatggaaagcggtacagcgcatattgtactagctgaaggtgataacagtattgtcgtggtaaaagcagcaaataatgaagtgacacccgcctatgtggaagaagcgcttgacgtcatccgaagttcggatattgtgctaattcaacaggaaataccaacagaaacggttgtttacgtaagcgagatttgtgcgaaataccagatacccttgttgctgaatccagccccggctcgtgaagtggaagaaagcgtaattgcgaatgcgacctacattacgccaaacgagcatgaagctgccattatgtttaaggatatgagcctgcaagaagcgttgcgtaaatatcccaacaagctgtttgtgactgagggcagcaacggtgtacgatttttcgacggagaacaggaagtcgtggttcctacttataaagtagaagccgttgatacaacaggtgcaggagatacgtttaacgctgcttttgcagtggcactggccgaaggaaaatcgctggccgacagtgtgaaatttgctaatcgtgctgcgtcattgtccgtaaccaaatttggagcccaaggtggaatgccaacccgtcgtgaagtggaggagcaattataatatgaagaaacatggaatcctaaacagtcatatatccaaaatactggcggatctcggccacacagactatattgtcgtggctgatgccggcttacctgttcctgaaggcgttaccaaaattgatttggcccttaaactgggtgttccatcctttcaggacgtcgttgatgtcattgcagcagatatggtgatcgaaaaagtaacgctggccgaagaaatcaaacaagaaaatgaacaagcattgcagtatattatgcgcaactttgcaggggagcaattagaacatccacagattaataagcaggctgccgtcattgagttttgctctcatgaacaattcaaggagctgacccgttatgcgaaggcggtcattcgtacaggagaggctaagccatttgccaattgtattttgcaggcaggagttcattttggataaatcaatattgaataaaaaggagggtacagcatgcagattcaaatgaaaggaattcacaaagcctttggaaccaatcaggtactgagtggtgttgactttaatcttcgtgaaggagaagtacatgccctcatgggtgaaaatggtgcaggaaaatcaacgctgatgaatattttaatcggactgcatcggcgagatgagggaacgatcatcattgacggccaggaaacctattttgctgaccccaaagaagcggagcaaaaaggaattgcttttattcaccaggaactgaatgtgtggccggagatgaccgtgctggaaaatctgtttatcggcaaggaaatgacatccaagtggggcttactagacagctctaaaatgaaagcgttagcaaatgagcaatttagcaagctttcggtaaaccttccattaaacggtgaagcaggcgagtgttcagtgggtcaacagcagatgattgaaatagccaaagcactcatgacggatgctaaagttatcgtgatggatgagccgacagccgccttaaccgaacgtgaaattcagaagctgttcgaggttattacttctttgaaaaaagatggtgtttcgatcgtgtatatttcacatcggatggaggagatattcgcgatctgtgatcggattaccatcatgcgtgacgggaaaacggtggatactcaggcgattcccgatacgaattttgatgaagttgtacggaaaatggtaggtagagagctgactgaacgttatccggtaagaacgcccgctttgggagaagtggtgctggaggtcaaaaatgccacgcataaaggcttgtttgaaaatgtgaattttactgtgcggtctggtgaaattgtaggtttttcaggcttgatgggctcgggacgaaccgagatcatgagggcgttatttggactggatgctttggaccgtggtgagatccatgtacgtggaaaaaaggtgtctattcgcaagccggatgacgcggtgaaactagggattggcttcattacagaagatcgaaaagatgagggcttggttctggatttttccattcgggaaaatatggtgctgccaaatctctttagctttacctcaaaaggatttatttcaggtaaaaaagagttggattttgttaacactttaattaaacgcttacaaattaaaacccaatcgggtgaaacaacggttcgcagtttgtcaggtggtaatcagcaaaaggtggttattgccaaatgggtaggtattggtccaaatgtactcattcttgacgaaccgacgagaggtgtggatgtgggagccaagcgggaaatctaccagttgatgaacgagctgaccgaacgtggagtcgcgattatcatggtatcctcggaactccctgaggtactcggcatgagcgatcgtattgtcgtggtgcacgagggaaagatcagcggagagctgagcagggaagaagccacacaagaaaatattatgacgctagctacaggaggacagtaatatgacaactatgaatgaatcaaaaagcagcaaaggctttcaaatgtcacaaatcacacagaagcttggcccgttgttgggactcattattttggtgattatcgtatcggtcttaaatcccagctttttggaaccgcttaatattttgaatttattgcgccaggtatccattaatgcgttgattgcgttcggtatgaccttcgttattctcacaggcggaatagatttgtcagtcggctccatattagcactatccagtgcgtttgtcgcaaatatgatgctggctgggttcgatcctattttggcgattatcatcggctgtgcattgggtggcgtgatggggatggtcaacggcttgatgattacgaagggtaaaatggctccattcatcgctacactagcaaccatgaccattttcagaggattgacactcgtttataccaatggtaaccctattacaggactcggggacagtctggtatttcaattgttcggtcgtggctatcagttcggtattccggttccagcgattacgatgctcattacctttgctgtcctatggatcattttgcataaaacaccattcggacgtaaaacgtatgccattggtggtaacgagaaggcttcgattgtatctggtattaaagtaccgcgtgtaaaaatttggatttactctctggctggaatgctctccgcattggcgggagctatcttgacttcacgtttgaactcggcgcaaccgacagcaggtacttcttatgagttggacgccattgcggctgtcgtattaggtggaacaagtctctcgggaggacgcggacgaatcgtaggtacgttaattggtgtgcttatcatcggtacactaaacaatggcttgaacttgctgggggttaactctttttatcaaatggtagtaaaagggatagtcatcgctattgctgtattgattgaccgtaaaaaatccgcataatacacctaatctgcgtagaaggagacacataaatatgaaaaagcttacattaatcatgactgcattgctgctcctgctcatgacagggtgttccttggaaccgcccgaatgggcgaaacctaaagcggccgcgaacctgaaggacatcaaaatcggcttgtcgatctcaacactgaataatccattcttcgtatctctcaaagacggagttgtggcagaggccaaaaaacaaggaatgcaggtcattgttgtggatgcacaaaatgattcggcgaaacaaagtaatgacgtggatgatctgattcaacagggagtaaacgcgttacttattaatccgacagattcgtcggccatctccactgtggtacaatcagcgaatgcattgaacatcccggttattacactggatcgttctgctgacaaaggcgatgtaaaagcactcgtcgcttcagacaacgtagagggaggacgaatggctgccagatatgtgattgatcaagttggaaaaggtgccaaggtgattgagctggaaggtgttccaggagcatccgctacccgtgaacgcggaaaaggatttcatgaagtagcagataaggatctgaaagtcattgccaaacaatcggccgattttgatcggaccaaaggtttgaacgtgatggaaaatctgctgcaaggcaacccggacgttcaggcagtatttgcccacaatgatgaaatggctttgggtgcgatcgaagcaatccaaagctcaggtaagaacattccagtcatcggttttgacggtaacgaggatgcgcttaaatcaattaaggaagggaaactgacagccaccgtagctcagcaacccgagcttattggtcaattggcggtacaggcagccaaggatgtacttcaaggtaaaaccgtgaaaacatcaattcccgctaagctggagttagtggatcaatcgaaataaaaagggcgcttgacccaacatattaagctattcggactgatgctgtaatgcgcatcagttcttttttttggctattctacgatgacgatacatacacataaatggaagttttttatttttgtattgtaagaagagacggtaaaagatagaataacaattatatgataatgagaatcactatcatataatgaattgtatatatctaaggaggacgtatattgtgcaacaaaggtacagattaaaatgggaatccacgctttgtcttgtggttcttttgatggttgtattgagtgcatgtggaaacgcagctagcaacaaccagacaaacgacaagaccagtactaatgatccttccgggcaatccaagacggttgtcatgcgcgaatatactgatgccactggcaataagatcagtatccctgccaatccacagcgagttgtcacaacacaatatttggatgctatgctggccttgggagttaagcctgcaggtgctgcttcccatttgttggaaggcaactatttaaaaggtaagattgacggagttgcggatattgggaacccgacaaatgtagaaaaggtgctggagttacaaccggacctgatcatcacaacagaatataccacgcccgaagtgaaggagcagctagagaaaattgctccaaccgtagtcgtttcgtttggagaaggcgatgtatttgagcaactgcggagtgtcgcagccgtgctgggtaaggacaaggaagccaagcagtggatcgctagtttcaacaaaaaggctgaggaaggtcgaaagaagttggttggaaaattcaaaaaagatgaaacggttacgatttatatggcctacgataagaatgtgttaagggtatacggagcgcggaatgtaggacatgttatttaccgttcactggaattgaatcctcctgagtacatacgccagaagctggcgaaggacccgagatttaattatgtttatgatgttatttcaatggaaaagttacctgaactgtcaggagaccgaattattatgctggtttatgatgaagcgagcaaggacggcatgcttaagcaaattgagcaaagtgcattgtggagaaatctcccggctgtcaaaaaccacaaagtgtatttcatcaaagccgatccgtggtttacctactcaccgctagccgttgaccaatcactcgatgaggctgttaaaatgttttccgttgatccgaagtgatcagttcaattgaaataagaaaggagaagtcataaccatgcttagacgattttttgaatactatcgtccttaccggactttgttcatcattgatttctcttgtgccttgctggctgcactgctggagttggcttttccgcttgcagtcaaccgggtggtcgatgatttgctgcccagcgggaactggaaatggattttatatgcctgtctagctctactcgggatttatgtcgtcagtgctgcgctgaactacgtggttacctattggggacacaagctgggcattaacatcgaatcggacatgcgtaaaaagctgtttgatcgggtacaaaagcaatcttttcgtttttttgacaataataaaacagggcatctcgtgtcacgtatgaccaacgatctgatggatattggggaaattgcccaccacggacccgaagatttgttcatcgcgttgatgacactagggggagcctttggtatcatgctcggtattaactggaagctggctgtactgactttcatcattgtacccctcatgatttacttgtctctttatttcagccgtaaaatgtctgctgctttccatcgtatgttttctgatattgcggattataacgctcgtattgaaaataatgtaagcgggattcgtgttgttcaagcgttctccaacgaagcacatgaaatggaacggtttgctgaaaataatgggcgtttccgtaaaacgaagctgatcgcgtaccggattatggcctggaattcctcgattagttttatactaatgaagctggtttcattgtttgtgctagtatgtggaacatggtttgttattgaaggacagatgacctacggggaatttatcgcatttgtgatgctgtctaatgtattcctggggccgattaaacaaattaattctgtcatcgaaacgtatccgaaagggattgctggcttccgacggtacctggatttgctggaaagtgaatcggatgtagaagatctgcctggggccaaggcggttagccatcttaatggagatattcaatttgcaggtgtaacgtttggttacgaaaacaaagataaggtattacgcaaagtggacctatctatccatgcgggtgaaaccgtagcacttgtgggtccttcaggagcaggtaaaacgacactttgcagtttgttgcctcgcttctacgatgtcgaggaaggtagcattactattgatggaatggatatccgtgaaatgaagctggaatcgctgcgatccatgattggtatcgtacagcaggatgtattcctctttgatggaacgattcgtgaaaatattgcttacggtaagctggatgcttcggaagaagaaatctgggatgctgctcgtcgagctcagattgaagaccttgttcgctcatatccggatggtctggatacaatgatcggtgagcgaggtgtgaagctctctggtggtcaaaagcaacgtttgtctattgcacggatgttccttaaaaatccgccaattctcattttagatgaagcaacatcagcattggatacagagacagaagccgcgattcagcaagcgctgacagagctatcccaaggccgtacgacactcgttatcgcgcatcgtctggcaacgatcaaaaatgctgaccgcattatcgtagttgcagaccaagggattgccgagcaaggcagacatgaagagttattggcagtaaaaggggcatatagccgcctgcaccaagctcaatatggaacgtaaataggccaatatgacaccgtaaatagagagaggaatgaacaggtttgacaaagaaaatgtggattgtaatgatgcttctgtcagtcattttagctcttaccgcctgtggtggaaatgtaaagcaaccggatgaaaagcagaatcaaacatctagcgaacaaaagtcagaggaaatgaaaacagtcaaaacgattcatggagatattaagattccggttcaccctcagcggattgtagtagatatgtaccagaatgatttattagcactaggaattaaacctgtaggaagtgttaaatattatctggataatccgttttcgaaggagcttgtgcagggcattgcaagcattggagaccgcggcagcgtatccattgaaaaagtattggctctggagcctgacttgattctgattggttccaaagatgctcatgaatatgaaaaatatagtaaaattgctccgaccatcgtcattccttatggaacgtacaagaatgttcatgaggaactgacagcttttggtgagctgcttggaaaagaacaggaagccaaaacatggcttgcccaatacgatcagcggatgcaggctgcacgtgacaagctaaagggaattgttcagcctgaagatactttcaccgtaatggaagcttcggaaaaagaatactatgtatatggcgataattttggcagaggaggacaggcggtatacaaaggactgaatttgacacctccgccgcttgtccaaaaagaattatttggtgagactcaatggaaatcggtgtcaaaagaagtcattaatcaatatgctggctcttatatctttctgacggttaacaaggatttgagcggttacgaaggagacagcatatggaaatcactgaatgcagtccggcaaggtaaggtttttgagctccaggaggatcgatattggtacttcgatcccattgccattgtagggcaagctgaagaaatcgcagatttgatcgtccagcggaataaagagaacgccacacagaagtagtcgcttcggtggtgttggcagccctttggtatttatgccgaagggctttatttgttcacaatagggcagagtattaggcattcctcgaaatttgctattgatgccgttgccacattaatttacaatagtaaagattgcatgataataattctcattatcaacatcatcttcaacacagttcgtgatagctacatactattcaacagtaagggtgaacaatagttatgaaattatcagaatcatcggatagccccgctcaaagtaatcataaccagtcgccgactcaattccactcgcgaccttgggcggcttcgcttatcctgacagttgggcttggacttttagcgttcggtatcgcgctatccctatcttttggtgcagcctcaattaggctggaagaggtatggaacgccgtttttcattttaaacccgagttgcaaaaccatcagattatttgggaaatccgtttacctcggattctgggtggagttctaatcggagtttgctttgctgttgcaggtgcaattatgcaaggaatgacccggaatccgcttgctgactcgggcttgcttggactgaactcgggagccagcttggcgatggcgatttgctttgccctttttcctggctcttcctttttacaattaatgttgtattcctttgttggtgcagctctggctgttgtgatggtatatggtacaagctccatatccaaatcaggtcttacgccagttcgtctcgtattggcgggtgcagctgtcacagcattgctgtctgccttaggagatgcgatcagtttgtactttgatgttggacaggatttggccttttggtatgccggagggcttagtggaaccaagtgggttcagctcggtatagttttgccttgggttgtggcagcttttatcggtgctctcatgttgtcgcgctccattacgctgctcagtttgggagacgaaattgcgttgagccttggtcagcgaactggggtggtaaaggtagtcggaatgattcttgttctgattttggcgggtgtagcggtgtcgttggtgggttctataggtttcgtgggattgattattccccatataacccgcaagctggttggcgtcgattatcgctggattattccatgctcggccattatgggagctttactcattgtgtttgccgatctggcagcccgtatgattaacgcacctgaggaaacaccggtgggcgtacttattgccttaattggggttccgttcttcctttatctggcacgtaaagaaaggagggcactgtaagatgaataacgttacgaatggggctattgccaaagctagtcatcgtaaaaaaatacatgattggatggttgtagtcattctgctcgtattgctcattgctgcgttcaccataagtgcgaatacgggaaccatccggctttcgccaatggagctatttagaaccttgtttggacaagggactccacagcaggaattaatcctatttgaattccgattgccacgaatggttatttcccttcttatcggtgcaggtctcgctgtttctggctgcatcatgcagggagtttcgcgtaacggcctagcggaccctggtattctaggcattaatgcaggcgccgggttgatggtcatgctgtttgtattgctttttccatctatgcaaactacgaattcattgtttttacttcccgctcttgcactgattggatcaggagcagctgctattctcatctacgcgctttcttacaagaaaggtgaaggaatttctccgacaaggctactgctgagcggaattggcgtagcggcgggtatcagtgctgcgatgatcattatgactcttaagctgacacccgaaagttacacgtttgtagctaattggttagcaggaagcatctggggctcaaactggaaattcgtgatggctctgttgccttggctgattgtattgcttcctttcgcatactacaaagcaaatgtgatgaatgtgcttaatctgggagatcagacggcatcggggttgggtacagctatcgaaaaggaacgtattctccttctcgctgctgcggttggattggccagttctagtgtttcggttagtggcggtatcggctttgtaggtttggtggctccacatttggcgagaaagctggtggggccgaagcataaaatgctgctggtaacctgtgctttagtcggagcactcctggtacttgtagcggatacgatcacacgatccttacctttacagaaagaaatcccgacaggtttaattgtagccatcattggtgcgccatacttcttatacctgttgagtcgctccaaagggtaacgtcacgaaagagtaccacctgtcaattaaaggctacgcaaacaaataaccttcaacaccactaaggaagtggggctgaaggttgtttgtttcatttaatttagcagcctttcatctcaacgggaagtattcaaggcatgagaggtttgatgcagctctctgatcattttatgcaacgtgtaattttcctgacgtgtcacgccgtgttgattttcctgaaccagcaactgatggatgtttcgttttagaatttcacttcgacgttccagcatttcggtactcataaataaatgaacactccctttgtcatgaataaacctacatttttgaaatgagcataggctgaatttaagtttgcctttcgacttctttaagtatatcgtgctggatgatcaagggaaaacggagcgagacagcaaattgctttttctcatcatccatgccgtgtcgacagcgactcaccccatgagttcttagatatacttcctgatgctagcgataacaggggattaggcgtaattaacttcatgtatataatttgactagctcatgtatagatgaacccgaacagttaaagcgaatgtatatggaatcacttatcagtttgctgaaagctatgggggggagcaactagaactgcaaagttgtattcaatgcaatcattggtttattccatattagcgagctcagttaaccaaattttgcagttctaaatgtcggagtcattacaactacttaatgaaaagaaaagattaagaggctataacatttttgaagtggggagatacaataatgattatttaaaaatcgaatgaacaaattgagatcatggggggaactggctgaattacgactattctgccagtccgcaccacttgcctttgaggccgaacttttcaagtcgtgtgttgtacgccgtagacgtatactggaagccgtgatccgaatgaagcacggcttcggatacgtctattttgtgtgcattcataataccaatttcttcataccccagaccgataagatccggaatggtggagaaatagctgctttatcatcattatttgtattgtggatataccggctgaacgactacctgctcaggatcatgaccgaagaacaacagattcggcttaacctcctgcacaatctgctgaatgcgggcgattgactgacgtgcctgttcacggtcaaagccgtcaaacggcacgtcgtttgcgtaattctcctgcgtgtaggcaacatcaatcgtcagcatgaccggacccgattcctttgttgtgaccaacgcggactgatgacccggcgaatgccccggagtatagaacagttgcaaacctggaaccagctcatgatccccttgaagcagtcggtaattcaagtccgcctgcacgcattccggtggcgcatactccagattaccgatcgcagcgtctgcttcggtctgctgcacataaatcggtgtatttggaaaatgcggattgcctccggcatgatccatatgcatatgagagattacgatggcatggatatcgtccggttgatagccgatccgatccagtacagccacgatactatcatcggctgacatatggggaatgaagcgtccttcaaacggtgtacttttaaaataatttggattgtcgataaacgaatccggcataccggtatcaatgagaatcggaccgtgatctgtctccagcagatacgaccagatttgcaggcgcaccagttcaccgggctgtgcatgatggttgagtgaggaacgatcaatatcaagctgaccgatcggtaaccagtacaatctgttaatcatacaatcatcctccaatcgtagtttacataataattattatgtagttattaatcggggtttcggctgacggaaagtgatgtttgtattttcgtttgtaagatccgggtgctggagcctcgtgctgtcgttgtaatctcactctttcgaaaattaatttttaatagtttaaatgaaaagcatgtaggcgtccagtagaaatttgccgtcaggcaggccagtccatacttttcctgtgaacaagactgtttctacacactgctcgaaatttgcccagaagctggatcacacggtcatcatctcgaaaatcggtgaaattcttggtgatccactgctgctagtgggtgaaaattacaatcagctagcaggctatcatatggagatggtgcacgcaccggaaggtgatccggatagcgagttggaagctgcgcatgatattcatgttttggccactatggcgattttgactgctaccgatcgagagcagcgcccccaacttggagaaatggtgccgcatgcaagactattggctatttagttttgttttggatatgaatgaattacattaggtgaacttttcttgagcgtgttttaatttgtctacattgtgggatcgaccccctctgatcctatgccacgccgttaagtgctttgaaatgtctgcttgaaggcgatactaggctggacaagaggaaaaacgctctatttgcccttgaaaagcgctaaaaaaacagcgtataatataaattatacgctgtttaggtttaaaacgacttttagaatccctcctgcataagatgtcgattggattgtcgataaaaatcagacgaaaatgatcgttttacagtatatttcggaatatgaactgaattggaggcgagcgagatgaaaaaagagatgcgacatgtggaactcgatacaactgaagaaattgatgaaatatatactgaggagctggaagcttttttgatctggatgaaggatgcaggatatacgatacatacgcaaaaaaattatatgggggatgtgaagcagtttttacggacgttgcgtgaaaaaccactcgatcaggtgaagaagattcatgttatgtcgtatttgtctaaagcgcgggagggaggcgccggcgatagtacgcggaaccggaagcatgcagcggtgaacagtttctttaaagcgctacaggaatttgagttatgcagcacaaatccggcagcgggaattaaaaaagcaaagactgaaaagaatcgtatgcccgtctatctggatgaaaaggatattcatccgtttttgctcgcagtggaggggaaatatgcaaatcgtaatatagctatttttctgctgatggtctacatgggattgcgggtgggggaggttcattcattgaatgtctcggattacagccgagaaagacgtaccttagatgtgttcggtaaaggacgtaagtggcgtactctcccggtaccagaagccgtgtgtgattttgtagagcatgcgttggaggaaagattgacgccgtggagaggtaaagaggatgcgatgttcgtatcccaaaaaggccgccgtctggcagtgcgcaccattcaacagatcgctacagaaacgttcgaacgattccagcaagataagagtatggaacgccgggaggcatattccagccataagctgagacatacatttgcgacaatgctattacgtaagggagcagatctgcgtaccgtgcaggagctactggggcattcatccattcagacaaccacagtatatacacatgtcactgatcgggaaaaagaaaaagcaatggataagctggatattcagataccaatatcaggattgtgagtatatgttggaaaattgagattaaacaaaaaaagagtttacataattattattatgtaaactcttaatgaggagtcatatcccgactcgcaaataaaatcaacgactttgtctcatcaatattgtgaacgttgtaaacttgtgagagaaccccacattagaacttgacctggaacgcgtttcataagctaggttaaatgtataagcttttaatccactcttgttagaaattaaactcagattctagtgtatattgggggattttatatatgtttaaactggtagtaagtttggcgagcacggaaaagagatctggatcttaggggacagtgctacgcggattaaaaaggatggagtcgtcgtcaaggagtttacgattgaacacaatctagcattacaagcgataagagatatcgaatgtttttccaatgattttaatatcatagcatgtacaacggaagcagcatttgttcattctcatattcaagacgaatactataaaattgtgaaaggctcgtataaagaagtggttaagattgattcatttgatcaaatcaaaattagctttcttaaaataactgtatatgatccagctggaagaagtcccttattaagaaaacatgttgaaaagactctactgggtcaaatttatatcgttgatagctgctctgggagaagcatggtgtggttcattacagggaatcgctgatggtgttgttctggtcgttggaaccggaatgggcggtggaatcgtctctcaaggtaaattgctaaaaggccatcatttatcggctggggaattctccttcatcagaactaacaatgagtatgcagacaatgttgattatttgcttggtatgcaagggagtagttctgtattatgtaaaactgttgccaaagctaaagggcttcctgcagattctatgacaggtgaaaaagtattcaagctcattgaagaaggtgatcacacggtccaagcgatttttcaagaatactgtaggaacatcgcaacacaaattattaatttgcaaacgattcttgaccctgaaaagtttgtaattgggggaggcatatctgcaaatcctttactggttattactattaaagaagaactagagaaactttatctagattcgatcttaaattttgtgcgtgcagatattgagcaaagtaaattaggcaatgaagcgaatttgctaggtgctatatataactacaaacaaacctatcatcttgattgataacaaaagttatatttcgatgtctgatttatcttgtcctgtctaataaagaagcatatagtttacataatatatattatgtttttagtgaggtgaaatctgcaagtgaatcactcttatcaagtgtccacttgcagattcaagtttcactgacaatataaaatagcttatttttcagttgagaatatacgcatgcgtctatatttcattttccgggggagattcaatcatcagtccttcgacatgcttacgtcccagcagttttcgttttttgcggttttccttggtttctaaaacaatatccagatcatagtcgtcaggatacaattcagtagcagcgatgtgaaggacgagcctctttttgttcatggttagcttctgtccttggatcaaaatcccgacattacctcgttcatcctcggttttgtatacaattccagttcgatccagatagcctacataaacactatcgccaagggcaaaaggcttggttttgagaggaatttcttgtttaccccgttttgtgaatgtctggtctaaagcctcttttttagggaaaggcttatttgcatcatcagacttttcatcatctacagaagggggaataacaaacgattcctgtgtattccgagacgctctgcctgcagaaatggcctcagaacgctcgataatacgtgtccacatgcccagcttcaaggcaattgcatatgcatagctttctccggcctctccaatgcgaagtcggtacaaaggttgtagcgtttcggtatcaaactccatacgagcattctgaaatcccggtgtgttttcagcaaaatgcttgatttcgctaaagtgcgttgtagccactactgtcgctcggcggcgatggaattcttctagcaacgcgatagagaggcctactccttctcctggatcggtgccggatgccatttcatcaatcagaatcagagtagagtttcctgttgtttctaaaatgctaatcatgttgcggatgtgtgcagaaaaggtgctcaaagcatgttcaatgctttgtccatccccgatatctaccacaatttcctcgaatacagccattcggctaccatgcaaaacaggtaccagtagcccagattgcaccattagtgttaatagaccgacgcttttaagtgccatcgtttttccgcctgtgttcggtccagtgatgatgagtgaggaatatccttcaccaattgagaaatcaagcggcaccatggtattggacatcaacgggtgacgtgcaccttggatgtctataatcccgtcaaggttaagttcgacaggaacagcatccagagtcatggcgtatttggcttttgccaataaaaaatccagtacacctacagtctctgtattgatgcttagttcccggttgtatgactcggccattgccgtcaggtctcccagcactttcatttcttctttagattcttctgccatgtttgcgctctgatcgaattgcagattcgtgatttccgcaggttcaacgtaaaccgtctgaccacttcccgattcatccagtacattgcctttcacttgtttacggaattcttttttgataggaagcacgtaacggccattgcgctgactaatcatattttcctgcataatggatcggtgacggcttgtgagagagtcaagttttctcttgatgcgttcttcagtaaccgcaatttttttgcgaattttagctagttctttactggcgatatccgtcacacgtcccgaatgaatacatctttcgatttcggatagaagtggctccatgctatacatggaagatgcataagcgctgacggttggagcagcgtccgccttggaatgcatatattttatgagttgaatgcagcttcgaatgaattgagccatatgagaaaaatcacgttcgctgaacatatacccggttccgagcagttgaagaatgtgctccattccttccaacgaaggaacagggacgcttgctccgtggcgaatgatctgtaacgcttcgttggtttcgtcaagtcgaatcttaatggtacggatatcagtaattgggcacatagaagcagcgtgatgcttacccagataagaaaaagcacattcggaaactattgttttaatttgatcatattccaaacgcagcattgtagtttcgttcatgaataaatctctcctttaattgtgtagtgtcaggattttggaaaacttgctattaaaataaaaaagggcggagaatgaacaaaacgttcattctccgcccttaaggaaagagggaatttatcaacaaataagcctgttatacagcttttgtagttccgagttccgtgtttccaattcattcacgtaacagctctttgctaagctatttggatcgaatggaaaagggaagttacaaaatctgaaaacaaaaaaccgcgctgaacacagcacggaataaggcctggatgaagataatcccgaaggcgatttatgatatccgcatgttcttaactaatatcaggataacaacacagcaagaaacaaacctgtccccgaagggtgcaagtgcctggtgttactccctgaatatgcaattgcttagttaagaacgttcaccgacatcaaaatctctcccttaattgaagatataaccatactatacgattggacaggcgttgaagtcaaggccgacttctttaattcgatgtaatggggatcataatgttaacataatgtatgttatgtatacataatatcaatgtcttttaaatgagaatgatgatcattataattgtaatcaagagcatgaagaaagagagccataatccgtatgaaatcatgatacaaacattaagaaaccgccccggaggatgctatatcatatctccaggagcggttccttgtgctgttattcagaatcatcggctatgacagcttgtacaggctgcctgtcacgaagcaatggtaacaacagcatcgctccgaccaaaaacaaaccggcgctcacggtatatacagtgttcagggaggattcgtgtttgagtgttccgccgatactcataccgacgaccatcatcccggagaacaggggagagagggcaccaccgacgcggccgataaaagcagcttcggcatttttcatcatcatcgtgttgataccgatatgaatgcaaggataaaataggccgctgaaaacttgtagtgccatagtcaacacaatattgtgcgaccatccgacaccacaggttgtcagtgtgctgaccaagagtccggctaccaggagcaattgcggctgtacttttttggcaacccccataatcaggccgcctcccaccagcatagccgctccgttcgccattaatggccattgcaggaattccttgttttgtccaaggttctcgatggcgacaaaaatcattaatggttgaataagtccaaccgccagtccaattacagtaaatgttcccccaagcgtgcgaagtgtgcggttattccatacataacgtattccttctttaagctcttgaatgaaatgagtgggttgatcatctatctcaagtgcttgttcatcttggggaatacgagtcaagacaagtgccgaaatgagaaacaatattccggttatagacattgaaaagaaaattccaaagtgttgataaataaatgtaccgataacaggaccgataaccataaataatgccatgagagattgaaaaagggccatcactccctgaagctggtctggtgctacatgctgcttaaatatcttcattgcagacggctgagaaaattgagatagaatggccgaaaagaaagtagacagcaaaagcatctgccatgacccgtaccatagtgccaacaagacaataaaaatagaggccgcggatagcaaatcgcaactaatcatagtccgtttgggccgccagcggtccgcaaatgttcctccaatgatagcgaacagaaaaataggcatgaattcagcaaccgaaatgagcgatacgtagacgggatcattatgagtcaaatctgttacatacaacagtatggcaaagttgcgcacccaaatgcccaaatttaacagcgcattggaggagataatggtccttatatatggatttttaaacaacaacaaactctcctttcctgttttcaaggcgcgaaccccttgcaatatcgttttatataaacaaaaattatttttgtctacaaaataatagataatataataaattaactattgtttagtcaaatgtttttttgaaaccaagaagaaagtagagcatggaaataaagaggtcaatgatccttaaggacgtgaattagaatagtgataaaagtactcactttaaacttgtgagttggtaataatatctaatcaaaaaaaggataacataatatatattatgttaactaaattgcttgtctaataatagggctttgaatccgatgtaccttttaaaatcatagtgatataattacgcgtacatgcctgaaaaggagcgaatggaacataaatgaactttcaagtggattttttatctttttttgtaattcaggtagatggaaaagaaggacagggtggtaagtcctataagcattacgctacaatggacgactacgattatgacgaaagcgatgttaaaaaatttttggacggggaatttactcgtattagcaagcggaaggttgaaaaaaatcccagcacagagcaggcaccgaccaaaatcggccgctttatcgtcgaaccggagcatgaattgagcagtaatccgaatttcaatatgttcgcccgactgcgggcagcagaggataaggaagattttaaaaatgcttgtgacgatctggtgcggatgtatctggatacgagcgcagtacgcggcggagcgctgatcattgtacaggctaccttgaatacacactcggatgatccgtttatttttgtgcttaaatgtgattttgaacctaaaattgccagaattactgaaagcagtctggtgagtgaggtcgaaatggctatttctgcccgtaatatgaaatccatcatgtatccttacatgcttgaggaggggatgaacgatgagtgggagcttaaaattcaccagtcttcgcatgcccggtattttgaagattttttgaaattcgtgacctatgagcaatccatgcccgaaattgtcaatgagcatgtcatgggcttcgttcagaactatgtagaaaccaaatggccggatgcatctaatgaggaaagacagcaggaagagcgtgatctggaattgtgggcggctagcgaaaaacgggatttgcaagggaaatgggaaccccttcaggtcgtagaggctgcacagcatattgtcgagctgaaaccagaaattgaagttcgttttaaactagatgatacggccgtgcgtgggctactgtccgactttggcgccaagctgcatatcacgaaacttcatgatagatatgcacttattattgaaggcgatgcatttacgtttgaaaagggattttcaccgattgagttgctccaacctgaatcgtttgaaacggtggctgagcggctaaaagagaaacgccagcatgaaattgaggatggcgatacgccaccttggtaattcgaatgcaaagcaagacgacaaactgaacttttacattataatgactaaaataactggcctctcaacggatattaccgctgtggaggccagttttgtttagcttttatgttcccaatctacatatgaactttgctaatttgatctttcagcttgtccgcagattgaagcaacctggcacgttcctcgtcattgagcggaagatccaaaatttcacgtaccccattgtgatctacgatacttggaacacctaaatatacgtcagatactccgttataattttccagcaaggtggacacattaagtaccgacccctcgtccccgagaatggcggctacgattcggtcgagagccagcccaatagcataagaagttgcgcctttagcatctataatttcataggcagcattcttggtattttcaaaaatttcatttttcgtttcttcacccagttccagcggagttccagctacgttggctgtgctccatacaggtaactcagagtcaccatgttctccaataatatgggcgtggatgcttcgtggatcgatgcccttttgctttccaatcagatagcggaagcgtgcgctgtccagcaacgttcctgatccaatgactctgcttgaaggccaaccactgcgtttccaagagatgtaggagagaatgtccactggattggttgcgatcagcaaaatgccatgtgtattgaccttgacgatattatcaataatactttcaaaaatttcggcattacgcttcagtaaatcaatgcgcgtttctcccggcttttgtgaagcgcccgctgtaacaataatgatatctgcatcacggcagtcttcataatcacctgcccacactttgacaccaccgagaaagggaagcccatgattcatatcgagcatttcccccttcgcctttttgacgttgacatcaataaagacaagttctgacatgcgttggcgcagcagtagggtatagccggttgttgtgccaaccgctcccatgccgacaatggccactctacttcgtttgtaaggttttaagctcataaaatcctcatctccttctcgggttgaataccttttcattttgggctatttcttaaaattttatctttccaacttagtgtaccgtatatatttacccaccgcaaagaaatatgacatttttccttgacttcaaaggcgagctcgctaataattaatcgaatgataagaacacgcactaaagcgttgcagcatcgatattgacgcatgaaattatggaaagaggattcggcatatggacttatttcgaaaaaaaacaggactgctcccgcatgaggaaagcggatctacaggtcacttaaagagaacaatgggtgcctttgatctcaccatgctaggtgtaggatgtattatcggtaccgggatttttgttattactggcaaggcagcagcagaaaatgcaggtcctggattgatgctctcttttgttattgcaggtattgcctgcgtactagcagccttgtgctatgcggagctatcatctacagttcccgcagctgggagcgcttatgcgtatagttatattgtatttggagaaattttggcttgggtactggggtgggacctaattctggaatatggagtggcggccgcctctgtgagtagtggatggtctgcatactttcaaggcttgctggctggatttgatgtacatttaccgatggctttaaccgcagccttcgattcgaccaagggcaccattattgatctaccagccgtgtgtatcattatgctcatcacattgttactgagtctcggagccaaggagacggtccgattcaatttaataatggtttgtgttaaagtcggagttgtattgctatttattgggatcggtatcttttatgttaagcctgacaactggacaccatttttgccttatggattttctggtgttttgagtgctgcggcaatcgtattttttgcttatctgggtttcgatgccatctcaactgcagccgaagaggttcgcaatccgcaacggaatatgcccatcggcattatttcttctctagcgatctgcacagtactgtatattgcggtttcagttgtactaacgggaatggtaccttatacgcagctgggggtaagtgatcctgttgcgtttgctctccgctttattcatcaggatttcgtagccggattgatttcagtcggtgcgattgcggggatgacgaccgttttattggtgctcttgtatggtcaaacgcggttaattttctccatgtcacgtgatggccttttacccgtttttttatctaaaataaatgccaaaactcaaacgccaattcgaagcacttggttggtgggcagcattatcgcattggctagtggactgttcccgttacatgcactgaccaatctgacgagtattggaaccctattcgcttttgctgtggtatcggtaggagttatcgttctgcgcaagaaacgccctgatttgaaaagaggctttaccgtgccgtgggttccgttgctcccacttttaagtgctttggtttgcatcggtctgatgcttcagcttcatattagcacctggattggattcattgtgtggctcctgcttggattgttgatctatttcttctatggataccacaaaagtttgttgaaccgtaaatcttaataaattctagtataaaaaaagccggcatcctgcacttttgtgaagggtccggttttttttgccattacgcgaaaagtgtcacatagaggcgtttatggtataattctgtttcagataagcttttggcacgtgattacagcatgccatcgagggaggatttttatatgaaactgcgctggcgtgcgctcttggggggagtactgctgctgacgggcattctactgactgcctgttctgctgaagccccagatacgttaactaaacctccgattgaggaaccggatgaccagggtcagacgattacaattaatccaccagtgactccaaaggtgggcgatcccaacgccaaatatgtagtacagacgcgaatagcggattttcatttaattgataacaataaagggttagtttggggggttacccataatgagctccggctttatgatactcatgatggcggaaagacatggaataatatttccccctccgaaaacgtccaatttcaagacaagcttgaatatggaaaggacatcagtttcactgattctcgtcacggttgggttgtccgtcaaaatttggacaaaacagcaaccgtcattctgagaacagcagatggaggacagagctgggatgtttcagcgcttccaagcggggaccatgtgagctcgattcaatatgtaaatccaactactggctggatcatggcatatgtaaatctgaatgagcaggatcaacaaaaactgttgtatcacaccactgacgggggagccacatggaataaagttgcgcaaagttcgggtatgacatccaacaaatcaggctcaggtttacccgatcggggcagcctggcggggatgagcttttcttccaacaatcaggggtttgtagcgatcaatctggataacagtgttaagttttacaagactttgaaccaagggaaaacctggactccggtagctaacagaatacagggctgccctcaggccaaagcagaagcccagcagtctctgaaagggagcagtgcctcgtactggattccggttctttgctatggggataaggccataaaatataacggactgtttacaaacgatacagggacacaatggaacggtgtgcctttgggtctgagtagcaacattaattctattatccctggccgtacgtttctaaatgaaaaggaagggtggatcataaccgagaccggaatgagccgtacaatggatggggggaagacgtggacaagtctcacaggcaacaaagtgctacctttgaagttaaaagactacccacgatcggttaagctccgtttcgcttcttcttcggtgggttggcttcttttggaacgccttgatgacaagaagtcactgctgctgaaaacgacggacggcggtgcgaactggagaattttataatcgctataaaggtgattgccctgggtgtttttcccagggcgttttatttttaaaaaatttaaattttatacgactatatgtgaaaaaaatcacaaactaacaaataagccgctgttatactaaacctgtaaacaacgataggagtgataatcatgagagcgaatcaggatcatatgttaacccaatactaccttcaattttgttatacttgccaggatgcctatggttgcacgactgaagaggactgcaagcagtgtgcagagcgttacgctgaagacgaaaatcatgaagttctggatgaaacacaacgttatctccagcttgtacatgtgtaaatcgatgcatcattctgatatcgccatatcttgagccctcccggataattccgtgggggctcttggcgttcttaagggttgctatcaaatttgggcaggaacatacatatactgttatagaaagcttaggtcaggtcaggatgcccggtagtttccctgtgaaatgcctggcggagaggagtgcggtgcatgggttttgagtcattatggatgttcgattggctgggcacggtactgcccgtatttttcgttgccgtgttgggtattgtcgtgttgtctgcaggcagggaagtcatggaatggagtcggaataaaaggcagcctgtattgacggtcggttcccgaattacagccagaaggacacatctccaacagaggcggcaggaggaacaagggactcgtacctatactttctattacgtaaccttcgaggtggaaagtggcgaccggatggagtttaaggtatctggggaagaatatggtcaatgcgctgaaggggatgagggacggcttacttttcagggtacaaggtatatcgggtttcagcgtcttaatcgctatagcttggaacaggttaaaatgtagaattcagtctaattattttttggattcatttacagccttctgcgagatgccagggtagagggctgtagatgtttcttgtacagcacattttggtacatatatactagaacagtgtagttcagaggaggaatgatttgtgtcatttgagggacaagttgttattgtaacaggagcggcgcacggcatcgggagagaggtcgcttttgcctacgctgctcagggtgcccatgttgtatttgcggatcacaatgaggaggagggggccgcagccgctgcagcggcccggaacgagggctatcaggctatttttattccttgtgatgtgcggaaggaagaagatattgtagcgctaatccgtgccacggaagaagaatacggtacgattcatacgctaattaacaacgctggcgtgtccaaatggaaatctccttatgagttaacgatagcagaatgggatgacattctaaatacaaacgtacgcagctgttttattgccactagggaagcggctaaggtgatgaaacgaaactcagaaggtggctctgtggtcaatatgacctctacacgagctttcatgtcagagccggatacagaagcctacgcggcatccaaaggagcgattggggcccttacacacgcgatggccatatcgctaggaaaggacgggattcaggtcaattgcatcagtccagggtggattgaaaccggggattatgatcaactgcgtgcagaagaccatcaacagcatccgtctgggcgagtaggaacccctaaggacatcgcacgggcctgtctgtatttgacacaacccggcaatgattttgtaacaggcacgaatctggtagtagatggtggcatgacgcacaaaatgatttatgagccataataaaagcctgaatgagtagtcccagtcttggggctattttttttatttttctggactgtcacccattgggcatttgtaccatacgatagggtatgtgatggagaagcgaggaggggacgcggtggctgtaatcaagaccaactcagaagatgtaaggaccctcgcccggctgatgcgggctgaggctgaaggtgaaggcgagatggggatgctcatggttgggaatgtcggtgtgaaccgaattttatccaattgcctagatttccgggggatacgtcttatgaatgacatggtgtttcaaagccccggaggttttgaagccactcagaaggggtatttttatcagaaagcccgtgatcgggacattcgacttgcccagcgtgtaatcaatggagaaaagctacatccggcatccaatgcattatggttttttagaccagcaggaaactgtccgggcacttggtatgaccagaccaataccggacgttttaaagcccactgcttttttagcccgtctgtacaggattgtcctaatgtatattagacactttacagaatggcttgaagaattaaattaaaaccattttaggaggaatttacatgatttcacagcaagcttaccgtcccgtatcttatgcttccggcaacggatatcccgaatggccaagagggatggctccaatgggaaccatgcagccgcagcctatgactggctttccacctcaagtaagtagtggcagccctatgacaccaacgggtaccgtagtgcaggttcagactccgcaatacgagcaatcatacatcgaaaatattttacgcttgaacttaggcaaaacgggaaccttttatatgacctatgaaaataaccgggaatggaatgcgaaaatattcaaaggcattctggaagcagcaggtcgggatcacattattattagtgatccggcgacaggcaaacggaccattctgctgatgctaaacctggactatgcaacgtttgatgagccattgttgtaccaatatcccggcgtcatcgggaatccgggtgcatccccggttcgctgatgccttcatatatatgagtctacatcctctgccagacggcaggggatgtattttgtttataatctttctcaaatatagtagctttcttgatggtaagcggcgaaaacgagagctttatgacctaaatgataggggggctgttttttctgacattgcttgtggtttgactgtatagagtatagttatataattaaatataagctgatgaatgatctaatcatttatgcggaatatggctttagaagccggaaggagtgaatgtgttgggaagttgacgctgcttatgatgtgttatcgttctgtctatgatgaaactatccgaaggaggtgcgcctgtctgccgtaatgacggctgatggggagcatattgagtgaccctttaccgagtatgtttaacttatttattgtttttgcattagtactattgaatggtttttttgtatctgcggaatttgccatggtgaaggtcagaggcagccgtattgaaacattggtggaagcgggcaataaaaaggccgtgtacgccgccaatatgttacacaacttggacgcttatttgtctgcctgccagttgggtattacactagcatcgttgggactaggatggatcggagagccggccatcgcacatttgatcgaacctgtatttacagccgctggattaggagcggtatatgtgcacggtactgccgtggttattgcatttattgttattacgattctgcatattgtgttgggtgaattggcgcccaaaacgatagctattcgtaaatctgagaccattacgctgtattcagccatgctgatgacttggttttacaagttgatgtatccattcatatgggcgttaaatggaatggcgaacagcctgctgcgtttattccgtctggagccggtatctgaaaatgacgattccgcgcataccggagatgaaatacgcattctgatgaaagaaagcaataagagcggactaattgataatacggaattggcgcttgttgataatatatttgattttaccgacacgaccgccagggaaatcatgattccgcgaactgagatgatctgcttatacagtaatgagtccacagaagaaaatctcgcgattgcgacggaaagcatgagaacccgttatccaatctgcgccgaagataaggaccatattatcggctttatccatattaaggaccttctacgggcgaacacactggatacccgtacgatgattcgaccgattcttgctgtcccggaatctacgcaaattagtgatctgctcaaacgcatgcagcgcagcaagacgcaaatcgccattttgattgatgaatatggcgggacatcgggtatggtaacactggaagatattatggaagaaatcgttggtgaaattcaggatgagttcgatcaggaacgtccgagttgtgagcagattaatgacgaggaattttccattgacggcatgttattaattgatgaagtgaacgatcgctttggactggatctggatcatgaggattatgatacggtagggggctggctatactcacatgtcgaggttattcctccacagcctggccagactgtagtgtttgagggatgtatgttcacggtagaagaagttgaaaacaagcggatttcacgtattcggctgacaaaacagcctattatcttggaagaagcaggagtctcataacggaatacggaataaatcttgagagcgaccttgaacgatgtggggtcgctttttaatttgcctcctttacagaaaggacatgaattgatatgatgttcgtgttattgtcaacctaattataatcgactgggttgacaataacaaaaaaacttcctctacgttgaaaatcttatccatttacatgatcattaaattttgggaggcaagaagtatgaatttactaaacgaggttatagattggggcttgttggctgaaaaagcgatccaaggcagccgtatatcgctggaagaaggtatggaggtactggaagccgacgatgaggaattattaccgattatgcaagctgcatttcaggtgcgacatcacttttatgaaaaaaaagtaaagctcaacatgatcatcaatgccaaaagtggcctgtgcccggaggattgcggttattgctcacaatctatcgtatccacggcgcctgtgagcaagtacagtatgctggacaaggaatcactgttggctggagctagggaagcagtagcgcggagagcagggacgtattgcatcgtagcttccggcaaaggtccaacagatcgagaactggatcaggtgattgaggcagtacaagaaattaatcgcacgatgccgctcaaaatttgcgcctgtttagggattctcaagggagatcaggcacggcggttggcagaggctggggtacatcgatacaatcataatttaaatacaagtaaggccaactatccttcgattacaaccacacatacatacgatcaacgcgtcgaaactgtgaaaatggctcaatctcacggaatgtctccatgctctggcgttattatcgggatgggggaaacgaatgaggaaatcgtacaaatggcttatgccttacgggagttagatgctgactctattccggttaactttttgaatccagtccctggaaccccgttggaaggagcaaagcgaatatcacctatccaagctttgaaggtgctagcactgttccgcttcatctgtccatccaaagaaatacgcgttgcaggtggacgagagttgaatttacgctcgttacaaccgctatgcctgtatgcagcgaattcaatttttgtaggagattatttaacgacagaaggccaagaggtcacatttgatcatcaaatgattgaagatcttggtttcgaaattgagatgtgtgccctttcaaccgtataatagaaattgtacaaacttggaagggagagttaaacgatgagcgaaaaagtatttattagtcccggtaaatatgtgcaagggaaaaatgtgattgataaaacaggtgagtatgttaagccattaggtcatattgccttggttattgcggacaagctggtttgggagatcgcagccgaccgcgtagtaaaaagtctggaacaggctgatattacggcggttaaaattgagtttcaaggggaagcatcgaaaaatgaagtcaatcgtattgcggatcagggacgaagcgcccaggtcgatattgtcattggtgtaggtggtggtaaaacgctggatacggccaaagccgttaatgaactactcggttcctcagttgtgattattccaacgactgcttctacagatgcccctacgagtgcactatctgttttgtacaccgatgagggtgcatttgatacgtatacctttttcagtaaaaatccgagcctgatcctggtggacacgaaagtcatttctcaagcgccgcccttgttcctctcctcaggcattgcagatgccatggcaacgtggattgaggtccgtgcggtcattgaagctcgcgcaacgacaatggctggtggtttgccaaccttggcggcagaagccattgcgtccaagtgtgaggaagttcttttcgattacggtctgcaggcttatgaatccgtgaaacgcaaagtcgtcacacctgcgcttgaagcggtagtcgaagccaatacgttgctaagcggtttgggctttgaaagcggcggtttggcaggcgcacatgcgattcacaatggttttaccgttctggaaggggatattcatcacctgacacatggtcagaaggtagcttttggcaccttagtccagcttgctttggaaaaaagacctttgtccgaggtggagcggtatattgacttttatctaaaactcgatctgcctgtcacgctcgaagacattaagctacaggaagcttcccgagaggatttgtaccgggtagctcaggctgctactaaagaaggcgaaactgctcacaatctaccatttgctgtcacagcggatgatgtgcttgatgcgattttagcggctgaccagtattcacttgcctacaaggctaaaattggacataatagctaatctcatacgaaataaagtagattcaaaggtcgctgatcagcgaccttttttccattttttaacttgcaacttatgttataaggtgtatatcttgggtccaatcaaccttatgttcctgtgagtaaagttccgggctggagttgggcttttgtcgtggtcagcttggttataggattgctattttcggggattttcggtgtgtgtataggaatattgggcagcatgttttacgtgaaatcatctttatccatgcatcaaaccaccaatcgaagagttgtaaattgtcttattgtctttttcatcatcagcgtgatacaaattgtttttggaattgcagcgaattcttggattaacacgttgtaaaatagatctaacatagcatataggaagaagcaagaaggctctcacgcataaagaggtgggagccttttttgccgtgttagatcgcccaatttcctttacggaagataggttcctcagtaccgtcctcggtaacgccgttaatgtccatttcagctgaaccgatcataaagtcgacgtgagtcaggctggaattcaggccgttggcagccaactgctcttgagtcatatccttgccgcctttaaggttaaatgcataagcattaccgatggccaagtggttagaggcattttcatcaaacaacgtattataaaataaaatatttttatcagagataggtgacttgtgaggtacgagagcaacctcccctagatagtgtgaaccttcatccatttctacgagatgttgaagagtttccaaaccggtttctgcctgtacatcgacaatacgtccattttcaaaagtcagtgaaaagttgtcgatgatatttccgctgtagctaagtggcttggtgctgctgaccttaccgttcactcccgttttgagcggagctgtaaacacttcctcggtaggcatattggctacaaaagtatgtccctgttggttgacgctttcggctgctacccacagatgatcttttgccaattcgatggtgaggtctgtgcctggagccagataatgcagctttttatagcgtttggcatttaaaatatcagctttgctggaaaggattttcaaatgctctttccacgcctccacagggttatccagatccacacgcacggtgctgaaaatggcatcccacagtttatccatttgctctgaagctggcagatcagggaatactttggcagcccactctgctgaaggataagcaatcagagaccaactgaatttgtcggccatttgatactcacgatattgacgtaattcatgtgaccgcacacgctgggcagcagtaattcggctggacggaattccctgaagcaaatccggattttctgcaatgacatgcagtacagctgcgccattttcgacctcttcagtcatttcggctgcgtaccatttgggagcaatattaaaagtttcatcaggagctagttcatactgtaatcgagtaatagtctcatcactccattttactgtaaccagcttggccccagcagtatacgctgatttgacgataagtctcacgagttcggcggacaaaattggtgcatgaacgatgagtgtctgcccaggatggacattggcgccgacccgaacggctaactcggcatatttgtgcaatttttgttgaaaatctgacatgtaactttcctccatttcacgaaaagccttaaacaaggcttgggtaacttgcacagtttttttgcaaattccacacatagcttatatattgtacaatgtaacgaaaaggttcacaaatcagttttggtactatttagtgaaaatgaaagggcggatagatgaatgacagagcaaaattcacctcaggaagtgaaagaagtacatattcaacaggcacaaatgacaaaagatgagaatggtgcttatctgggccaagtggtatttaaagtagagggacagagttctgtatatgaaatcacattccacagcaaaaggggaaaggaatgggattacagtctccattttgcgggagagccacgggtggaggaagagatgctgcaaatggatagctggattgaagagaacgatgatttgttcgactatttgctagatacggcatggagcaaattacccgagtaatgtaaacatggtctattttcgtgacaagcggattatatttagcagtgtccgcatattctgctgacatgggggaagcctaaaggtcgatgttaacaggaaattccatgtgaataggagggtgaagctttggcaaatcatctgttcaccgaaggaatgacggcaaatgaagaggctgctcccgatctcctgagcttacggacgctgtttgtaaatatgtgttttattggggagccgggaagccgttcctgggtgctggtggatacggggatgacaggatttacagactcgattatacgcctggcagaggaacggttcactggccctccgatcgctattgtgcttacacatggtcattttgatcatgtaggttcggttattgagttggtacagcattggggtacacctgtttatgcacatcctttggaattaccttatttgacgggaatgaaggattatcaaaaacctgaccctagtgtagggggaggtttaatgtcgagcatttccttcttataccctaatgatgctatagatctcgatgatcgcatcacatcactgcccctagatggcagtgtccccggtgcccctggttggaagtggctgcatacgccaggacatacacctggtcatgtatcgctttttcatgagcgaagaaggttaatggtggccggtgacgcttttattacggtgaaacaggaatcggcactggccgttattttacaggaaaaagaaatacatgggcctcctgcgtattttacgacagattggcaagctgcgcagcgttcggtggaaatgctggccaagttaaagcctgagattgcagtcacaggacatggtcattacatgcatggtgctgagctgacagatcagctggagcgactggcgggagattttgagcacatggctgtacccaaacagggccgttatgtgtagtaatgtgtgaaggacgatgccttgcggggcatcgttttttgtgtggacgtggaatttttttgctcagcatggtatagtcaagccaaaagctaaacgctttcattaaacatcgtcatttcatcaaggaggattttttgatgacacaacaacatgctgcaattggtgatctttattatggaataccggcgattcgtcttaaatttggacgatatgaagcagttgccctgccgggaaacggtgcaaatctgatttcttttcgtgacaatgaaacgggatattcttttctgcgtgagccagatgctgagagcatagaggcttttaagcaaagcccgtctgtttacggaattcctttcctgttccctccgaatcggtatgaggatggaaaattcctgtggaatggtgttacatatgagctgccgataaatgaagaggcgacccacaaccatctgcacggctttttacacactgttcggtgggaggttgaggactacggttctggggagcaaggtagctatttggtaatgaatcagcatgtaagggaaggacatcccatgttccgctatttacccttcacctttaccatgaagttaacgtacagcctggacgaatttggcctgcatcagcgttatgtgatccataacgagggcgatcaaccgatccccaacttatttgcctttcacacagcgattcgcgttccgttcgtacccgatagctcgcctgaggattacaagattaaggtcacaatcggtgagcgtcgtgagctgacggaacggttgttggccacaggtcagttccagcctttatctccggaagaggaactgctgaagacgacgggagttagtccttattttgcctctatggataatcattacacggcagctccgcaaaatggacgcaactacatggaactgacacacagtaagacaggtgctaccctcgtatacgatgtaggcacagcttataagcattggatgatctggaataacaaagcgaacaaggaattcatctgtcctgagccgcaaatgaacatgatcaatgcaccgaatcgtccggatctgccagcagaggagatcggattgattgcactggctccaggccatatttttgaagcaaccagtcgtttgtattgtattacacctaataaatcgaaatcctaacatttaaatttatccttataggcctgtatcgtgtccaacggtgcaggctttatttgggtatgtaagcataggtaaggaccaatggggaaggaggacgaaaaaggttgcagaatgacaagcagtcgtagtatgatacgaaacaggagatgatcagatgaattttccttttcaagccgtcaaacgcaagcaaatcgccgatgaagtggctgaacagctgcaacgaaaaattgctgctggtgaatggaatgtgggcactaagattccaaccgagcccgagctcatgaagctattcggagtcgggcgatctacagtacgtgaagcggttagcgttctggtgcatgccggtctattagagaaaaagcaaggacacggaacttttgtctgccaaccgacgacttctcaagagccattggattaccgtctaagccgtgctgaaattattgaggtttatgaagtgcggagtgtgttggaactagagattgccagattggctgcattacgtcgtaatgacgtggatttacgcttaatgcgtgcggcgttggaccgtcgtgctgcaactttggccgctggagatttgactgggtacctagatgcggatatcacttttcacttggctgttgccggagctacacgcaataaggtgcttacagacgtatatggcagctttgtagaggccattcgcaaggcattgaacaatctcattaccgatccagcgatgcaaaatcattttactctgcagcatgaaaaaatatatgaagcaatccgtgatcaggatggcaaggctgccgaactttatagcattcaacatttggacggcaccaagctggagctgcaaaagcatatgggaagttcataatttttttatccttaaacatcagatgatcagatgaatataatgatctttgagccttttacttgagcatctcctaaaatcaaaccaaaggtggtatctgcatgcgcaaaatatgggtgttggacacaacgttaagagatggagagcaatcaccaggagttagcttaaccagcacagaaaaggtggaaattgcgcttcagcttcaaaaattaggcgtagatcggattgagactggctttccagcaacctcgcctggtgagattatcagcatgcaggagattgccaaacaggttacccaagcaacactggttggttttgcacgctcgaaagaacaggatattgatgcagtcagagaggcgctacgaggagctgaggatgcctgtcttcatttgttcctggctacctcacccattcaccgccaacataagctgcgaatggataaagcgaaagtattagagaccgctgctgctgccattcgttatggacgcaagtatttcagcaaggtagaattttcagcagaggacgccagccgtaccgagctggactttatttgtgaagtcgtggatatggcgattcgtgctggagcgacagtcgtcaatttaccggatacggtgggatatgcctcgccggatcagttcggtgaaatgtttagaattgtaaagcaacaagtgcccggtatcgaaaaaatacaacttagtacacattgtcatgatgatcttggcatggcaacagctaacacgctggcggccatccgtaatggtgtagatcaatttgaaggtaccatcaatggaatcggtgagcgagccggaaatacacctatcgaggaagttgcactggcccttgataccagaaccgagctttatagtgcacaaacgagtctggttttggaggagctgtatgccaccagtcgtctggtgagcaaacgtacggggatgtcggtaccgggaaacaaggccattgttggagccaatgcgtttgctcacgagtccggtatacaccaggacggaatgctcaaagagcgtacaacgtatgaaatcgtgtcccctgaacgtattggtctgaagacgagtaaacttgtgttgggcaagcactcgggtcgacatgcatttaaagaaaaactggcggacatggggtttgatgctttgacggaggaacagctgcaagaggcgttccgcaaattcaaggccttgacggataagaaaaaacaggtgctagatgaagatttgcacgtcctgatggacgaaagccgcaatgcctcacctcaaatgtacacactggattccattcaggtgtcttatggcaatcagtcggttccagtcgcatccattcggctgagtaaacaagatgggacagcaattgatgaagtagcaatgggtaacggttctgtagatgcgattttccatgctatagacaaggccagtggtgaagaggtggagttagaggattattcgatccaatctgtaacatatggcaaagatgcgttgggggaagtacacgctagtttgaggcaaggtgagtacacagctctgggaagaggcacaagtactgatattttggaagctagcgccaaagcttacatcgatgcgctgaacaagctactgggcagaaaagaagtccatggcaaaagcaatatcaccattagctgaactttgtgacccaggatagtagtcgaaatctccttttgcctcctctgacctcattgtaaaaaagcgcttgcaaaataaatgataacatttgaaatttaatgtataataggcaagagagcaccatattttgtctgaattacataggccaagaggaggaaatgagttgaactaccgcatcgaaaaggatacgttgggtgaaatcaaggtaccggcagaccgtctgtggggagcgcaaacacagcgcagcaaggaaaattttccgattggcttggagaaaatgccattagaggtcatacaggcgttcgcggtgcttaaaaaaagcgcggcgatcagtaactataagctgggtaagctatcacaggagaagcaggacgccattatttatgcagcggacgaaattctcgcagggcgggttgatgaccatttcccgttggttgtatggcagacaggaagcggtacgcagtccaatatgaatgtaaatgaagtgattgctcatctgggaagccaatggttacaagagcaaggaaaagatacgaagctgcatcccaatgacgatgtaaacatgtcgcaaagctcaaatgatacgtttcctacggcgcttcatgtagcgggtgtcattgcagtggaggaccgtttgttgcctgccactgataggctgaaagagacttttcaacagaagtcagagcaattcaaggatattataaaaattgggcgaacccatttacaagatgcgacaccgcttacgctgggtcaggaaataagcggctggtatgctatgctggacaagagcaagcgaattatcatcgacacggtgcaatacatgaaggagctggcgattggcggaaccgcggtggggacaggaattaacgctcatccagagttcggctcccgaacctctgcggaaatttctagtttcactggcaaaacgttcacttccgcacccaataaatttcatgcactgaccagccacgatgaagtggtggccgtacatggagcagtcaaagcgctcgcggctgatttgatgaaaatcgccaatgatgttcgctggctggcaagtggtccgcgtagcggcttgggcgaaatcacgattcctgctaacgagccaggtagctccattatgccaggtaaggtgaatccgactcagagtgaagcactgacgatggtcgttacgcaagtaatgggtaatgatgcagctatcggctttgctgcgagtcagggtaattttgaacttaacgtgtttaagccagtaatcatctacaattttttgcaatctgttcatctgctggccgattccatgattgcttttaacgacaactgtgcgattggcatcgagcctgatctcgctaaaattgagcacaatttaaataattcgctgatgctggtgacggcattgaatccacatatcggatatgaaaatgccgctaaaatcgccaaacttgcacatgcagaagggctgtccctaaaagaagcggcactccgcagcggactgttgactgaagaacagttcgatcaatatgttgtacctgcgcatatgattcatcctaaagcctaaagcacgacgatagtctctgcttaagctctataaaaaatatacaaaccagctcatggagtgcgatttagcacaaaccatgagctggattttttgattttattatataattttttatttaggattagtattctgtgtgatttgagggtatatagatagaaggcgaaaaattgaacatctattttcaagataggagaagccgtatggaacagacaaccgttattaatttgattgtacttttgctgtccggcttgctgctggtcggcgtgctgactaccaaattttccagccgtttcggtatgcctgcgctcgttttgtttattgccgtaggtatggtgctcagtcagtttatttattttgataatgcctttatcacacagctagttggcattctcgcgctcattgtaatcttgtttgaaggcgggatgcagacaaagtttgcagatgttaagccggttattcgacctgcattgtcattatcaacgttaggggtcatcattacgaccgtagtcattggcgtatgcgccaagtttattttaggcgtaagctggatggaatccatgctgtttggcgctattgtcggatcgaccgatgcggcggccgtgttttccgttctaggaggtaaaaacatcaaaaaacgaattacctcaacgctcgaagcggaatccggcagtaatgacccgatggctgtatttctcacggtaacattgattgagctgatacatcaccctgagcaatccatttggatacatatcttgttatttttatgggaaatgggtttcggtttagtcgttggttttgtactcggacgtatcggtgtatatgcgattaataaaatgaattttgattcctccggtttgtatcctgtgatggcgctggcatttgcggtcttgacgtatgctgcggcatcgttactggaggcaagcggattgctggcggtttatgtcatggccattgtcttgggaaattccgacttgacctacaagcgatccattatccattttaacaatggtttcgcctggatggtgcagattatgatgtttgtcctgctcgggctattggtctttcccgatcaattgctgggcattgcgtggcaaagcttggcgctctccttcatcctcatgctcgtggctcgtccaataggcgtattcctaagcttacttttttccaggtactctgtgcgcgagaagacactgttatcctgggcaggactgcggggggcggtacctattgtactagcaacctatcctttactggatgagatggatgtaggacccttgttttttaatgttgtatttttcgtcgtgctcacttctgcgattattcaaggtaccactatttcgtggctagcggtgaagcttggcttgatggaccctaacgagacgtcatctccttcactgctggaattagtttctctgggaaaaaccacttcggaaatcaaccacattcaggtacaaaaaggaatgtcgattgcgggcaaagcgattcaggatatacagttgcctgaagacattttattcacagccataattcggaacgagcaaattattgccccgagaggcacgacggtgattgaaccgggcgatacattgtatgtgcttagtcccaaactcaagcgacagcagatgaaagaactgttcatgctgctcgaaccagaggctgctccgtaaaaagcgtagagtacccttaattaaagtccttcacattcatgtggaggactttttcctgtgtttttttcagagtggatgaatctgttaaaaaattgacactatcattctacaaaattagtttatgatattgtcgttagatgtcgctgcctatcgttacggatcatttgatgggccatagtgatgaataagatagaagtcaccaataacaggagagatgatgaatgaaaccggaagtcttgccaaagcgtgcagtagctcgcaggcagaaaaatagaaaaaagaaacgaaaaggaaaattcggtcgttttatactgcggctgttgattgtattcctggtagcaggaatagggggtggtgcgtggttgttcttaacgtcatctggcaaggacatgcgctatttggctgcggatacgctgatcacgacacaacatcgtcactgggcgaagtactttatcggtgaagcagaggcgaaaaaacgtgtggcagaatattcggcccgttttgaagcgatgggggaggagaaggacagacatacaatcaatttgcctgatctgataccgaccaaagtacaacaaacgccgctggttgaagtggaagaggtatcgggccgtaactatcatggctatgttatgacggttcatgaccccactaaaattcggctcggggttcctgccaaggtcggccggggagaaagggtatctagtatggtcgagcgtttaggggctgttgctggcgtaaatggcggtggctttgccgatcccaactggaatgggaatggttttaaaccgattggcgttgtcatttcccagggtgagatatactacaatgacatgggcaaaaatgcgtctgttcaaatcgtaggtattgataaacaggggaaaatgatagccggccactattcgttgtccgagttgtccaaaatgaatgtgcaagaagcggttacttttcaaccacgcctaatcgtgaatgggaaaggtctgattcgcaatgcaagcgaggggtggggaattgctccccgtaccgcaatggggcaaagagcagacggggccattatattcgtgaccatcgacggtcgtcagcctgggtacagcattggtgccaacttgtatgatatgcaaaatattttgcttaaacatggagcggttatcggtgctaatctggatggaggctcttcaacggtgcttgtcaaggataatgccattgtgaacaagccttcttctgaatacggagagcggtatttgccgacagcgtttctcgtatttgagcatccagagaccgttagtatcccgaacatatgggaaggtctgaatcctggagacattaatgcagccaaaaagagatagatctggaatgaacaagtctattgagtgaacggagactgatgatgaagctaaaacgagcaggatttcagcgattgtttgtcgccttgtcaatgctatccttactcttgaccacaatgcatcaagcggttgccgaagctgctgaacagggtgccatagcgtctcaatcaacgcagttcatagatattgttataaacggtcaacctatagacagcaaggctaagcttctactgatccacggaaagctcatggttccgcttaaacctttcgccgaagctgtgggtgcaacctaccactgggatgtcaaaaagaagcaggtcacgctacaaaagtgggcagaacccttggttcttaaggagcgatcacgtaagaaccagcagcaaattacctttgagcttgtaagtaaagaagtatatgtacctctgagagatgtgtcgcttgaattaggttatacgctggagaagacaaattcacagattcaggttcagccagagattcatggtaaaataaaagaacaaatatacgagggggatctggccacagcgcgtgatgcgttaactcgtttaggcagacgttctgtccatccttatatcgaagcacaccgtcctaacactgagcttctgtccagtgtctacatgttcccccaaggtgaagcattacggtattttacagtgaacggggatgtgctaagtctggttgaagtgaaggacggttttccgattgtcacctatcaagggtatgtgggagctccttttgataaagaatttacaatggaatacgacccgctggggcgttttttggagaataaagccaaaaatcagtggggaacttatccgaaactaaataagccgctgatctacgagttcactacaggatggggagacagcagtaccactttctatgggcgtattactacggataaaaaagaagaactgctgggtactactggtgatccgataactggactcccggctaataccaaacaaattatgaaaaccttcaagctgccgtgggaatcgcgtaccgatgcccagcaggcgatgaaataagttaagagcagcaatagcaaatgaaaatataagaagcgcggatcgttgaagtaaagatacttccggtacgcgctttttttaatggaatttgtacttttgttgcttcgtgcttgcgtaaatatcgattaagcgtcattatctgcttcgagaaacacggagatcagaattcgtgcgttgttatctcccacatttttggcatagtgggggatagctgctctccagctaaaggaatcccctgcttccagagtagccgaatcctcgccttgctccacgtataccgtgccctccaagataaaatgaatctcatctcccccatgagcatgctcctcttctgtagacgagcctggcggcatgtccaccagcatcattttaacgtttccttgccctcccaaatgatcaacctggaggttgtttttaccatataaggttttacggcgctcgtccttgcgaattacttgcatccgttcctcatctttaagaagcagaaaagcgagagggaccttaagcgcattagcgatactgtccaatgtagcgatggaaggagaggttttattattttctacttgactcataaacccttgggatagtccggttcgttcgcatatttgctggatggataaatttttacgtttacgagcagcgcgtatgttgcatcctatactcatagaacgttcctcctttaaggaaatataatgtatactaatttaatatttatcataccaaataatttgttgacagactacagtttcttatgataaattcacattacaaaataattatttctattactaataattcgagtttgattcacactaatgtgttgcggcatcgattcagacaggattatttttttaaccaaattattagtaatataaattaattattcatatgcacttgtatgagtgtaataaacaaacagaatggagagataaacatgagttcagcaagcagaaacatttctacaattatgcgggtgacactgggaattttgtttttggcacacggaattgctaaattccaaatggggttgggtaatgtagcaggctggtttgccagcattggcgttccaggatttctaggttatgtcgttgcggtgattgagttggtcggcgggattgcattgattcttggattgcttactcgttatgtatctgggcttttggttattgttttgatcggcgccatttttacagcaaaactgtccggcgggttgatggggaatggtcaaggcgctggctatgagctggatattgcttttattctggtagctcttcatctggtatttgcaccaacgactcgcttgtctctggactctttgttcgggcgtcgtgagtcaacagaaaagtaatttttgattgtttagtcctccaatccatgtagaaagagggaaatctcatgacagcacatatacatgacaacaccaaaattgggcaggtttcattaaaagttagtaacttggagcgttctattcaattttatacagaggtggttggttttcagctactgcgtcaaacggcgaataccgccgaattgactgtcgatgggaagcatgcgctactgatccttaactatattgaaaatgcagttattctgccgcgtcaatctgctgccgggttatatcattttgctattcttttaccaaaccgtgtagctctgggcctgaccttacgtaatctgctggctcatgagattgaaatcggacagggagatcatgatgtaagtgaagccctctatatccatgatcccgataataacggaattgaaatctatgtagatcgtccccgtgatcaatggaaaaaggatgctaatggattttacatgatgggaacagatcccgtggatgcagaaaacttggttgcgatttccgaaaatctaccttggcagggactacctcagggaacggtaattgggcacgtccacttccatgtgtctaatttgctcaaagcacagcaattttattgcgatgtgcttggctttgacattacgtgccggtatggctcttcagccttgttcgtttccgcaggtggttaccaccaccatatgggcttgaatatatgggcaggtgaaggagccccaccagctcctgagcacgctgccggattggattattttgaattgatcgtaccagatcagaaggaattggatgccattgttgctcgtttagaggcagcaggctatggagtgcaagaacgcgagggcgccaagtatgtagctgatccgttccgcattcaaattaaactgattaacggtcaaatctcgtaacaaagaaggcacgtaacaaaaaagggtattcctaataagccgtaaaggctgggaatacccttttttcgtatacttagaacaagctccagtccaaatcccgagacatcttctccagcaagtgtacaccagctgtactgttgcccatacggttcagagaaggtccaaccagtccaatgccatatcgtccgggtaccatcgtcataatactgcctgatacgccgcttttggcaggtagtccgacttgaatggcgaattcccctgaggcgtcatacatgccacatgtcgtcataaatgttttggcgatctgtacatagcggcggggaatcagcggtatacctgtcactggatctcgaccattgtaagctaatacaagtcccatacgagctaaatcagtacagttcaatttgacagcacaatgtctaaaataaacttcaagcacatcctccacatgacctcttaaaattcctttttccattagaaaataagcaagggaacggttcaaatggcctgtagctgattctgaatcgtagacatcctgatcatattccaatgtgtcattgtgggtaagcaggcggaaaaattggagaacacgggcaaatctctcttctggactgttcccgcgaatcagagaggagactgcgattgctccggcgttaatcagtgggttaaacggaatgcccggttcaactagttctagctttagcatggaattaaaacggtctccggtaggctccatacccactttagagaagacaacgtcctctccattatccatcaaggccagaatgagcgtaaatacctttgagatactttgcatcgtaaattggatttccgtatctccggctaccacagtttcacccgcaccgttcattacgacaacacccagcgcgtcggccggggctttggacagctcaggaatatatgctgctaccttgccatgaatatactcatgacggctttgttctacccattccggcagtttggtctgtaatctctgccactccgatgtcatttcttttcctccagtcgagtaaccaatctgtggtattttattgtagagcaaaaagtagctatatacttattttaaagaaattttcagttgaaaaacaagctctgatgtcatttctttttctccagttaaatacccaacctaatgtaatatcggtattatggtttatcctctgtagtcttcattcacttcatccaactgcctatccgaaatcacttctaagtgccacacatactcttttttagcgttggctcataagaaagattcccatttttaaaaaaagttaataggagaaggagatgaagtggaacatgttacacggtacgttagcggattacccgcgggagaaaacgattcatcaattgtttgaagagcaggttgagcgcacaccggatcacatagcggttgtatttggggacaagcacttgacgtatgctgatctgaacaaacaggctaatcaactagcacatgttttgcgggctaaaggtttagataatgacgaggctgtcggaattatggtcgaatgttcattggaaatgatcatcggaattttcgggattttaaaagctgggggagcctatgtgccgattgatcctgaatacccgaaggaacgtatacgctatatgctgacggattctggtgcaaacttcctgctgacccagcttccaatccaccaacaaacagagctcgccagtgttgtactggatttgttggacaagcggaactatgggaaagaaacagggaatctcacatctaatcaaggttccgatactcttgcttgcattatgtatacgtctggctctaccggcgaacctaagggcgccctgacgatgcactacaatattatacgtgttgttaaaaagacgaattacatccaattctcgtcaaaagataggatattacaagtggccagtttttcgttcgatggttctacatttggtatttatggggctttgcttaacggaggcactctcgtattgaactcacaagatcaaaccatgaatgcacgtgagctatcaagcgtcctacggacacaacagatcacgaaatgcttcgtcacgacagcacattttaatgcattggtggatgtgaatcccgattgctttgcaactattgaaaccttgctattcggtggtgagaaggtttcagtcagccatgtgcgtaaagcgtttgcccgtctaggtccgggccgtttaattcatgtctatggaccgacagagagcacggtatttgctacttattacccgattgatcatttggacgaaaatgcaaataccgtaccgatcggcaaaccaatcagcaacacgaaggtttacatcttggatcaagaacagcatcctctgccgcagggagttgcaggtgaactgtacatcgctggcgatggattagttaaaggttatttgaatcgtccagagctgacagaagagaggtttattcagtcatcatgggtacctggaggcaggttgtatcgaactggagattgggtgcaagagcaagcggacggaaacatcgaatatatcagccggatcgacgatcaagtgaaaatacggggttttcgaattgagcctggggaaatagagtcgcatttattaaaagtagatgatatacaagaagcggcagttatcgcccgtgaaaaggaggacggtcaaaagcagctggaagcatactttacggcgaccaaaaaactgacagcagatgaaattaaaaccgctctctctataaagctgccaaattacatgattccatctttttatatacaactagagcaaatgccattgacactgaatggtaagctagaccgcaagacactgttggcccttgaagagaatatacatggtggtgcagaatatgtgtctccgaagccgggactggaaacgaagctgatggacatctggcaggatgtattgggggtgcagcagttcagtgttttagatagcttcttcgacctcggtgggcattctattcatgcgcttacattaatgtcgagaatggagcgtgcaggatatcacgccactttaacagacatttaccactataaaacgattcgggcactcgctgattatcttcgttcaactcagaatagtgttatagggtcccaaaagcagcaggacatcatagaaacaacacaagagttgatgtcttggcttcaccaagaaacagatggtgtttacgagctggtgaaataccaagtaagggattttattcacgaagttagagatattcaggtgctttactacgacacggcggccgacgtaaaccatatcatgcggatcatggatgggaaaatagctcaagaactactgcctcactacattgtaccactgcatcaaaaagctaaaatggctgatccatactggaccatggatgaagaggagtttttccagcgtctgggcttaaaaagcatggatctggatcaggcggcaagtttacgcaagcggctggaagacgattatttgagaaaagatcagtggattaaaacagggcaagtggcacaagaatatccgctaagtggaattcaacaaatgcaaatctcgtttcatacacctccaagcttaggtatatttaggctagatgagtgtgtgaattacgattttttggatcaggcttacgctctttttatacaaagtcaaggattactgagaagcgtcccggtccaaagagatggatggacttattggagggaatacgtactttctagcgatggtttgccaaagctcaacatcattgacgtgtcggattacaatccatgtggtcctattacggacatgataaatgattatgtaacgaacactcgattcgccggagaacatactttgttccacatgtttgtgctgaaacgaaacctgcgtgaacattatgtcattactatttatcatcatgcgatatgcgatcgggtgacctcggaagtagccgaacgacagttgattgcttactacaggagtctgcttcaaaatcgaccccttcctaaggatgaagtgaagccctatgtggagtatgttaaacaaatccaaagtggaccgaaaggaatcacggaacaagaattgatatcagcctttaatttggaagcgttccaaaaaagcaagcaaaacgtcttccaagctccgaagcttcgaacgagcacagaagcctacctgtttaacgtaagtatccctgctgaagatccttctttggagtttgcgctttctgtctatacaaagggcttgcaaacttatttaggtatggataagctaccattgttatttttatatgatggaagaaggtacgacgaggcggcttattataacacggccggtgaatttatcgattttgtgcctatgctgatggaactgaagcagaatccagatgaaatgatgcagtctgtcagaagcagactagatttattaaagcaccacacgattaattttatgcatctttttacgagtcctgattacaaagacaagtggaaacatgccagaacacttgcacagtttgggaagcagtacgagcaactagacttattcatgtttaactatttaggaaacagtgccaaagcaggctcaaaatacagcaattattatgatgatactgtcataaagcaaccaaatccgttgccgatctattcactgttcaattgcattgcttcttcctacacggacggccttattttttctatacgatgcagttacgagatagaggttaaggaagtcagggctgctttttatcaagctgcaggtatggcatcccggataggggaggtttaataagtgatggaatcagccaatacatcttatcagagttgttctgataggccgcgacgttacttgcctttattttctcaccatagtggaaatgccggacagcccgaaggccatgatcaagcgctttacaaaattcgtttggggacaagacaggtcaaaacgattatgggttttgtacagcatcatcagctgggtatgccttcttttataacagccatatggtccgtactgttatcccattacgccaatcaatatgctctgcctgttttatattccgtggtatcagacaaagaagggaaaggatgtcgtctggattatccactactcattcatatacagaaggaagatcatcttctctctttgatacaaaggatacaaatggaatggaacaaacaacttagtagcgacgagtggagagaggatttttcgcagcaaactaaagtcgatcctctattaggggggaagaaggatttcttcaatgtgggtatctcagaaatttatggtgactttccttctccaagtttaaatgtggaaaagtcccctcccctttacggtatagatcagccagaaatcgcgctctgctaccgttatggccaggatgtattggagtgcgcaatacagtatgatggcagtcgtttgggaaaaaggcaaatcgctagattcgcaggccatttcaaaacactgctggcaaatgcactccttcttccggagaagacggtactatttcaccccatgctgaccacaagagaacgcagacagatgcaacaatggaatgatacggaacaggcctatcctttggataaaactgtggttcatttgatcgaggagcaggctggccgaacacccgatgcaatcgctttagagtttggagagcagaagctgacctactatgagttaaatcaccaggcaaatcaaatcagccgcatgattttagagtcgtattcgatacagggacatggcgttctgccgaccggcacgctgattgccatcgtcttggatagaagcgcagatgtgatcccgtcgatgcttggagttatgaaagcgggcgctgcttatcttccggtcgatccccaatatcctggggaacggctgcgatttattttagaagatgcacaggcccaaatgattataacgcacagtcaattagtaagtaggctgaatccatatatttctcaaatggatatgggagcacattcgctgatttgtgtggataaatgcttggtacggcagggctactatccctacgaaaacttgaagatcaaggttaaacataatgatctggcttatgtcatctacacatccggttctactggaagaccaaagggaacgcttattgaacacgctggtctggttacgttggtcccttatcttgttgaaaagtttggtatcacctcagattcaagagtcatgcaattcgcctcgattagtttcgacgcttcggtctacgaatggatcggcacgctatcagtaggcggaacagtggttgttctgtcagacgaggaactgcctccttatgcagacatttcagatattcttgaagagaaaaatatccacattgccatgctgacgccatctgtgctgcgaacgatgaaacatagggaactgccaagtttgcggacaattgtatctgctggagaaccctgtacgtctgatattgtagactattggggaagaggaagacgattcgtgaacgcttacgggccgaccgaagtgacgattatttgttctacttctgtctgcagaccagggaaagaaattacgatcggcaaacccgtctataacaaacgtttattcgttttgaatccattcggcagtcctgtgcctgtcggcgttcccggcgaactatgggtgggcggtatagggcttgccagaggatatttgaatcgtgaagaactgactcaggaacggttcgttcacaaagaggttgtaatcagcagtgaaaatccaccacacagtgagcggttatataaaaccggggacattgtgaaatggacgccgggtggtgaattggtatttatcggccgtagtgatgaacaaattaaaatcagagggtatcgtatcgaactgggtgaaatagaacatcagctctgccaacatcccgacatcggtcaatgtatcgttcaagcctggaaagacgggtcctaccataaactggtggcctattatactgccgtagaagaactgaaagaggccgatctgacacagcacttaaactctgtattaccagcttatatggttccttcatatttttgttatctggagtcatttccagtaaatacaaacggaaaagtcgaacgtggagctctccccgatccgaggggcaacttatttattcaagctgatgaagtagtggaagcagacgaggacggtttcgaaaagcgcttgctttggatttggcggcagattttaaaaagaggagatatcggggttaacgaccatttttacgcggttgggggagactcaattcttgccattcaggtcgtatctatggcaagggatcatggtatcatgcttactccaagacaagttgcggagtatccaaccattcagaaattagctgctgtggttacttggacagacaatgatcaaaaggaagatctcagcgttgacttgacaggcgaatttggtttgacaccgatccagcactggtttttcgagcaacagtttgtagagccgcattatttcaaccaatctcagctgtttgtactcagtgattgtgatgctgtgaagctggaaactgccattaatcaattgattcgattacatccagagctttcaatggagatcgtagtcaaggaacatgtgtattcgcagcgctaccgaaaggatgcttccattcaactggctagctacacccttcaacaagtcgattatcccgaatccgaaatttcaagcatatgtgatacgtggaacagacaattgaattatgagacgggcgcgatgatgtatgcaggagtaattcaaggtcaccctgacggtaaaacccgtctgtttatgactatacatcatctagtcattgatggagtgtcttggagaatattggtccaggatttgtatcaattgtatcagggtatagcgctgcctactgttttaaatccatacaaaaaatggcattctgtattgataagttattctaaacataaagatactttacgtcatattgaatattggaaaaaggtgcagcatcaaaccgcagcatttgtgctgccagtggaccattccccggctcgtaaaaagagcagtgaatcttcggaatgggttacgatgcttactccagacgatacggaactgcttttgcaccattgctcccaagcttaccataccgagattaacgacctgctacttacagcctggtccctggcgctctccgcttggtctgggcagaagacgattgcgtttcgcttagaaggtcatggacgtgagcactttgtatccgatatagatctgacaagaagcatcggttggtttacctccatgtttccggtatgcattcagattacggacagttcccccttgggagcgacgattaaatctgtcaaagagcagttgcgttgtattcctcaccgcggcatgtcatatggcgctttaagatactgccatccgaatacagaagtccgttccgagttatcagcttctgaacctcaggctcttttcaattacttgggccagtttgatcaggggaatgtgagcgaattaaaccagtggttagggtttacaagtgacgcagcacaggattatagctcgccgcttaatcatggaacaagcctattggaactcaactgttccattgttcatggcaagctgcatttgtttatgaaatatagcaaacgtttctatgaagaagccactattactcagtttttagatacttttataacacgtttgcttgctattatcgaacattgcagccggattgaacaccaagaattcacacctagtgattttccatcagtgtcactgaaacagcattcgctcgaccagatcgtaaagacatatcattggcaatttggtttggataacatgatgtacctaagtcccttacaagaaggactgctgttccattatttagatcatcctagttccgatcaatactttgtgcaggttagttggaaatatcatggcaggctagatgtagaccgttaccgggaagcctggaacagcatcatttctgaaaatgatagcttgcggacttgctacatttgggaggcgttggacaagcccatacaatgtattgtccgaaatgtagaatgggattggacatttttggattttgaagcagagcaaccagagcagcaacaggagtgtatcgaacgctggatgacaatggatcgtaatcgccgttttgatctgagtcagcctgcgttccgcataacactgattcagaccgcttcgaatgaatggacgatgatctggagttaccatcatattttgctggacggttggagcctgccgctactactgagtcgggttcatgagctctatgcttgtagcctgcaaaaccggatgccacagcgcagcttgacccgttcttttgaaacttatattcgttggttaaacaataaggatcgcacggaggccgagtcattctggaaggcatatttggctgacgtaacggagccgacccatctgccgatagagaagggcatacttcccgatgtacatcaaccgattgagaaccagcagatcgaaactttttgtatcgattcgagacgaaccaagcggatcactgattttgtacagaaagcacaagtttcgctaaatacgttggtgcagttcgcatggggcaaagtgctacaagtctatcaagatgcggatacaaccgtatttggcatggtcgtgtccgggaggggatcggatcttgcacaatcggatcggatcacgggtatgctgattaatacgttacctttggtcatgcactggaatgtggagcaaaccatcactgaatatgtacaaaagctgcaccaaaccattcagaaactaaacgactacagctatgtgagcctgaacgaactgaatagctggtctggtattcaaggacatgtcatgttttacagcatcgtagcattcgaaaattatttgaacgactatcggcagcctgaaaatgaattgaagatgtcagctatggaggaacgagagaaaacgaattatccaatgacgatcaccgttgccaatgacggggaacagatcaccatcaagtttatgtatgatgcagatcgactgaaacaagaaacggtttgccgactggcagagcatctgctaaatacggtgcaatatgtgttggaatatccgaatcacaccgtcggagacgtttgctttatgaacaaggatgaatataaacgaatcgtctatgactggaacaatacgtatacagcatatcccagagaacgttcaattgttgatttattccaggagcaagcgaaactacggcctatgcagccggcagtaattgcgcacaatcaggttatgtcctaccacaccctaaacctcatgtcccagcacattgccaagatgttaacggatgatgctgatgacaacaattatggaaagtttatcggagtttacttgccgcgctctcttgaattcattgtctccatcctggcgatcatgaaagcgggatatgcctatgttcccattgaccccgattttccggcagcaagaacccatgaattaatcaaggacgctggactggacaccatcctcacttcacaggaaggagcggaacgtatctcggaagccagtaggggaatccatttaatattaattgatacagagcattttgaccaaaatggagtggtgaaacaagaagagaaggagaacatgattgctcccaatgaccttgcttatctaatgtatacatcaggatcgacaggaaaaccgaaaggcgttatggtggaacatcgcagtgtcattcgcttgctaaaaaacacctcttatttcccgttttcctctgatatcagattgctctatacgggttcgcctgtttttgacgcttctacgtttgaaatttgggggacgttgctgaatggaggacagctgttcgtagtttcaaaagatgatcttctaaatatccatgtgctggagcagcggatgaaggagtggagaattaatacactatggctaagttccgcactgtgtaatcactggattgaagaaaatgaaaagatatttgctggactccaatggttgctcataggtggagaaattttgtcagttaagcatataaatcgtatccggcttgcctatccagaactttcgattctcaatgtatacggtcctacggagaacaccaccttttcgacgagctaccggatcgaaaagccttttgagcagaatattcctattggcaagcccattagtaactcaacttgttatattctggacaagtggggtcgtgttcagcctgtcggagcactcggggaattatgcgtggggggagacggggttgcaagggggtattggcggcaaaaccaattgacacagcatgcgtttgcaccgaatccatatcgctctgccaaagatggtgaaagaggtacaaatttaattctataccgtacgggagatcgggcgagatggctaccagacgggaatatcgagtatattggacgggctgacgatcaggtaaaactacgtggctatcgaatcgaacttggagaagtcgagttccgtcttagcagctatcctctagtgaaagaatgtctggcctttgtccgggaggttcatggcgatttgcgaatgatcgcttactatacagcggaagaggagcaacgagtggagcagcttcatacttttatggctgaaggtcttccatcttatatgataccgtttcgttacgtttggctgaaatcgttcccattaacggctaacggaaaaatcgatcgcaaaaagcttcctttacctgaaatccatagtagtgatagagaagtaaatgctggatcgaagactgaattggaacaaacaatagaagaagtttggggcatggttctgaagctagattacattggcaaaaatgaagactttcatacgttgggaggacattcgctccatgcgctacgcatagccagtctgctgcaaaaaagcggatatccggttacggttaaccaaatatttcgcgaacagacgatcgaacgtttggccctctcattgagcaatgcaatgacggatacaacaactgtccttagtccaaatatggatatcccatatattcagtctataagaaaagcatatccggatgacggatttccgctatctgctgtacaaaaacgtttttttcaaagagatctcgtgaatcgtaacatgtttaatgtaccttacctggcccggctcaaaaattgcatccctacagaattgctgaacacgtcgcttgagtcactattgaacaaacatgcggctttgcgactatcctttgctcaactggaagatgatgaatggtatcagtttgagcagaaaataagtgtagaacaggtagtctcttacgtggatttgcacatggtctcgggatcacatgacgcctacatttcggaatactgctcgaaagtgcagcgtgaattcgatatcaaagaaggacccttatggaaagttgtgttgtttgaccattattgcgaagagagacaacaggtgatattacttctgttccatcatttaatttctgacgggatttccataaacatttttttagaagagttgagacatcttctcctgccgggaaaagggaatgatctggcgttacatgcggaggaggagggaagcagttatcgggattggtgcatggcgttgacccaatatgcggcgaaagacttttttcctaaagcatccactttctggagtaaggttgtggaaggcggccaatctttacaggttgacacggaatcggagatacagccacttcatcgccacatgagaactataacgtatgatttacttgaaggagaggagcatattcttcttctaaaagcattggctgtaaagcaccatactacgccactgagcatcttactgacggcattgtcacaggcttgtttccaattgaaaaagcaatcagatttggtgctgcatgtgatgtcttatcaacgtgagtcctttttgccgggtatcgtgattgatcgtacaattggttttttcgccggagcatatccccttcgaattcagatcccggaaggagacctgtccgacaattgggaagtagcactgggacatgtcgtacacacgttgcggcatattccatctgaaggcatggattactttattttacgtcatttgatacagaatattaatccaaatacggaaccactaaaggacggaacacacatgcttttccattaccaatcagaggaaatgaacgggatagccgatgagttgtacgagcctttatccatttcttacggaaatacgaacgccgcagacaatccctctgcttacaagctaaatataacagcaggtcttagacgcgatagattaagtttaacctgctattatagttcactacattataaggatcagacgatcgctgaactaatacgcttcataagcgaacatctgtgccaaagcatcggtgttcgcccatataccatgataggggaggggagcttcaaattatgaaagtatatgaattttgcccatttttcaatgaaaatcgcattgcagatattaaaataaaagaaaatgccggctggattgacgagctgcacgtgatcgaagccaacaagacgttcagctatttggataagccctgcaactttaatccagattatgtgggtcccaaggtgattcatcatccatttcaagcggatcaactgtttcgtgaacctgagaagcactcattgtacttcgatgtggatagctgcggcgcagataactttgaccgctggtactggcgtctgctcagctataacagtgcgttttataatgaggcttgccaaagaaacagaagttcctctatcttacaggataaagttaaagacgatgatgtgatcattttggctgattttgatgagatcattgacagtcggatggcggatcgtattgtttcggaagtgaagaaacatcaagttattacaattaaaatgcactattctgtattcttcctgaatcttttttgccaatctaatcacggtgctcctcattggagctaccgcgtgttcgccatgaccggtcggtacttcaaaagtatgcctttctcacccgactatctcaggaagaagggaattgctgaagcgttatatcatgacatttattgtctggaggagccagctggattccaccattcatggcttgaatatcaaaaaaccgcgcttcccaaactgcaagcttttgctgccaatgtagaagataaaagtatattaaatgcagagtatattgatcaatgcttacatgataaaaagctgtactatatcgataccgaactttatgttgataactcaaaatcgtttttgagcagtctacaggaacttgaaacagatgatctttggtataagtaaaggaagttagattagctgcctgagaaacccggttcacacaagatcagggtttctcttttgctttttttcaagctataagggggagctacgccaattgggaggagtaaagcgaaaagaaatcaaataaaactgccgacgagatcggcagtttagtttaaagatcttctgatgatcaggttattcatcggaaggttattttgctatgtaatcagaatcaatagtagctgtttgaattcaatgaacttatgatggcaggcaacagagcaacagccataatgatatagatcacaattacaatagctgcccaaagaaggcctgctttagcatagttagctttactcggattagtcgagccgctaaatgcccacacaaacagcataataagtccaactaccggtatagccatcagaagtaaactgatcatccactccttgaatgatacaggaggcgggtaaacaggggctggtctggatggtgctccttgctgattgaattgcggattaaactggttagacaattagatcttctccctacgtgattagtatgttgtgtttcctatattgaccaaaacatcatacatgatatgacaataagcaacaagtgaaattcagtaaacagtctaatagtactatcaaatgattaaaaataggactatacaccctattgacgaagcagtttttatatattactgtattgatattaacattttgtttttatcaattaattcaaattaaaagttacatagagaattcgtcacttttgaattaacagcgacaaatgacccatatatgaacaggtaggtgaggcaagtgacagatggatcgaaacataatcacagtggcttgacggaagaggagttcttggccctgtatgatgcgaatgaatatgagcacccatccgtaacggtagatatgctgctatttacggtaatggatcagctccaacaaaattatcggaagctgcctgagaagaccctccagcttcttttgatccaaagaggggagcacccttatatagggcaatgggcgttgccgggggggtttgtaggtatagatgaaagtctggaagaggctgcgcgacgcgagcttaaaacggaaacgaatgtggatcagatttatatggagcagttatatacttggggagatgtggcacgtgatcctcgtatgcgggtaatcagctgcgcttacatggcattggtggatcacgattccttggaggtactggcgggggatgatgctgatgatgcccaatggtttgagctggattacagcgtagctcaggagacgcggacgaagcagccggaaggttacacatgggaacaagacattgacatcacattgaagcatggggacatccatctatcagccaaagtaaaaataactgaaattcttaagggaagaaccattgaaatcaagcgagaggtgctggagtcacaaggaattgcttttgatcatgccaaaattattgcatacggtatagagcgtctgcgcagcaaaatagaatacacagatatcgcatttcacctgatgccagctctatttacactgagtgagcttcagcaggtgtatgaaattattctaggtaaggagctgttggccgcagcttttcgtcgcaaaatagctgatctcgtggaagaaaccaatgagtatagaaaggcggctggacatcgtccgtccaagttataccgatttaagcctcggtcgcgttttatgtagcataaggaatatgaaatgaggaatctttatggaaaagtttacatttttttatcgcagtcattcgccattttcgcaatggtatccttctgattttgtcgtggatggattggagtttaactgtgccgagcaatatatgatgttgaaaaaagcacagctttttggggatgaagaggcggccttgaaaattatgcaagcacctaccccaagggagcaaaaagcccggggccgcagtgtgcgcggatttgaccaatccttgtgggaggccaattgccggcaatttgtatatgacggtaattacgccaagtttacacaaaatccgaatttgctcaagcacctgcttaaaacgaaaggaaccactctggttgaggctagtccaaccgacaccatttggggtgtaggcttagctgagagcgatgctcgtatacggaaccgcaagctatggcgtggcacgaactggcttggggaaatattgacgaatttacgtgaggatgtattgcaaaaggaggaatagtcaccatgagaaatacaatgaattcccggagtaaccgggatgcacgatcacatatggcgcaggagacactacccattttggagaatggatattacacgaatatcaaacaggttcaagtaaatatgacaaaagagataggaaatgcggtcataggctcgaagttatatacaccttctcaactggtagctgtaaagcaagaaacagagcaaagaataaaaagtatattggggccttcttcccgcatagaagaacagacgattattgcaaaattggaaattacgggagaaagcacgttacaggcggcatacagactccaggtagaggagaagctgacccacgtggcgtgtttgaattttgcatcagctaaaaacccgggaggtggatttctcggaggcagccaggctcaagaagaaagcttggctcgttcgtcagcgttatatccttgcatttcacaaatggaagagatgtatggacataatcggaagctgcggagctgtttttattcagattatatgatttattcgcctgaagttccggtatttcgggatgatcagggaacattgttggagaagccatatcaagtcgacttcctgaccgcacctgctgtaaatgctggagttgtgcgagaacgggagccagagcaggtgaatcggattggggaagtgatgctggagcggatccgttacgttcttggaatggctaagcaaaacggcgtagaacatcttgtgctgggagcctatggttgcggagtatttcgcaataagccagaagaggttgccctctggttcaagcaagtgcttgtagatgaaggatatggtttgctgtttgaccggattgtttttgcagtgttggatcacaaagcagaccaacatactttaaacagctttaaaaatgttctttcttgaagtgaaggcagtgcataaaaactgttttactataatatctcatgaaaaaggaaggtgctgaatgaatccatcttcgaatataacctggcatgtgtccgatattgataagcaagcgcgtcagcttttgaatggccataaaagtccggtgctttggtttacagggctgtctggttcgggaaaatcaacggtatcctccacacttgaaaaagcgttatacgcacgaggcatacacacgtttattttggatggagataatgttcggcacggtttaaatcagaatctaggtttcctgcccgctgaccgtaaagaaaatatccgccgtattgccgaagttgcaaagctaatggcacatgcgggtgttctaacgatttgcgccaccatttccccttatcgtgaagatcgtgaaatggtaaaggagattttacagcaggaaggttgctatgagatttatatacagtgcagcctggaggaatgtgagcgacgcgatccaaaaggaatgtacaagaaagcgcgtgccggagaaattcatcattttacggggattgatgctccctatgaagcaccgctggaacctgatctaatcgtatctactgaaggtcgagaggtaatccagtcggttcaggatatcttggattttcttgataggaagcagctgctattatgattttatgatgaattctacatgaatattgtctgaaagcctcaatggcaaaacttcgagaagtgatcaaagtaatcattatagaaagtaaaaatgaaacatatatattggtaaataaatacagtagtgcatatacggcaagccttaaggggcttgcttttttgtttatgattttaaactaattctaaatcctagattataataattataaaaaagtattgatttttgtttgtgcacaatttatagtgaaaggcacatagttaaccaattcattcaagaggtgatttcaatcatgagtaaccaaccaacgaacctgactacaagctggggagctcctgttggagataatcaaaattcgatcacagcaggctcacggggtcccacactaattcaggatgtgcatctgctggagaagctggcgcattttaaccgggagcgtgtgccggaacgtgtcgttcatgcaaaaggtgcaggggcgcacggatattttgaagtcactaatgatttgtctgcatatacaaaagcaagcttcttgtctgaagtgggcaagcgtacaccgatgtttatccgtttttctactgtggcgggtgagctgggctcgtccgatactgtacgcgacccacgtggttttgcggtgaagttttatacagaagaaggcaactatgatctcgtgggcaataatacacctgtgttttttattcgggatgccattaaatttcctgactttattcatacgcaaaaacgtcatccccaaacccatctgaaaaacccgaatgcggtctgggatttctggtccttatctcctgaatcgctgcatcaggtaagtatccttatgtctgaccgcggtattccagctacacttagacatatgcatggtttcggtagtcacacgttcaagtgggtaaatgccgaaggacaggcagtatgggtgaaatatcattttaaaacagagcaaggtgtgcaaaatcttgatgtggatttggctgcgaaaattgccggtgaaaatccggattatcatacagaagatttgtttaatgccatcaaaaaaggtgattttccggcatggaaacttcatgtgcagattatgccagtagaagatgcagatacgtatcgctttgatccatttgatgtgacaaaagtatggtctcaaaaggattatccgctgattgaggttgggcgcatggtgctgaatcgtaatcctgagaactactttgctgaggtagagcaggcgacattctctccgggttcatttgttcctggtattgaagcatccccggataaaatgctgcaaggacgcctgtttgcctacggcgacgcacatcgctaccgtgtaggtgcaaatcataattcgttgccgatcaaccgtccgcatgcagaagtacacaactaccaacgcgatggtgcattacgcagtgacagcaatggcggaggctctgtttattacgagcctaacagtctcggtggacccaaagaatcacctgcgcacaaaattgctccttttgaagtgtctggcgaagcgcaaagtgtagcctacgatcatcatgatcactacacacagccgggcgacctgtaccgcttgctcagtgaagaagagcgcgcacgtttggtccgaaacatcgtaaatgcgatgaagcccgtagaaagtgatgaaatcaaactgcgtcagatcggacatttctacaaagctgatcctgaatacggacgccgtatagccgaaggtttgggcttgaccgttcctcaaggcgagtagaggtatctgcaaactctaacctgaaagccgtatgaatatataataaaaggatgtcccaacaccacgtacatggtggatgggacatcctttgtttttgagagcgatgtaaatcaggtgctgctatatcctctgcaagcgaggtaaatagattacaagaaacagtgaccgtcctagtgcaaatacgataaaggatagccaaagtccgtgattcccataatggggaacgcaccagaagagagcgatcaaaaagcagagcaatgagatcagcatcgaattacgaatcggatacgttactgtcattcctgtaaacacaccatagaacaccagtcccagcccggctgccagcggaaagaccacaagccatccattataagggcctgtaaggccaatcactgtagcattatccgtaaatagcgagataagcggctctttcagtgcgaaatacaatcctcccgtcactacgctggtcaccagtgtccagaaccaggacaagtgaataaccctttgcagcattttacgatccccggcaccccgagcctgacccgtcataatgctactggcgttggcgaacccatcaaaaaagtaagccataatatagtggatctgtagcaaaatagcgttcgccgccaactgatcggttccaaagctcgcactgcgcgccgtaaacagattaaacattgtcagcagacaggctgtgcgaatcatgagatcaaggtttgttgccatgacatttttcaactctgaagctccaaaccaacctcgccaattcatctgtccgctttgcttccattctctccaaatcgatgagcggaacaccagcaccagacccaatacacacgcaagaatttctgcaatcagagtagcgcttgctacaccagtgacattccaatgcatcatctgtgtaaatacaatagctaataccatattgattacgttcattgaaatttgcaaaaataatgtagccttcacacgggataatcccatcagccagccaagcagcacatagttcaccaatgtaagaggggctccccaaatacgaatgttaaaataaattgctgcctgcgccgctacatcctgagccggatggattagctgaagagaagctagcagaattggcttttgtaacacaatgaataccgcaccaatgagtagagcaatggccagtgggcgcatgagagcagctatgctctggtcgttattttgtgcccccgcggcttgtgccgtgaaagctgatgtgctgactcgcaggaagccaaacagccaatataaagtattgaaaataagagtgcccaccgctacaccgcctaaatacgcggaatggctcaaatgaccgattacagctgtatccaccgcaccgagcagcggggttgtaatcgtcgaaataattaaagggatagctaaagcaagataggctcggtgggaaggcaacatgttgaaaaaacctccagtaatgattgtgtataaggatggcgatccgaatgaaataatgcttctttgggaaaatgctcaaccacactgccttctttcatgaccatgattcgatcactcataaagtgcacagccgccagatcatgtgagataaacagataagccagtcctagctcatcctgcaaatccttgagcagatttaaaacggtagcttgtgtagtcacatccaaactagccgttggctcgtccaatacgataaaatccggctctgtgctgatggcacgtgcgatggttacacgctgcttttccccaccgctgagctgatgtggaaacttgtccagatagctggctggaagctttaccatatcaagcaaatgttctgctatatcccgacgttctgaggacatacccgccataaaggaaggaacatagtacttaagctggtccagtggctccagcagggagtgcaggatggttagtctggggttcaaagccgcagatggatgttgaaatactgcacccagcctgctgcgaatccgttttaattcgctccgctttagccctcggatagactgtccatccagtctaagctcaccttgatcaaatgggtccaatgtcaaaatacagcgagcgagtgtacttttcccactgccgctttccccgacgatgcccagacattctcggggggagatcgtcagagcaacatcttgcagcaccgttttgcctccagcgtaagccttcgtcaaaccggagacggtcacgacaggattagaagtgtcttgccgctgagcgcaggtggcttggttatccatgtaaagcgctcctttccattgcgttctgttcttcagtgctgttgtaaggtaaacgtgctggagcgcccggagacagcggcggaatagccgccagtagacgacgagtatacgggtggtccggatggttcagcaccgcttgcgtgtcacctatttcaaccagtgaaccttcgcacatcactgcgattcgatctgcatacttgcgtacatgacgcaggtcgtgagtgatccacaagacggaaatacccgtctccgtccggatttggtcaatgagttggagcacccgatgagctgtgagcgtatccagcgctgttgtaggctcgtcggcaataagcaacttcggctccagcagtagtgcagccgcaatagctgcccgttgcaattgaccgccgctgagctggaacggatagctgcggtacacacgctcggcgggaagctgtacgcgctccagcacctcgatacagcgctgtttgcgcgccttgcgatcttgtttgccatgggcgcgcatcagctcgtccagttggctgcctacacgcagaaagggggtgaaagccccgtggtagtcttgaaaaatgtaagatatttcactacccagcaaagaacgtcgttgtttagcggatagggctagcaaattattgtccttccacgcaatgattccttccgctgtaacagaagaggggagaaggccgccgatagcgaacgccgtcatgcttttgccgctaccgctttcgccggctagagcacaccattctcccggacgaatggcaagctccagttgctctacaatcgtttttacatttgtccgaatcgttaagccttcaatagtcagcatgtacagctcactcctctgtccgggttttaacatcataacggtcgcgcagtttgtctccaaatacgttcgctagtagcactgttagcacgacagctatccctggaaccagcatcaggtggggagccatttgaaaatacgctcgtccttcattcaacatagtaccccattcgggaattggcggctgtggacctaagcccaaaaaagatagggaggcaatcattaaaatgattttgccgatatccagcgtagccagcacaagaacattcccaattgcatgggggagaatatgccgcatgacaatccgcagggaggaggtacccgccagtatggataacgaaatgtaatccttttgcttttcagccagaacggtactacgcaccagacgtgcataaccaacccattttaccgccgtcaccgcgaaaataagatttactaagcctggtccgagcaaaccgctcagtacaatggcaaaaatgtaatcaggtaatgtcatgaaggcatcgaccacccgcttgaatacacgatccatccagcctccaataaatcctgaaagcagaccaagagggaccccgacaaccagcgaaacggccaaaatcaataaactggttccgacagtcgtccgaagtccagctatcactctcgatagtacatctctgcccaaatgatccgttcccagccagtgtgtagcgctgatcgattgtagtcgattccccatctggatgcgatacggatcttgcggtgcaagaaacggaacgactgtaattgctgcaagaatgagcaggatggagagcgacacgatccatgttttggacaatcgtgttctagtgagctgcccgttttccgcatgtacggattttatcatgataaacgtttctccttcaaagcgatttcaggattgacccaacggtaggacagctctaccaaaatattgatacatacaatgaatgcagccataaatacggtatagccctgaattatggggtaatcccttgcagcgatggcatccacaatccatttgcccagccccggataggcgaatagcacttcaattacgactgtaccgcccagtaggctgcctatactctcactgaataccgtaataagcggaactagactgtgacgaagcatgtgtctgaaaaaaatgcggatggggctgattccacgcgcttgcgccgctttgataaagtcttgccccgagctttcaatcagacttgcgcggatcattcgtacataaacggctgccattgccaatcccaaggtaagagaagggagtaccaaatgaaaagcggttccttcacccatagacggcaaaatgcgcaatttaactgcaaaccattcgataaacaaaagccccatccaaaagctgggaatcgaggagccgattaaggcaaacacacgactggctctgtcaatccaacggttacggtagagcgctgccatcgttccgagcgggagagctatcagcagcataatgaacagggagcctccggtcagcagaagtgtataaggcagtttttccataaactctgtgaataccggacgatgggttaaataagattgtccaaaatcaaactgaagcaactggatcagccacttcccatattgtacaggtaatggctgatccagccccagttggctgcgcatatctgcaatttgctgattggacacagctacatcgtcgactcggagaatgctccggacgggatcgcccggaacaagcttaagcagaaaaaagctaacaaaggaaagaataagaaagaacaaaaccagttcaagaaactttttggcgatggatttaaacatgctagttcacatccaggtcctgggtcagcaagtagtattcactttggctagttacccagttatgtacgtaatcgcgataggccactacgttgttaggatggaccagaaaggattgcagattttgttggtcaatcagcgtgacagccttcagcgccagcttgttgcgttgttcctcattcacggttgtgttcagctgtgagatcatacccgtgagttctagtacatttacacgcccataattcagtgctccttcaggcatgtaagccgcattcagaaaatagcttgcatcgccgcgcggggctgtaatgctactataagtcgctaaatcccaatcctgatgtgcggcgagatattcgtcaatattatcaacctgacggatatcaatcgtaatgccaagttctttagcgttagcctgaatcagctgggaaatgagtggaagctccgctctcgactggtaagttagcaatgtaagatgaagcggcttgccgtcggggttcgcaacttttccgttctgcactgtatatccagcttgcttgaagccttctcgtgcagcattcaaatcaaactgtttcgtaatatatttcggtgaaaaaggaaagtcggacaagaacgggccttgagcaggggttccctgaccagacatgataccactggcaatctcatcccggttgatcaggttatcgaatgctttacgcacagccgtctttttcagatcgttattgttcatattgtaaatcagctgatgcgttcgcaaactaggaagcgagtcaaccttaacagtagaatcagctttcaatagctccaagctttcaattggcgggcgatacacaatatcagctgttttggcttgaaaagcaagctgacgcgcattggcgtcttcgttaaacatgaatttggcatgtttcaactttactttaccgttccaatattgttcattgcgatctaaattcagttcacttccagcacggaagctggcaatcttgaacggtcccgtccctgatgggaggtcacctgtagctgtggtgtctataatagccgtattcggatgaaccagctcagacacaaattccgggaaaggcttgtctgtcgtaatggtcaaaatctgtccatccgcatgaatatcacggatatgcagcgcatttttgaccgatggattgagctttaacgctctttccaaagaggctttgacagcagcagcattgacggctttaccgctgtggaagtttacacctggtcggatgttgaaagtccagtgctgtccgtccttgctatcccatttttctgcaagccaagcttccagcttgagatccttgttcactttgatcagtgtttcacttactccagcacgaacagctgtgtaatttacatctgaatgaggatctatagaagggctttgcacgttaaacaataaggtgacacttttatcttgtggtgcagcagatggagagggtgaagctgacggagatgaagcgcaggctgccatcatcaccgccattaccgcaggtataaatagtttaaaatacgaacgcttaaacacatggagtcctccttaatagtaatcgtaatttttacgctttaattcataaaccatatcgtaaccaaatgaaggagctttgtaaatatgtaattgatgaatgtgtatgtaaattcatatgaaaaaaggctgcataaccaatagtgagatggttagcagcctttaagtatatttagatatgtttacaaaaaatttatgaattaatgcatgggtgctttggcagtgccatgttcaacatgaactctgcggatgaaaaacgcaaggatcaacccgatcacactgatgatcatcgcaaagaaaaatgaattttgtgatccgattgccatggcattggccatttcatttacggattcaggcatactggattggctcaaatagttgtccatgcccttcgagagaatacttaccgctacggctgtaccaatagcaccagcaacttgttggagcgtgctcataatggccgttccgtctgggtatagatccatagggagctggttaagtccgtttgtctgagctggcatcataatcatggaaatgccgatcatcaagcaactatgaagcacaataatgagtacgagagttgaagttgtggtaatgccagacaggaaaaataaaacagcggccacgatcacaagccctggaatgacaagccatttgggaccgaatttatcgaatagggagcccataatgggagacaagagaccgttgataatcccaccaggcagaagtaccaaacctgctgttagagcagacaaagccagccctttttgcaaaaagagtggaagaatcagcatcgtagaaaggatcgtcatcatacataagaacaccataataacgccgatcacgaacataggatatttaaacacacgcaagttcaacataggctgcttcatcttcaactgacgtacagagaacagtatcaacgataccagaccgacaattacaggaagcagaaccatcaggctagcccaaccttcgccaccttctccggatttactgaaaccaaacacaacaccgccgaagccaatggaagacaggaggatagataaaagatcaattttaggcttggtcgtttctgaaacgttttgcataaataaaataccgcaaatcagcgagagaaccaagaacggaagggaaatccagaagatccagtgccaagacagattttgcagtaccaatcctgcaatggtaggtcccacggcaggtgcaaacataattaccaatccgatgatccccatagccgcgcctctcttttcagccgggaaaatgatcaagatggtgttaaacatcaacggcaataacaacgctgtaccaatggcctgaagaatacgtgcgatcaatagcactgaaaaagtaggtgcaagtgcagcaacgagacaaccagctattgaaaacagtaacgatgtcacaaacagctgtcttgttgtaaaggtttgaatcagcaatcccgaaacaggtactaaaataccgagtgtgagcagataagcggtagtcaaccattgggctgttgcagttgtaatatgcaaaatctgcatcaaatcattcagtgcaatgttaagtgccgtttcactgaacatcccaataaagccgctaaggagcagggcaatcataataggtagcaccttgaacgttttgggttcagagggtgaactcgattgactcattgtattcatgttgtttttgttcctccaataaattaatggtgttgaattataacgatcggtctatatataataaacatgttgttatttttttgtcaaagtataagttataactactatataatgaaggatgctgtatatggctgctaaacccgaatcatacgagaatatcgtacaaaccgcatcgaagctcttttttcatcaggggtatcacgcgaccggactgaatcagattcttgcggagagtggatcaccgaaagggtcactttattattattttccgcgtggtaaagaagaattggctttggagtgcataagaagagggaatgagtttataaagcaaaaattaaaacagacactgaacgggaatgataatccagtactagccattcaggattttattcgtaatacagctgaggaggcagaccgtaccggctttaacgacttcatgccgattggattctgggctgctgcggaaacttcctgtattagtgaatcgctacgtcatgcctgtgtgaatacgtttacagattggcagcacatctatatggagcgccttcaggattcgggctgggaagaggaaaaggcacatagtctggcggtacttattatttcgatgctcgaaggtgcattgattttggccgttacgcaacagagcagtgctcctatatataatatcgtggattacattccgcagttggtcaaataatcctgtctcttcgacttttaatcgctcctaatgggctccaacaagcaactttaaaaagccgatattttcggttttgagaactcggcttttttgtggctctgagacgtaattttactcacattaccagcaccaaatgatgaaaagtatggtaaaatagaatgaatttgattttgattttgcacgaaggaagggtgatagcaagtggcaaaagcgaaggtacccaaacggcctactcgggatgaatttgtactggaggaaatcgggaatcagcttgtagaagcacaacgagagcaatccgaagttgtattgaccgtatggggacgcgaagaaacaacccgtggacaaattgttaaaatggacccgagaacaggaaaggttcatgtagagagtaatggagaaacggataaagttccttttatggatattatgagtgtaaattacccgagagattagttgttgtgattacataaatatagcagatagggaagaaaagaatgacaaagttagagtctcccttactgcgtgggaaagtaacaatttacaattcgcgtatacaaaaacaaccgagtggtttagagccatcggttgtttttgtatactgctgcatgagtgggaagagaaagccgcgttgttgtgttggcacttgcccttgtacatgcttatgtagcttttatcgggctggtatgactcgcacgtgcttcggcttttttaagcaccttacgatcaaaaatgaaggggccaaacggcaacagtgaggcaatcaaggcagcaagactttgcagtagcgttattttccgcataatcagcatgaccacagtcgctacaacataagccacgaacagtaccccatggatcatacccacccagcttaccatttgtggcattccagctgcgtatttaagtggcatagcgatacacacaagcagcagatatgaaattgcttcaatattaccaataacaccaaacatcttaaaggcatttttgaacataatacacctccttctcctattgcttaaaatttaatatatcctataatgcaatgttattaaacggtagaaagttacgatatatcgaatatttatagctgaatccaaggttatgtcagagctttcacatgattgaagtatccaacgtcccacagcttagcgtgcccggaaacgataatcgtaatttcgtttaaattattgaaacaaacaagggggcttataaaagatggcttggagtaagagaaaacactaagctggtgtagttcgaaggcttagcatatattgtttgcgcgacccctatctgtaaaaatgctagtgtgaagcctaaacattttgtatggaaattccgataacagttaaatgaatgtctgtacattttagtgtgaattttaaaagctggattgcagcagaagggtttgtaagcttgacttattagttttgacaaataaaatttccatactggtatcaaggagagcatagattatgaataaaaaacgtttgcgtcaatggatggctccgttcgcaacggctacactgattttgaatacgggatatggcattttggcacccgatgcagtggctagcgcgttgtcgactgaaaggcataactcaaatctgacaggcctgaatacagaacagttacataccaaattaacaatcgctcaaggccgtcatgtgcctgttacttcaggcacgaaagtgactacgttaaccaaaggctatggtcagaacacctatcttaaccaaatgctaaaagtaatgtcgagccaaatggttactgcgaatatcgcgccggcagaggtaagcaatctgacagcggttcctacagaaacaacaaaagtaaatttgtcctggaacaatccgtcggacattaattttgaccacataaaagtggtaaatgtcactaacgctgtatatgtagataacattcgaagtaactcttatatgatgagcggtttacagccgaacacgacatatacctttcgcgtgaaaacggtgaataagagtggagatgaatctctaggtacgacaatacaggctaaaacggcttccgttgatggtcctgtggataagacacccccaggagaggtaagcgggctgacagctacgaatgttggatataacgcttttaccgtaaattacatattgcctaaggatgctgacctgagccaagcgatcatctatttaaatggtaaggaagtgcagagaacctcaggcacgtcttacacgtttaatgtcttaaatgctgctacagcctacactgtaacggtcaaaacgatagacaaatccggaaatatatctcaaggagttagtattccagttacaacttctacggtctctaccgatattgtacccgaagtgacaggtgcttcagtgacatcagttaataactatagcgttactgtttcctggacaagacctagcggaattaatacggtcagtctgtataaggatgggcaactggtaactgattcaacaggatcatcctatacattcaacaatctttcggcaagccagacctacacgttcacgattaggtccaagcgaagtacaggtacgttgtcctctggtgtgaaactgactgctacaacggacagtacgtcctccaattcgtcagaagtgtccaatcttgaagtagatagtaagagcgacacctggatcaaaatcacctacgatatgccgagtaaagccgacaaggtaaagatatatgttgatggtgattatgagggaactacaagctctgagtcctataaaataacggatttgcgagaaggacgctggtatgagattaaggtcgtgactgtcaatagtaatggaagagaatctagtggtgttaagatatcagaacgcacggattcggatggttactactcttcttcgtcatctagttcatcgaactatgagaaagcgagagatttgatgcgaattgcagaaaacagtctgaatgcctccgactggcgttctgccagagatgcaatcagtgatctgccgagtggaacccgtaaaagcgatttgctggatcggttagaagctattcgcaatagagcaattgggaccagtagttcatcatctgggacgagttctactacaacaacttctggtacaacgtcctcctaccctaacaatgcggtttcctcatattcaacttcgttcaccctgacaccaggagctaaatcagcttatgtcgatggtcgtgctacgacgatggctcaggctccgcgaatcataaatggggcgacgatggtcccgctgcgctttatcagtgaacggataggttacgaggtaaattatgaaaaagcgaccaaaaagatcattctgactcgacctacagacggcaaacaagtagtgcttcaggtcaagaattctacccttgccgtgtatgagttgaacaactcccggagttattcgacgaacatcacagctccggttattgttaacggctacacgctggttccattacgagtgattagcgagctttcggggtatcaggtgaactataatactgcatccaaacaaattacgattacaaaataaatacttctgcaaaaaagggttctaaagttttcactttagaaccctttctgtgtattaggaagtgtaggtagaacaataacaatctgttactctgtaaacaagttattttgattgaaaagaatatcgagttgcttaagctcgtcacttgttagtcgaacacccaaagtttgaagattggattcgatttgatcaggcttggttgcacctggaataattagatcaacggctgaacgcgttaatagccaagctagcgccttttgcaagggtagttctaattaattgtcggcttagagtatcatcgacttttggatacatcattgaattacctaccacacctgctccaaaaccaagtttaaatgcttttaatcctgtttttcctattgctattgtattgttcatgtttataagctcccttttgtatgatgtggaatccttggagggaatctaatgcacatcttacaacctggtgtaaacactaggtcaagcagagcaattcagttttaaaaaaagattaagtttgggtctcaagcggcaaaaagttatggccaaatttttgcccggtttgcaatttcaattcaatcatatccttaatttcctgaagttcttgcagctgctgatctatctttttttggtaattgtaaagcctatcataccattcattatttgatatgttgctctcatctaattgaagctggataataggttttaactccttcagcgacattccggctttttttaaacacttgatcattagaagtgcctctttgtgtgaattgttatatatcctgtgcccattatttttgcgggccacgggaggaagaagacccattttctcataataccgtaaggtatcctcactgatttggaattgatccataagttctttcattttaaaatttgttgtcatctctcgtcaccttcgtaagggaatctttaaagcttaatgaatatattaattaacattaagtggcaaccaaaccggagttggtatgggtatctatatgatgggaagctttatggcggggctatcggaacgtctattcttggttccgtatttgatcaaggagcacaaagcaaaattatagcatcatccgttcagcagcacatatagtaatccaataaccaatgttccttataataatcgcgaggctgtgccaggagtgttttcattccgatggcaaaatgataaaacgctactgaccttcatatgtcagtagcgttttaaattgtttcaatacaaacgaggaagaggtgtgtgccttatgaatcgaaccaagcttaagagcaaattatttatttcggtaatttactcattatgtcgctaatgaactgacggaatctcaatgcttacctgtccgccgcctgtctgggtggagttggtgatgattagctttccgccatgtagattgacaatggattttgttatatacagacccataccgtaatgtccatttattcttctggacgagtcacccatatagaactgctcggcggcctgtttaaggccttccggagagaagcctgggccttcgtctaagatgctgaaccgaatgcagtcttccacagactctacggtcagctggatctcgctatattcaggtgcctggtctaccgcattagaagcaacattcataatggctcgctcaagtaaaactgggtctgcatacagcgtcttagggaggttatatgcagcgaatgctacagatatttttttgacagcagccaaggccattatctgatctttcactttcgctaaatagaagtcagcatccatcgtttccgcccgcagggtgacaagcgtttccgcttttgaaatttcaataagagtcttaatatactgctccatctgcctggtgctttccgatatataatccgtatagttcttttgctcttcggattgatcggtctcggacagtagctctacgtttccacgaacgatagtgagtggtgttttgacatcgtgtgctagggcggatatttgctcgcggcgggatctttccagattccactgtttctgaagcgaagtctttaaagtttctttcattttatccatggaatgcagcacctgatcgatctccatcacaccactgaattcgattgagaagtccagatcctgtgcttgaatttgtttggtggcctgctgcaacccactcattttacgtgccagctttcgtccgaaggaggaagccagcaaggcacctccccccagaaaggcgatacagaacacggcaaaaaaggacaattccgcgttcggcaggtattgacgcaggataggaagttcaaactgagccgagacagaatagcgcatcacagtaactttatcattatgtgagacttttacatagttatagggaaattgataagcagtatcgttctgctgcgtaacactccaagcagtttgagcctgcttttcagaaaggtttccctcattgaggcggccttccgaagtgaatgatgcgtatttatacagtttctgccgagaatccggctgtagggtcttgccagcttcaatgattgtcctatcctcccgcacctgattctcagcatagttcgcggggagaatggtcccacaagacatcaggacatagaagatgagaaccaggaacagagcgagcgcaatcgtcccgatacagaacataactaaataacccagaaaaatggttcgtagtttggttgtcttgcgtgcctgctgtactttggttacttccatcggtacccgatcccccaaaccgtctccactgccgaaacctctactttgccaagcttggctcggatatttttaatatgctccacgatggtggcggaatcgctgtccccatccaagccgaagacagcttcgtaaatctgctctttagggaacacctgtccccagttcagggctagaaacttacatatctcatattcgcttttggtaaacgggactacaacattctgaacggtgatttccttgccggacagattgaaatgaacttccccgatgcagaatacattacgccgttcacgattctcccgtctgagatgggcgttgattcttgcgcgcaattctccagcaccaaacggtttgacaatataatcgtcggccccttccccaagccctaacatcacatcgttctccatggattttgcggtgaggaacaggatcgggcagtctattttgctgcgaatttcccgacagagtgtgaacccgtccatggtaggcatcatcacgtcaagcaggatgaggtcaaaggctccaagctgcatggtgagaacctgtggggagtcggagatcaccgtgacaacatggccatctttctgcaaaatattttgaaggagtgccaaaacggcgggttcatcatcaacggccaacaagtttgccatgcttaattcacttcccttgctttctatactctagtctttattccgacgaattgtgtccttcccaacgacaaatccataatcctaataataccatgatgactacggtccctactacgcaatatctgactcccgaatcaagccgtatagcttcaggaatagatactgctgagtttatatcgtattgcacccagatcgtgatgaaccgggcagcccaagcagaggggatgaatatccaattatgatcacccagccctgtaagaagcaaagcggacaatagactctccataatgcctagaccgatggaagctcccttgccgaaccgcaaactaatgaaaaaatgcagaaaatagaggaagacactggacataaacagaatgcaggcagccaacacataaaacttcaagccatacggtgactctctcataagatatatatagccagccccaaagcctccggaggcaagcagcacactgccaaatcccaagatcaggagcaggctgagcttgctcaggaaaggtagcagcttcactggcgagatcaatagctgctggaaattgccagcgactgcctcctgctcaacagcaatggagcagacaataccaatcatggtaggaagaaccacggccaagacctgcaaatagccgtccacctttgaaatcggtgaatacggagtaaaggaatagtaggctagaaagattgctatgcctaaaagcggcacaaacagctgcacaagcagtaagggctgccttctaagtttaagcacatcggatttcagatagcggaaaaaagaaatcatcttatttagcctcccgcttgcggaaggacatcgccgtcagtatcgacagaattatgaacaggcagattgtgatcactaggccgggcacaatcacgcctttatccaaaagcggatctcctgaaggaacggcaagcccattaggtagcactttaatgacggcgcacattaatcgggctggaatagcataagggaccgcccaccacacagaggacgtagcgaacaaaatggtgcaagatacgttgcccagcatgttaataattagagtggcaaacatgcctattcggtccgtcaggaacaggcaaagtggaacttgccacaaaaaggtgatgaataggattagagttgcagcaacgcttcctgctagtgtcacggaagttgagaatacgaatccgccaagcgttatccctataaataggacaataaaggaaaccattaagagtcttacgcaaaccccgattttaccgtaccatacctgagccaaatctacagccatgccgaggacagcacggtatttcagcttcttgccatccttttggatcactcctgagcacattaaggtgagggcacctggcagcagcatgaaataccaccaattgtagctggcactttggagcatacgtccccccatgagtatggtacacagaagaagagtagctatgggggcaagccagaccaacttttttgtgaaggtgcgctttaattttagatgttcggcggctatatattgctgcatcctactcatccccttttcggtattcctgtgcaatctgcatgaacaacgattccaggttttgccctggagtgaccgcctcttgataagctaatacgccgccggcaatgataccgacatggtcaacgatttgttcgacttcggataaaatatggctggaaagaattacggtaattccttgcttcgggaaggagcgaatcaactcgcgttgctcctgaataccaatggggtctagtccgttggttggctcatctaagatcaatagcttgggatgattgaggagagcaatggcaatgcccagccgctgtttcatacccatcgagaactggcccgagcgctttttcccggtatgggtcaaatcaaccatgttcagcacttcatcaatctgcgaatcaggcaatcccagcaacgttgtacgaactttgaggttctctctagctgtcaaattctcatagagtggaggggattcgatcagtgcgccgatctgagcaagatcttttcgggaccagggttttccttgaaataaaatctcaccggatgtcgggcgtagcataccggttaacattttcaaggtggttgattttccagccccatttgggccaagtagtccatagacggaattctcctgaatagacagtgtgacgttgttcaccgcctgttgtcgtccgaaggttttgcagagatttttagtctgtaaaataatgttatccatatcagttcatccttttcatttgttctgacaactactttaaagatcaattctaagaactttataaggatttaaaatattaatttcaaactttatgcattcatgcactattcgctataatggatacagtgatgtaggaaagggatgtaatcatgaagaaggtcatcgtaatcggatcaggaattctgggggcatcgacagcataccatctagcaaaaatgggcgctaatgtcattattgtagatcgtaaagataaaggacaggctactgatgccgctgctggcattatctgtccctggctatcacagcgacgcaatcaggcttggtaccagctagccaaagcgggagcacgtttttaccctgggttgattgaagaactcaaaagcgagggagaaacagaaactggctatgctcaagtgggggctctcagtattcatgatgatttggagaaaatcaaaaaaatggagaagcgggcacacttacgacaattggatgcaccggaaatcggtgaaattacccggctaaatgaaaaagaaacccatgaacggtttcctttgttagtagaaggttatcattctgttcatattagcggtgccgcccgaatagatgggcgtgcgctgcgggatgcgttggtccgatcagcacaaaaaaacggggcggtccttatacaaggaaatgctacgcttcaatatgagtccgaccatgtaacgggagtagtggtcggtgcacaaagcttctcgtctgacaaggtcattgtttgtgcaggtgcatgggccaatcaactactgttgcctttgggcattcattttaaggttagttatcaaaaagcacaaattatgcatttgcaggttcctaataggcaagatacaggcacttggcctgtagtcataccgccatctgatcaatatctgctggcttttgataaacagaagattgtaataggggcgactcacgaaaatgatatcgaaggttacgatacgagagtaacagcaggggggatgcaggaaattctggataaaggtttagcattggcccctgatttagcaaacagcacttttcaggaggtaagagttggtttccgtccttttacacccggttttctaccggtgatcggagctgttccaggctgggatggtcttatagcggcaaatgggcttggagcatccgggttgaccatgggcccctttattggaaatcagctggcaaagttggcacttggaatgaatgtagatatcgatatcaatgattatgatattcgaaaagcaatagatgaaagttgagccttgactgaggagaacaatatatatacttactgaaaaagtcgccatattggcgactttttgttttagtgcatatttattttatacgtcattcatcatgtcattgagatgcgaattctccaacgattgtgttagggtttgcatgtttttcaagtagtcgattttatagatacaggaatagatcacatttaatacatagtcaaaagcaatttgcgacgaaaatgtaccaatcttggcatgttttacttcgtcattaggcacccggatacagatattactgagtttggccaattcactttgattggttgctgtaattgtgataaaagggatattttcatgtgcgaaatgccgtgctgcttttaaaaaaatcggcgactttccgtggtaagttaaaaacacagcgcagtcctgtgtcgtaagattagccgtatggtaagcccattcagacagctccgtagctataaccacatacttgtttatttttactaatttattttggaaacttttcgcacggatttgtgaatcgcccaacgcatatataaagatccttttcgcttgatccagcaatagggctgtttgcgacaatgaatcatcatccatgaatgtaaagtttttttcaatcgtttctttcattaattctgcaatttctttcgccacttgaagtggggattcatcataaccgaagggatagttggggtctacattggaaatgttctgggtgttctgctgaaactcccgagcaagtttgattataaactccttgaagcccgatagcccaagtttatgtgttaatcgattaattgcggaatgcgaagtatacgttgcctttgcaagctcctgaatatttaagtgcagaatactttccttatgaagcaaaatataggatgcaatgcttttttcgtttggtgtaaagttttgcatttctgataattgtatcagtattttcaacaggttcaccccggctcaattgaataaaacgttcgaaaaataatatgaaataaacattttgtttaaaaataaacaaccatttttaaaaataatcggttgaatgtaccattttggtggcgaatcctttacgatcaacgttcttcttttataataaatgaaaaagagcctaagggggaaataatatgcttaccatcggttatattggaaatgggaaaagcacgaaccgttatcatcttcctttttcattgaacagagctgaattgaaagtgaagacgatatatgctcgtaatctagataaaaggaagtgggaaaaaatacctgaagtgctgtatacagataatatagaatctttaatgaacgataaggagattcagttgattgttatctgtacacctgtagaatcccactactcttatgcaaaaatggcgctagaccacgggaaaaatgtacttgttgagaaaccttttatgttaaccaaagaagaagccgtgtcgatcttccaatatgctaaagagaaaaatctggttatacaatgctatcagaatagacgttacgattcggatttcctcactacccagaaggttattgaatcaggaaagcttggagatttgctggaggtggagatgcattacgattattatcgccctgagatcccgaactccacttctcatttttccagatataacagttacctatatggacatggcgttcataccattgaccaggttctttcctattttggaaagccggacacaatccattatgatgttcgtcaattgctgggtactgggagaatgaatgattactttgatctggatttttattatccctcgctcaaggtatccatcaaatccagcttttttcgcttaaaagagcggccaggttttgttgtacacggcaaaaaaggcgtttttataaagcaaacgaaggatcgtcaggaggagcatctgaaattatactatctgcctaagggacactccgatttcggcatcgaccagcccgagcattacggcatcttaacatatctggatgataaaggcgagtatcatgaagaaaaagtcgtttctgaaaagggagactatgctcgagtatatgacgatatctatcagtcgatcgtacttggtaaagaaaaagtgattaaagacgaagaaacgataatttgtatggaaatacttgaaaaaggtatagaggagtgcaactaaaatgaagttgggaattgtcggagcagggatgatcgtaggggatctattgagctttattcaggatatcccgactattttattaaaggcaatttgttctagacctagtcatgaggaaaaattactggattggcaacatagatatggaatctctcagatttattcggattacagcgagatgctgatgaatcatgaagtggatacagtttatatcgggctgcctaatcatcttcattattcatatgccaaagaagcattattgagtggcaaacatgtcatttgtgagaagccgtttacttccaatttgcaagaattcctagagctaaaagaaattgctcagcaaagaaaactgatattggtggaagccataacaaatcaatatttgaaaaattatttgtccatgaaggagtatctatctaaacttggtgagatcaaaatcgttgaatgcaactattctcaatactcatctcggtatgaagcattcaaagcaggaataatccagcctgcgtttaatccagaaatgtctggtggagccttgatggatattaatttatataatattcattttgttgttggattcttcgggagccctaagaaagtggagtattgggcgaacatggagcgtggaattgatacttcaggtatgctgctgcttgattacggtgatttcaagtgtgtctgcatcggttcaaaagatagtacggcccccaatgccgtgaacattcaaggcaataagggctatatacacatggcaagttcagctaatatatgcgactgctttgattacactgcgaataaggaaatgccaattcgggtggatctaaaagatcattcgcatcgaatgtatgacgaattcgttgaatttgaccgtatcatccgagaaaacgatttggaaaaagtttcggatatgcttgaacatagtgaaaaggtcatgaaggtcatcgaggaggccaagcagtccgccaatcttatatttggccctgatccactttcactgtgttcaacccctaaatttctaaatgataattgaatgttttaacttatatgtctattaatgaagaaatcaagcgtatttatcaatggcaagcattctgtatcagccatctctgccaaggaggagctggcacactcgctgcgaaattaaacgaagcataccgaaaaaaggacagcccaaggccgtccttttttcttcttcaccgatcggtccagatactcagccattcatgacctgatcgtatttttctttcaatcgcttaatgtccgctcttggaggagccccaaacattcgggagtattcgcggctgaattgggaggaactctcgtatccgaccctgaaagcgacgtctgcggcgtccgccgattcagctaataagagacggcgggcttcctggagtctcagctgtttttggaactgaattggactcatggcggttacctctttaaaatgccgatggaacgaagaaacactcatgctggcggtgtctgcaagatcttcgatccgaaaagactggtcccaattccgaacgatatagtcaatagcttctcggattcgataggtgctgcttccttcgactgcaatctgagccaattcgactccataaggtccctgcaacagcctatataaaatctccttcgtgtaaagaggagcgagaaacggaatttctcccggggtgtccagcaggtgggcaagcctaagaacagcatcctgaatggacgattccatccggccgacgaatagggcacgtttggcgttttcttttagtgttacctggattttagaatcgttcagtacctcgagaatctggttctgggtaaattcgagcttaagactcaggtagggtgattctggagaagcttttatgatttgaccgatcaccggcagattcatagaagcgatcagataatcagaaggtccgtattcaaaattctcttgtgccagtaaaatttctttcaaaccttgaacaacaaaacaaaatgaaggcttgtaaacccggtaaacgggttcggttttgctggaacgctgatagaaaaatagggaagggatcgctgtttcccccgtgctattctgaaacgagtgacgctcgatcaatctggtgagctccttttgttgttcaagcatgtcctccgacattcaaatcctccttactggtttgtctggctccattataagacttatctagttgtaacaaaagtggtggtgataggattaggcaaacaattgagacaattgagataccgcttcgcttcctctgttcgtcataataaaactacaatcctagaatcaggtaagggggagcagatgaattatttgaatcgttggtttgggaaattattggttcaaaggcttatcacattaatagagtttgaagagcatgaatgttttatacaaatgtataatagctctcttgataggattgtaagccaattaactaaagaaaaataatgaacatttatcattcatttagcccagaagccgtggatcgttccaatcccgggcacacggaaattaagccgtctggaagaaaatctaggcgcagtagatattgaactcacatccgaagatgtgcgcaatattaacagcgcagcctcgcagatcactttgatgggcgccagatatacggatgaactggagagaagaacgggtctttgatctaattcttcaagtcataatccaatcatgaggaaatctcttttgttaaagtaaataattgagatgagaaatcgtatttctccgcaatattaaaatcctgtcccgccttatgaggcggggtgagtataagtccaatgttcattaactcgctgccggtaaaacgttggcccagctcttccacaaaatatactgccatttcgtccagcccgactagctttagtcgtaaataagcttgattcggacgcgagagcacctggtaccaaccgacgagagcatgttcacattctgcatcaatgaccatccaggcagtctcatttttttcaaagggacttagcagacggtaaaaggttccctgtgtaattaatcgtcggtgacgtttatacgtttgtatttgttctttgattacattgcactcttcttcggacaaagccaatgggtcaagttcataaccgaatataccaaagtaggcgacattggatctggtttgcagcggtgcggttctgcctacctggtggttcgggatgcttgacacatgagcacccatgctgctaagcggataggccatggaagtgccatactgaatctttagacgttctatagcctcgctatcgtcgcttgtccatgcttgcggagcataataaagcatccctggatcaaaccgtcccccaccggaagcacaggactcaaacaaaatctcagggtgttcggtaatcagcttctcatataaagcatatacacccaagacatagcggtgaaaaaattcgccctgtctttccttgcccagagataacgaataggcttctgaaatacagcgattcatatcccattttacgtattcgatccgagcagaagagagcacgtcatccattaacttaaacaggtaatctacaacaggcggttgggaataatcaagaacatattgatggcgtccatgcttgcgttgacggccgggtgttcccacaacccagtctggatgctccctcataatatgagagtcggagttaaccatttccggctcgaaccaaagaccgaatttcatcccgagcgcattgatcttctctgccaaattcgagatcccgttcggtagcttttcaggattttcaaaccagtcgccgagggaagaggtatcattgtttcttcgaccgaaccatccgtcatccaagacaaagagttcaattcccagttcacctgctttttttgccatatcaactattttctgctcagtaaaatcaaaataggtcccctcccagttattgatcaatacaggtcgttcccgctcggtccaactgctgcgaattaagtgtttattgtacaggctatggtatgcttggctcatgccatttaaaccgctctcagaatagaccagaactgcttcaggcgaataaaaacattctcctggcttcagggtccagcagaatttgtcaggatgaatgccgatcatcaatcgggtagttgaatagctgtccacttccgcctgggcaagaaagttcccgctgtaaacgagattaaccgcatatacttctccttggtgttcctgtgatccgggtttggcaagcgccagaaatgggttgtgaacatgactactaattcctcgtgtgctcccaatcgactgtagcccaggtctcaatggtgtacgctccacatgacgttccctaccccaagcccctgataaatgaataatttcataatcggagtcagggagatcaagactcaggctcattagacggttgactctcaggggattattcccggaattcgttatggatacggatctcgtgatcacgggcagttcgctgaagatggtgtaagcaagcacggccaccgctcctgtaagagaatcggtcagcgtgatgaggagtgtctctgcttcatgtgcttccttacaaaacgtagctggaagatgggggattttaggcttctcagcgattacctcgtaacgatcataagtgaactccattatatgagatccgtcctcctgtatgatctcaattgccggctctcgaaagtctccacttcccgcagaaggaaattcctgcttaatactttccaacgatgtcaccaagtcactatcaaactcaccgacagacacaggacggtagcttcgctcgataaaacggtcatattgacccaggtactctatttttttgccgtaatataaatgctccaattgcccgttctccatgacacggaaaagataactgcagtatttgttcgttaagtgaaatgtccgttccttttggttaacttgtagactagccatgcacatagcccctttcaaaatatgtcaaaccacttgaaagcgttattattgaatcagcataacaaaggtagtgatagaaaatacatgactttttttaagtcgaatataggaaaaacaaagaaccttacaaaaaattatagtttagagctaaaccttttctcgatatttgtcatccttaacttatgctatactgataaattaacaagcataggttctttatttggaaaagtggggaggatgccaatgggcgagaatatgattcaatatgttgatacgtataccagttcagagcataaaaatatatcagatttgattttatataactgtggcacagagctctgcttatccaatcaggattttggacccatcgcccgcgattttaatctggttcattttgtgctaaaaggacgaggtaggttggtgattgacaacaaaaattacgatataggagaaggacaggcttttttaattccggccaatagggtagcttattaccaggcggatgaagccgagccttgggagtactgttgggtcggctttatgggcattaaatccgacatctacctgcagaacatatcacttccaagccagaacccttatgtaatcgatattgaagatattacgttctttcattccacgattcttgagatgttgcggatcggagataacacactttcttcatcgttggctatacaggggtatttattccatattctcgccaaacttgtgcacgacttgggagaaacgatgtcggtaaaggagcagcttccttattcggttcaagcgataaactttattgagaaaaactacatcagcggcatccagattagtgaagtagcggagtacctcggtctacatcagaattatctaacctccgttttcaaacttgagactggtgaaacgcctaaacaatatctgatagacctcaggattaaaaaagcgtgcgaactgctgcaacatacggactattcgattcaggtcatatcaaattcggtcggctataccgatcaattgaccttttcgcgagcttttagaaatgtaatgagtacatctcccagtgcgtatagaaaacagtttctttgattttgctatattaatctataaaaatatttgtatttagaagcggttttttttgctatcgtaaaactgtagattctttcctgcatggcatatttaacaattgttaggaagagtactttttacgggaggagaattccgcacgtggatttcattattgcttttattccagccgttggctggggggttatgccgatattggcacatataacaaaagccagtccccgagaacagctgacaggtaccgtgattggtgctgtgctgtttgccctgtgcttgtatatcattcaccctacctcattagcaccgattcattttgtggtaagttttatatctggtattttctgggctgctggacaattgcttcagtttcaagcttttcaaaaagtaagcgtatcgatcgccattcctgtgatttgtggtctgcagttaataggtacgacgctatttgccgcacttattttgggtgaatggataacagggtaccaatatgggataggcgttggttctcttctgtgtatattggcaggggttctgttaaccagctatcagggcaagtctgcagggttgtccaagcctttgccggtacccattatcataatgttggtttgctcggggttagcgttaagtagttatgtcgttattaatcagttctttcatatatcgggacatccgtcattctgccgcaatcgctcggtatgctatgctcagccatggtcatgaacctgaagggcaaaaagcggctacgcttctctctggtggttcacaatttacctacaggattggtttggagcatcgcgaatctagcattatttatttccaacgggctgatcggcatggcggctagttttccgatctctcaggcgagcattgccattgcttgtgttggcagcattttaatatttaaggaaaagaagagtccaaaggaatggataggcatacttgcgggaattacagtacttatgattggagtagggatgattagcttgctcaagccttaaggaatcgagaccctttcctttgagtaacgaaaagagcttatccatccatggatacgctttttggggattgacagaggtatggctgcatgagaaaatgtacgcgcgtacataaaatgatttggaggtgggtaatatcgtttcacgcaaggaagtagcagaactttccggcgtgtctgaagcgacggtatctcgggtcttgaatgcagtaggtcctatcaaagaggatacgcggagaagggttctggacgcagctaatcagcttggatatgtacccagtgcgctggctcgtaactttgcccgaagtaagagtggccatcttggtgtagttatgccttatgtcccgaaggcgcacctgttctcagcctattttttctctgagatgctgagcggtatcggaaacaaggccagagacagcgggctcgatctgcttctattgttccgaaagccaggggaacggattgattacagtagtcttttccgccagcaaagaatcgatacctgtatcatcctaggagccagggatgaccacgatgaggaggaagctctaaagagacttcaggaagaaggacgtccgttctgcgtcatgaatcaccattttgaagggcaatcgttctgtgaagtggatgcagaccatgtagaaggcagccgggcggctgtaagtcacctcatcgagcagggatacaagcggattgcctttctcaacggcccggacatctattccaacagtactgagcgattgaagggttaccgtaccgcgcttcaggaggccggtattgaatatgaccacgatctacttctggaaggtaattacagccgtcgaagcgggctcgaagcctcagctacaatcgcagacaaattgaatgatattgatgctgtatttgcggcgaacgaccggatggccctcggggtaatgcagggtctccgtgagcgcggactggcagctgaccagtttccggcgtttgtaggctatgacgattcggatgcggctgagatggctgttccgccgctaagcagtgtccgcgtacctttttatgagatgggggagcttgcagcctcgaagcttatacccgattctctgaatcttattccagccctggaactaaccgggcgcgacttgataagagaactcctgtccacagagctgattatcagggcgtcatccattcgtccataacaccattcgtcaaaaattcgttgaaactcagacccataaggaggatcacgacatgtctaatcgtcttcgtatcggaatggttggctacaaatttatgggcaaggctcacagcaacgcttaccgtagtctacctatgttcttcccagatgccccgctgcagccagagatgtccgttatatgtggacgcaatgagcagggggttcaggcagctgcccgccagtacggctggaccgaaagtgttacggattggcgtgatctagtgaaacgtaacgatattgacctcattgacattaacgccccgagtaatgcccataaggaaattgtcgttgaggcagccctccatggcaagcatctattctgtgagaagccacttgcgctctcgctggcggattcacgtgacatgctgcaggtagcagaggaagcagggatcagacatatggtaggcttcaactaccgtttttctccggctgtccagctggctaagcagctagtcgagagcggacgcctaggcaaaatttatcatttccgtgccttcttccttcaagactggatcatggacccgtccttccccctggtatggcggctgcaaaaagaagtggccggttctggctctcatggtgatcttggcgcccatctgattgatctcgctcgcttcttggtcggcgagttccatgaagtgatcggcatgagcgagacattcatcaaacagcgcccgttggctttggagatgagcgggttgagctccaaaaggagcgctgaagcaaatgctccgatgggagaagtgacagtcgatgatgccacgttgttcctggcacgcttcgccggaggtgcgttgggcagcttcgaagccacacgttttgctgccggacatcggagcacaaattcattcgagatcaacggtagcctaggcagtgtgcggtttgactttgaacgaatgaacgaactggaagtgtatttcacgcaggatgaggaggacgttcagggctttcgtcgcgtactcgccaccgatccggcacacaagtactccgaagcctggtggcctgcaggacatacgattggattcgaacataccttcacccatgagatgcttgagatgttgagtgccatctctgaaggacggcaaccgtcgccgaatttccacgacggtgttgcttgtcaggctgtaattgaagcggtagaacgatccatagaggaacgccgctgggtatccattgaagaaatgtagtataacaatacattccgaaaggtgagtggattacagatgcgcaaggcactaattgtaaggggtggatggaacggacatgagccggagcaggtggcggccatttttgaacgcattttgaaggaagagcagttcgaggtggaagtgtctaataccctggaagtctaccaggatgctgagaaactgcttgacttggacctgatcgttccaatgtggaccatgggacagattgagcaggaactggtcaataatgtttcagctgcggttcaaagcggcgtaggtctcacaggctgccatggcggcatgtgtgatgccttccggaacaacgtggactggcagtttatgacaggcgggcaatgggttgcgcatcccggcaatgacggcgtagagtacatggtgaacatgaagcgcggctccagcccacttctagaccatattgaggattttcaggtcaaaagcgagcagtattacctccacgtagacccggcagttgaagtgctggcaaccacacgctttccgatcgtaccaggcccccattcagccaatgggccagtggatatgcccgttgtatggacgaagcgctgggggaacggccgcgtcttctacaattcgctgggccatcacgcagatatcatagatatgcctcaagtgaccgagatgatgcgcagcgggtttctgtgggcagcagcaggcaaacaggcggtggccccccggggcaactctctggcagaggcttatacaggcatgacagacaaccaacagcgttagcgtgtattcttatgcaatgatgtcccgattgaattcgtatttccagtctccatttgattgatacattgatgatttgtaattttacaaatatttaacaatcagaacaaatgggattgtttataagccccgttcagcgacaggatggtatccgatgcaacaaaagaatgccattatccattttttctgaagaagaagggagtctaggcatgaacaaaatgaaagtaggcattatcgggtgtggtaaaatcagcggaatttacatggaaaattgccatcgtttcgacattctggagctgtacgcagtagcggatctggaccaaggtcgggcagaggagcaggcggtagcgttcaacgttccgcatgtatattcggtagatgagattttggctgatccggagatcgaactcatcattaatttgaccattccgggcgttcacgccgacatatgtctcagagctcttgaggcaggcaagcatgtctatgtggaaaagccacttgccgtcacccgtgagcaggggcaggttgtcttggatcttgctcatcaaaagggactgcttgtcggctgcgcaccagagaccttcttcggttccggtatacagacatcattgaagctgattgaagacggagtcattgggagtccggtagccgctacggctttcatgatgagccgtggacatgaacattggcatcctgatcctgaattttattatgcagtcggcggcggtccaatgtttgatatgggcccttattatttgacggctctggtgcaattgctgggtccgattgctgccatttcgggcatgacaagcaaggcgatggatcggcgaacaattacgagcgagaaaaagagaggccagaccatcccggtcgatataccgacccatgtggccggattgctgcgcttcaagcagggggctgtcggcacgctaattaccagctttgacatctttggtggaagcactctgccaccgatcgaggtatacggcactcagggcacgctacaagtgcctgatccgaacacgttcggagggccagttcgctacaggctgctgggtgagcaagaatggacagaggcaccgctgctgccgggctaccaggagaatacacggggcatcggtgttgccgatatggcctacgctatccgcagcggacggcctcaccgcgccagtggtgaattggcttatcatgtgctggaggcgatgtgggcgttccacgattcctccgatcagcagaccttctatccaatgcagagcacatgtctgcgcccggcggctttaccggaaaacctgcccttgtatacgttagatgcgtaaactaatgtaaattttacatcccgctttgaatgttcatttctattgaaaagaagacttcagctccgttttaaccgcggctttggagtcttcttcgttcattttcaggaaggatcttaatttcgggcataaaatcattctttaccgatcattctaaatatgttatattgttggcgtaggaggaatacacggataagtagccaagagttatgaggagtggtgtgagatcttgccgtggactcttctgcgaatattagaacgaccattctaattatagcagatggagaagggatggattgaacatggaatatcgtgtattaggaaatacaggccttaaaataagcagttttgtattaggtacaggtacttttggtttttggggcaacaatacggagaaagaagctgcagtcatgttagatgaggctttggctggaggcattaatctgatcgatacagcggatgtctattcaagtggtcaatccgaagaaattctgggtcacatcctaaaaggacgcagacaggatgttattctggccacgaaaggcggaatgcccatgggcagtgggcttaatcaatccggtaactcaaaatattggattaagcgtgcagtagagggaagcttgagaaggttgcaaacggactatatcgatttgtatcaactacatcagccagatctccatactgacattgaagagagtcttgacgcacttacggacctggttcgtgaagggaagattcgctatattggtacatccaattttcaggcatggcaagtgaccgaagcacaatggactagcgaacgcaaaaataccgcacgctttgtatccgagcaagccccgtattccatattgaatcgaagcatcgaattcgatttgcttgctgcaaccgctaaatacggaatgggcgtaatggtttggagcccactttcgggtggtctactcacgggaaaataccgctcgggagaagctgtttccccagattcaagagcagcaagttctctagggaaactttcaactgttgtagatccgaatcgagaagaaaatcgcatcaagttcgaagccgttgctaagctccaaacccttgcaaatgaagcaggattaactttgccacatcttgccatggtatttacacaagctcattcgtcagttacttctgctatagtgggggcaagaacaattgagcaacttcgtgaaacgttaaaaggcagcgacatccgattaagcactgatatcctggatgcgatagatgctatcgttccgccaggagtaaccctggatgccttggaaaaaggatggacgcctgattggttacaagcaaacaaacgaagaatcctgggttaaatatataagacagatctcatagctgtaatgtattcacatattttaaatctagtttgctgatccttcactacattgtataatgattattcgaggtgatgacgatggcaagatcaaaagaatttgaagttaatgaagtattagataaagcaatacacctgttttgggcacaaggatatgagaaaacttcaatgcaagatttggttgagtttatgggcattcaccgaagaagtatctatgatacctttggggataagcatgccttatttatgaaagctctcgaacgatatgaaacgaaacagaccagcaaaatgaggtttctgattgaaaaacaaaaaccgatcaaagaattaattcgggagttgtttgaggcgacagtaagaaatgaaggagaacctctagggtgttttctcgtgaattcaggcgtggaactcggcgtgttggatcctgaagttgcatccttagttgatgagagttattcgcgaactgaggaactcttgactaaccttgttctgaagggtcaacaatcgggtgagttcaaggctgagttggatcctgtagttatttctcattatttaatgaatgcgtggttagggctacgtacgttggttaagacaacaacggatcagcaaaaattaaagaatattattgatatgacactgaccgctttagattaaaagtggaattacagcatgacaggcaaaaggagtcacctaaatggaggactgcttgtttccgtgatacaagttttttcttgtccctctaacgaaagaaagaacttgtatcttatgcctcaaacaagtcaaggaataccgctccaaaattaaaattttagtcataaaaaaattatttactgttcgttctaaaattgatatgctaatagcaagttagatataactttttttaccataataagaatgatcgttctaaaatcatctttaaaactcatttacactaatctgcatgttatgaaggatagaatattatgaagtatacagttattacaggagcaagttcagggattggatatgaaacggcattggcgtttgctgcatgtggcaaaaacttaatcttggtagctagaagattggataaattagaagaactcaaatcagcaattctggatatggatcctactataaatgttattgttcgtacaagtgacctatctattacagaccaggcctacacactatataacaatttaaaggaataccaaattgagacctggattaacaatgcggggctcggtgaagcttcttttgtagcagaacagaatttagataaagttgaaactatgctacgtgttaacattgaaaccttgacgatcctttctacactatatgtacgagattatgctgaatgtagaaggaactcagttaattaacgtctcatctgcactcggatatgccatcgctgttgggagtgttgcttattctgcatctaaatattacgttagtgccttcacagaaggccttgcaaaagaactagaaatgaaaggtgcaaaactaaaagcaaaggttttagcaccagctataacggaaacggaattcgggaagaaatcattagatactgaagaatttgattacaaagcaaacatgcctaagtaccacactgccaaacaaatggcgggattcatggtggatctttatgataacaacgaagtggtaggttttgtagaccagaactatgatttcaacctgagaggccaaatctatccaatcatttcagggttttaaatttaattcatatatccgtggagatcctgaactttatcgctaccttgtaacggaattagctcaattggatttagcttaccttcatgttatgcatcttggaaatgaaaagctgctccaagacattcgctcaatctggacgaatccattgttagtcaatcgtgctggacgggctctggaagatcttagcttggatatagaaagtggccttgctgatttggtgcctgttggtgtatggtcattagccaatccagatttagtggaacgccttcaaaaaggtgcgcaactaaatgaagcagatccgtcaacattctttagtttggggagtaaaggttacacggattatcctacgatggaagaattagaatcgcaagagggtctatacaataacataaaggctgaaacatggcgtacaactgaaaattgtacgccacgtttttagtctaagatgttcgatgttttcaaaaaaacacatttagtaaataatggtatagcgagcgggtcaacctaaaaactcgattgcgttcatggttatgctatctccaaattagcaaaggaagaggatgaatatgagagcagcacaagtacagaaatattcaaaaataatccatgtggaattaaatgatgtaaacataccacagatcaatagccatgaggtacttgtcaaagtaaaagctgcaggtgtaaatccactggacattcttaatctgaatggcagtgttcggatgattgccgactataagttgccattaactttagggaatgaactatctggggttattgaagctgttggtgatgatgttttgaattttaaggttggtgaccctgtttatacgaggttgccgcttaataaaatcggtgcttttgctgagtatgcggccgtaaatgaagatgctttatccatcatgcctgaaaatctatcttttattgaagctgctgctgtaccccttactgccttgactgcttatcaagcattgcacgatgtactccatgtccagccgaataaaaagctattcattcctggaggaaccggaggatttggcgctatggcaatccctattgccaaatcactgggattatttgttattacaagtggaagtgaaagaggcagatcacgtatactgtcgatcggggctgatcaattcataaattataaggcagagaattatgctaacatactgtccgatatcgattatgtgatcgacaccttgggtaccaaagagatcaaagctgaactgggtattttaaaaccacaagggaaattggtatcattgaaagccggacctaattatcgctttgcggttgacaatcattttccaatgtggaaaaaagcattgtttggtctagtgggtgctcgcttagattctttagcacgtaagaatcaaaatgaatatcgctttttatttgtgcaagccaatggaagtcaattacaagaaatcactaaacttgttgaaaaagaaaatatcaagccctctatagattcaacttatacgtttgatgacattaacaaagcgttgattaaagtgtcaacgagccactcccaaggcaaagtgattgtgaccttctaagtaatattacatttttcatgatactagaatgtgcattctattatttgcttctaaaacgtgtattctagcgagttgaaaaacggtattcgcgggtgaagcaaaccggatttgattatttaaagaattggttctcattaatgcaatccccctgactaaagtttctggcagtggggattgcattaatgtaagttctagttcacatacttctctatcgtgcttcggactgctccgggacctgccagcatttcataaaacatggcttcaatcttgtcgcctagaccaatttcatataatcggacaccgaacagtttgtcatcctcgaggaggcagcgaacctcggaggtctgatcgcccagcttcgtattctgcaaatatccctgcagcgtatccagtaacgggtccggactgagtgtgaagggttctccttgatcatccactcccagcaaatagcgacaccagatcgcaatggtcaaggggatagcagtcaagttcgtaggatcaagccctgctgtgctagcataagactttatggtttccccaaaacggatgctcatcttttgagacgtatctgttgcaatccgctgtggcgtatccggaatatagggattggcgaagcgttcctgcaatacctcgtcaataaatggtttcggttcgataattccgggatcaattacaacaggtaagccttccttgtagccgatggtttccaccagacgacgtaatgtctgatccttcatttcatctgcgatgagctcgtacccaagcagacacccagcgagggccagcgctgtatgcagcggattgagacaggtagtgactttcatcttctccactttgtccaccgtatcccgattcgtgaagatgatgccagcttcctccagtgcaggtctcccgttcgtaaacttgtcttcaatgaccaaatactcgctaacctcagcattgacaaagggagccgtatacgtatgcctggaggtaacgatcatctccatgtcagctaaccccagcttccgaagagcagactgtacttgcaaggaagggcggggggtgattttgtcaatcatggtcaaggggaaggttattttctcctcattctgcagatagtctgcaaatccttcctctaccaggcctctgcgagcccactccttggcgatggcaatcatactatcctttaacagatcgccgttatgggagcaattatccatgctcacaaaggtcattggatgccgccctctcagataacgccgataggcaagcgaagtagccaggctcatcacatgcatcggctgttcaggaccattcgtcaaatccctctgcacaacagccagatacttgccgtcgggcccggtcagggcgtatcctttttccgtgacagtaaagctggccatctgcagggacggattctcaaatatttcaatcagacggaggtagtcgtctggacgattttgctctgctgcgagtccctcaacaatgcttgcgaccacgctcttgtgaaatcttccgtctgcactcatcaacaccagtaaggttagattgtcgtaaggcttataagctttgtcgatcatttcaaaatcaaaggcttcggccgcaataatacctgtatccgctttcaagttattcagcagttgttgctgcgcattggctatcaacccacgaaaaatattgcctgcgccgaaatgcacccattgcggtctaactcgggtgttattggctacaagctccagatcatatttcggcagttcaatgcctgctgctcgccaggccgctttgtctgaaaggccttgccggtcaagttggagcatttatttcactcctttgccttgagagagactatcccagacaccaagcaagtacataacccccagtgcacggtcatacaaaccgtagccaggtcgacaattcttttcttccccccatagatgtctgccgtgatccgggcgtacatatccctgatagccgttctcgtgataagctctaactacttccggtacatcgacgcttccatccttcccgcggtgtgacacttcaataaagtcgccattctcaaacaccttgacattacgaatatgcgcaaaatgaatacgctcatgaaactctcgaatcatggttggcaaatcattctcaggattgctccccagtgacccggtgcagaaggtcagaccattatatgggctgttcactgcatctaggatgcgctggatggtctcacgactacggacaattctcggcaatccgaagatgggccatgccggatcatcaggatgaatggccatcttgatgtcaacctcttcgcagactgggatgatgcgctcaagaaaatacttcaggttgtcaaacaacttgtcttctgtgacatccgcataagcagcaaaaagttcatccagtctcgccaaccgttccggttcccagccaggcatggtgaacttcccagctcccttgagaatccgatccaccatttggcggggatcatcggtaatggcagccttttcataaaagagggcgttggacccgtcaggcagttccttgtacagctctgttctggtccagtcaaagacaggcataaagttatagcaaatcaccttaactcccactttggctaattttcgaatggtgtcgatataaatgtcaatatattgatcgcgggatggtaggccgattttgatatcatcgtggacatttacactttctacgaccgccgtactaaagcccttgctcgtaatctgatcagctacctcctgaattcgctccatttcccatacttcaccggctaccttatcatgtaaagaccagacaatgcccataactcccggaatttgccggatatgatccagtgtaatattgtcgttgccttccccataccatctccaggtcatattcataacgatacctccctgattatattccatctgtcttgtatacaagattgagttgatcataaattatagggtttgttcttgtcaatgataatctcagaggagtccgtcacctcaaaatgctttataataagtctactagatttataaagtgaaggtaggaatgatatgtttacaaaagaagaaatcatgcaactgttgaaaaaagatattttgtcactgaccttaaagccgggtactcttctcagcgagacgactttgtcagaacgctttcagctgtccagaactccgctacgcgatgtattgaagtggcttgcgcttgagtcctacattgatatttatcccaagaaggggaacattgtgtcctatattgatctggagtccgttgaacaaattatttacttaagaagcgcattggaaaaggagattatgaaggagctttcttcgcaaattgcattaagcgatgtacagaagctgagcgatattctggacagacagagagctgtgattgaagaagatcatgctacggatcaatttctcagtttggatgatcagttccaccaaaccatgttccaattggtggggcggggatttctttggcagctcattcagcagtcgaatgttcactatatcagatatcgcaagctgcatatgctggaaacagggaagctgataggcatctggcatgagcaccaagctatgcttgaatacatgctgaataaggaaacaactaaaatggatgatctggttcatcatcatctcagagaggatatccattcgctcgattttcttcggaagttcgctgattatatcaagaaataaggcagctagctcaaattaacatctatgaatattaaagaagtgaggaattcatggggctgttccacaaattggatatgtcggtgaaagagcgggtaagaaatgcgagactgcagcaaaatttatgggcggaaacgtgctggctgtatcattccgtttttgctcgtgaatattgttatataccctcaggcggggtcaaactggaggaatcatcataggagttttcgtccttgtatacatgataggtgaaatcctccttgaatacactctatgtatcatgagctatcccgatcttttgacagactcgcaatttaaattcataaaaaatcaattgtacatggagatgtataatgttccggctgtttacccagattcaatttaatttatttgagcgagggagcattataaatagtttggggagtaaaagttcttaaggcttgattcgtacagaatgaaagagtagtcgggtatattgttttacgcaaccgctcaccggggaacttcctaaactgctgcatcaaaagaaaaattattacaatttaaaaaatactgaaatatttccatgatgtaagtgaaaaatgccgaccaattctagattataagggggaacgatatgtgcagatatgcaatgtacggcccatataaagatatatttgcatgctttacctgcaggaaggtatataagcagacatcaaggtttgaaatgccgaaggatgaatatgaacggattgtccatgtctgtccgcaatgccaggcatccatgcatgacatgggtcatgattttcaggcccccaagcaaacggatatcaagcagtggaaaaaggtagagctactatatcaacaaggatacgcttaccactcctgcggctgcggcggccccgggtacagaccctctcggctgtcgaaggtacctgaatttctggagaaccagcgaacgttcgagaataagggggaggcgctgctgtgccggcttttgcaaagctagttgactcgggctaattattaacatgtgagatgaagtgtattatagaaacttacatgttttcccattttccaagtgcaaagaagagcagcccggaaaaaatataagaggttcactatacgtgcttcgttcgctgaactaacgggtaggttagctcaataagaacctgacgccacttcaggatttctttaggctgcatagaaccgatatggaactatgcagtaactgagttcagctcgagccacggtttttggatttgactaatgatagtggaaaatcaaaaaagaacctggatagttttatcaggttcttttatattgcatataaaacagacacgatgatataattagattgtgatttcttaatttaagtgatcataaatatcacatcttatactttaactttaccatgccgctaaactcttgtcaaatgtttttttctcaatttaatagttaggagagatattgaatgagttctttggttctcggttttcaggaaatggaaaaaacgcagtttttgctcgttggcggaaaagggttgagtttaggggaattatcaaaaattgaaggaatacatgtaccacaaggattttgtgttacaacagtggggtatcaaaaagccatcgaacaaaaagaaacgtattatgcattgttggatcgactaacaaggctaaaagcagaagatcgtgctcaaattggtgaaatcagcaggcagattcgacaaatcattatggaagtagaagttcctgccgatgttgtggaagcagttactcactatctctcccggtttggagaagaacatgcttacgcagtgcgttccagtgcgactgctgaagatttgccacatgcctcttttgctggtcaacaagacacctatttaaatatcatcggcaaagaagcaatcttgcagcatatcagcaaatgttgggcttccctatttacggatcgcgcggttatctatcgtatgcaaaatggatttgaccacagtcaagtttatttatccgttatcgttcaaaggatggttttcccgcaggcttcaggaattttatttaccgctgatccgattacctccaaccggaagctgctatcaatcgatgctagttttggacttggagaagcattggtctctggcttggtctctgccgattgttataaagtacaggaagaggcaatcgtcgataagaggatagcaaccaaaaaattggctatctatggacgaaaagaaggcggaacagagacaaagcagatcgagcctgatcagcaaaagaatcaagcccttactgaacaacaaattttgcaactggcgcgtatcggaagacatatcgaggctcattttggttgcccacaagatatcgaatggtgtttggccaatgatactttttatattgtccagagtcgtccaatcacgactttatacccgatccctgaagcaaatgatcaggaaaatcacgtttatgtatctgtcggtcatcaacaaatgatgactgacccgataaaaccattgggattgtctttttacctgttaataactcctgcacccatgcgtatagccggtggaaggctgtttgttgatgttacacaaatgctggcttcacctgtcagcagagaaactttcttaaataccctgggacaatctgatccgctcataaaagacgcatttatgaccctaatagagcgagattttataaaatcgttaccagatgatagaacagaacggagtcccggtaatagcagtaaaggtaggtcgtctgcaggttttcaagcacaaatcgaaaacgatccggcaatcgtttctgatttgattaagaacagtcaaacatcgatagaaaaattaaaacaaaacatccaaacgaaatcaggagcagatttatttgattttattctggaagatctccatgaattaaagaagatcttatttgacccacaaagttcaaaggtttttatgactgctatgaatgcttcgtcatggatcaatgaaaaaatgtacgagtggttaggtgaaaaaaacgcagcagatacgctttctcaatctgtaccaaacaacattacttcggaaatgggtctggcgctattggatgtcgcagatgcgattcgtccttatccggaggtaattgattatttacaacatgtaaaagatgataattttttggatgaactggttaagttggatggtggacaggaaactcaagacgctatctatgcttatctcaacaaatacggaatgcgatgtgccggtgaaatcgatatttcgagaactcgttggagtgaaaaaccaattatacttgtccccatgattctcagtaatatcaaaaactttgagcctaatgctggcaattggaaatttgagcaggggcgacaggaggctttgaaaaaagaacaagagttattagatcgattgaagcaattaccggatggtgaacaaaaagccaaagaaacaaaacgaatgatcgacctgatccggaatttcatcggttatcgtgaatatcccaaatacggcatggttaatcgctacttcgtttataagcaggctttactaaaagaagccgaacaactcgtacaagctggtgttattcacgagaaagaagatatatacgatctcacttttgaagaacttcacgaagtcgtacgcacaaataaactggattatcagatcatccgtaaacgaaaagacgattataaattatatgaaaaactaactcccccgcgtgtaatcacgtctgatggtgaaatcattgcgggtgagtacaaacgagaaaatctcccagcagaagcgattgtaggtctgcctgtttctaccggagttatagagggtcgagcacgtgtcatcttaaacatggaagatgctgatctggaagatggagatatattagtcaccgcctttactgaccccagctggacaccattgtttgtatccataaaaggcctagtcaccgaagttggtggactgatgactcatggagccgttatcgcacgtgaatatggcttacccgcagttgtcggagtggagaatgctaccaaactgataaaagatgggcaacgaattcgtgtgcatggaacagaagggtatatcgaaatattgtaatggctgaatgcgctaagtaatagcctctgtcataatggacagtattaaatgcaacctgtcatggataaaagggcggttaccctgttcgtccttttatccatgacacaaaagatttatacatagctgacccgataatctaaatctcttgtcgtgtgccctcagagtcgaacctgcatattcgcttctgaacaagcctttttcaaccaacaaatccgtcaatagccccagcctcaaaccgctcaataatatcgttcaatacgtcaagttatttggtgatagcttacagcccgctcccttcaaataccaattaaatggaagcgggattgcaacagcaataggaattaggatattacactctatcccgttgctcaggctagctgcagcgatagcttttctaatgataatcttacggtcagggaacccacaattatagtcagttctatgatgtcctttatcgttggggtaaagtgacagacttgacttgagcagaggtatttccgtaaatatccttggccagcccgagaatatgcagcgtatcagcttgggaggcaccatcctgtttgtatttagtagttggaagcgttgctgaccaattggctttatcttctgtaataacgacacgaatgccattgacataaactttaagctgcgcgatatcactttgatctgtgactgaaccttccaaagcgagaacatcatccgtgatcgaagcattcaacttaagtacaggggttcctgtttccttgcgtttaaagggtgggagagtggtttgcgggttataggaaaaggtttcatcctcaagcgctggcgtacgtgctgcaataggacggtttttggtcgcctgctcataggaataagcgtaacgaagcaggtcattatcgctgtatgcggcacctgccatcgtcagattaacgggcataccggtatccttcatagcgcccatactcacagacacacttgggatcccgtactcgcgtagaatgaaattcgtattggagaaatagttgccattctcccaagcctcctcgtaggacgtttcattcacatcggagtcagctttgccgatattcgaatttgccgggaatgcaataaaatcaaggttgttttgcttcatccaatcttcaaaatcaatctttcgtacattttcaagccccctcagaccttcctgaaactgaggaatttgttcgtaaggggtgacgcctttctttatggtttcaatgaatacgtcatagtggccaaggtctctgccacgtttggcatctaccgaaccgggcggattcgggaagacggttgcagggtcgatatttgcccatgacgggaaatttggatcgcccacacttttaaggaattcctcagctgcataaggattaagcaacccgaattccttttcagcccactttgccggcatcaaaccacgctcttcaggtgttttcgctgttggccggtccttctcgctattcgcctgcaaggggaagtcaacttccacaacctcagctccaagagcagttaaatccttaacagctttttcccataatgcctgtatcgaaggtctgaatttgatcggagttgtggtttcatggtccttaccgatataaattttcggaacgccaatgcgtttgcctttcaaagcttgaatgtctcgcagctctaaataggatttgggacggacactgttgacagaagggagccgaacggctttctgctctcgccagaaatcgcccttggtgatcttatcttctacaacgatcacgtcaagcaagcggagcatgtcctcgacagtcctcgtatgtgggacaacgacatcacgtatagggaagagcggccaattcccccgaatggagattaggccccgcgatggcgtgtaggcaattaaaccattgttagatgccggtgatcttccagaggataccgtttcttcccccataccgaaggcagcgaggttggcggctgttgatacgccagatccgttagaggagccagagtaccaggctgcagccaaataatctgggttgtacggactttcagcacggccataaacgcctctttgcattccccctgctgccattggcggcatattggttttaccaatgagcaccccaccggatttgcgtatcttttctactgtaaaggcatcgtcctttgccatcaggtttttgaaagccggagatccagaagcgacagtgagtcccttaaccttgtagctgtctttaaccgtgtaggggatgccttgcagaggaccagtcttaataccttgtgcccttagttgatcagcttgagcagcttcttttagtacgtcggggttcagaatagggatggaattcagtcgaatgccactagaatcataggcatatacccggttaaggtacagagcagtgagctcgacacttgacagtgcccctgacttcatcgcttcctgcatttgagcaatcgtagcctcttgcaattgaaatgtaactagggaagaggcgggttcactagttttactagaggatgagggtgaaggagtggcggatgcaagcgggcatcccgtgaaagttaaaatgataccaactgtgatccatttgcaatagttaccgattacattccttgtattcgcttttagcgttcgtgcgcacatagcattttcactccttaaattaggtaggatcaggaatttaaaaagagggggatgagaaaggcccttttacagtataaatgtttctaattatattacttattttcatatgaaatgtcaatttttgtaatgcgaaacacaaggaaattcgctacttttaatgtgaaatctagtaattcatgattcagattgttgcatcatcgctgaagacaaaaatcaatctcctccgaaaaagaattttatatttcgtttaatcccagaggaagagatgttgaaaattacagacattggatttcatgtggaccaacgtacaggctttcgatcctgcgggtcacctcaacaaagaaggcctgacgaagaacgaagtctatcacattgccagcaacatcaagtttattgaacagagaaccatgttgggtgaaaaggagaagtgaagtgaggaattcagaaggaaagatataaggccgagatcgatggggagtctatcgtatttattattggcatgcgagtaaatcgtctgtgggcgataaataagtggttacctgtttccaaagcaatggggccgattagagaactatacatgaacaaagatctggggtttctcgggattggctggcgaggtgaaccagtacaacagcagcacgttgatgtccgcccaccatcatctgaagtaggagcagttcatgcatatgttatcaaggacaaaaaggaagtctatcaagcgctgaagaggttttggccaaaagcacaccgtgcaataaagacatgcgccctatctgcggagaagtaggccccgtaaatattgtctagacaaaacagcggttctccgatattggagaaccgctgtttaaaaattgtagccggctgcggatcgaccgtcgaattatacaaaaatgagggctatgatattaatacaatgctaagtatcaacataaataaaggaattccactgtcggataacgctaccgaatttgccatgtcagctgccgttgggattagcgacaattgtaatttcattttgcaagatagctcttcttaagtcagtttcttatccggtctataaataaaacagggcgaacgagtctggaactgtaatcttgaaaataaatcgagtcttccttgtgttgtcgcttgccagctctttaaccgcctccttctgcaccttatgctccatcgtttctaacgcgtcactttccacaagcagacatggaatcgagccagcggtcatgaggtagctttcgccgcatgacgtacagtcgaatgagaactccctcttcacaagcgtttgcttgcactgcggacacgcccagttaacgtctgttaatggtcaagcattactcaccgctgctcctccttcaaccatggctaggctctccttcggtgccggaggcatcttcaccaaatggacaattttgaatactcttctacctgcgaccatatcggtatgattttgcgtgccgggtgcctccagccattcccatactcgatcttccccttctaaggagccttcaagcgcatgcaggcgggtatccagagcatcgtctcccgattgtaatacattgcctgtaatatcccggatcaacgaggtgtgaaagcctagtctttgccactgctcttcatagcgcggcacgtcggaagcgctcataatatccgcatacaaaaatgtcccacctggctttaatacacggtaggtctccgtaaagaacagctcaatatgagggtacaaatgcgaggactcgatgttcagcacaatgtcgcagctttccgttttaacaggcagctgctccgcgtcgccaatacaatagtaagcctgctcatatcggttattcctttggcaaaattgaatattggacggcgtcagatcaatgccgaccacgctgccggtcccatagtttttgcatagctcgctcacgttgcctccccgtccacaaccgatttccaggatatccttgcctgaaacatccaggccgccaataatttcgcgaagcagctggatactgctgtggttaataccttgagggccgcccggtagttcgttatcggatgcataaccccagttaataaaggtggaaaatctggacagtcttttctcctcaagcgaccggttaatagagtcaaacatgccgatgatcgcttccttttgcgccgcgccttcggcaagcttctccgctacaggacggtcaattaacatacttgcgaggccctctttccaggcgtattcgaggccgcaggtctcgcagatcaaacagttgtccgcctcataaagatcactcttgcattcagtgcataccagggtaataccggacaaaggccaagtcgttttcatatctacatctcctcatcgttttagccgcttgcgctgctataattatttatcgcctttctccaaatcaaacggacatttaccagaagaaggatcgggacgagcaccgccccatagcataagcccttcatccagcctgttcataaagaaaagtggaccaaaattcgtaataattatctgcattcataatctttactccccatttgttgctttttctgatgcgcgatattttatccttacttacctggcgctaggatgaacactttaccacgatcaatcccccctttaaaatttagaattaatttcaagaatatgaattaaatatacaacttttatgcatatgtttccagttattttacaatagtgatgaataatctctgccaacgtgtcgagggacaagaacattgcaccgtttaaagtcactaatatatcggcttttcgtattattaggacagccagaaaagaaattttctggtttgcctattttaatgggtgttttacgatggtggtagcccggagaacgagggcggcttagggacaaagaacctgtacaaaatccatccaacgaccatgtttgagctggttgagggctatgacctcgtatcacaagctaagctatgggtttggaaaccaggtgggaatgccggtaaatcgaattagggaggtttttatgcaacccgttgttggaattgatgtgacgaaaggatgtagtgttattcaggccttaagtgcctagcaaactgaaagaggcaagtggtgtggagcctgtcgttgtcttcgaggcaaccgaacattaccatcgaggtttggcaggatatctgaaacgtagcggatggattcactacatcatcaatcctttgcaagcgaaacgatccaaaggcacacaacttcgaaaaaatgaaaaccgatgcagcagatgcttggcatattgccgagatgtattaccgtggggatgttaaagcgcatcgcgagtgggaagagtcctacagtgagcttcagcacttgaccaggcagcatgagtttgtgaccgctatgtacgtgcaggcgaagctaaacagctagaattattgaaaaataaaaaaagtccacttctaagtcatgaactgtgacccgtaagatggacactttgaaaaaagtaccctcttacgggtcttttgcgttttaatcagattataaaagtttgtggggatgtagattatgaagaaaatcggacgggtttttacggagaaagagatcaaggtactggagtcgaatccatccgttcttcgcgtatcagagaatatcacgtattcccctgcctttaagattgcggctgtacaggccaatcaagcggggcatacacccatggaaatcttcgtacagacaggattttacttggaactgatcggacaggaggcgccaaaaagatgtctggagcgttggtggaaaacatatgcttcttcaggtgaagctgggctgctggaagagcgtaggggaagggaagctcaaaaagaccggttagtcgtgagctatcggctgaggaaaagctccgtcttgccgaggctcgtatcaagcttttggaagccgagaatgaactcttaaaaaaagctagaagcgctcgaaaggcacaaagacacaatgaattactagcgtcttccgagcgctttcagctcatcaatcaggttgttcgtaaacatggactgaaacgcgtgatttgctatctttgtaagcttgctgaggtaagtacaagcgggtattatcgctggtgtgcggcggaagaacaccgccagcttcgagaggctgccgatgaacgagactttttacttctgaaggcgcactttgatgcacttagagggatggctggcgcgctggtcatcaaaatgaggttagaacggcttcatggaatcgttatgaatcataagaaaattcgccgtttgatgcggaaattcagactcgttgctgtgattcgtcaagcgaatccctaccgtaaaatggctaaagcgacgcaagagcaccgcacctgcccaaacctcctgaagcgtcggtttgaccggggagagcctgaaatggtattgctcaccgacattacttatatgcattatggaaatggccaacgggcttatttgtcctgtgtaaaggatggtgcaacaaaagaaattttagctcactacctgtcctcttcatttgaattgtctcttgttcaacgaacactgaagcggctgtttaatcgtttatcctgaagttcgttccattatcgctaaagctgggtttaaacaatcgatgtcacgaaaaggaaactgttggaataatgcttcgatggagacgttcttcgggcatatgaaggatgaattagagttcaaggattgcttatccctacaagagctgcgagttcgtgtcaacgaatacatcacctattacaataccgaacggttccaatggacattaaaaaagatgactcctgatgattgatgaatagggacccttttcaaaaggatccacaaatggggtcacagttcatcaccaataaagatatgttaattctatatatagtaaatataacttgactaaatacatatggatggatttgatagataaaaaaatcatgagttttaacaatgaaaaaaatgacctctaaatcattgcggagggttgggactggctataaaagcattacaaagcacaaacgcataaagccaaaaggcacctgaaaccgtaatttggtttttggtgccttttgtattaagactgtagtgagccacctcttcgacgatatcaccttaccgtagacgcgatgaactccaaaatcagcgaagtgtccaccatgatggatcatattgtttagtagacctcgcacgtggtggtaagcgatctagagatacaacctgtgttctccaggagaatgtcaaagagataataaagctttagaaagctaaaaggaactgcttttcctatttattcatttcaaaaacgaaaaattattcagagaattagtcaaaaaatccaaatgtctaaattttatttgataaattggatagtttattgaaaatcataacatcatttgggtattcaatggtttacattttatttactgaataattaaatgcgataaggagaactcaaataaaaacggccgttttcagatgaaacactattaaaatgtgcatatgtaaactaaaaagtttattttaatttaaaaaataatgcgaatgtgaaaaaaagtttgacatttgtacacatgtggtttattttgttaaatatgggcattttgttttgagtgctcttgtagtttttcttggttgcttctatagaaaggtggacgtaatatgtcccgaacgagttgaatcaattctaatatggatcttatttaaacccaaaggagcgtgagcaacattaacaaaatgcacttatcagatgatattagcagcagaaaaggatcaggaaatctgtattacaggtagacatataggccccaatttcattcaacataccccacatgatacacagcctgacttcggcagcatgcattgggggcatgcggtaagtgaggatttggtgcattgggaggaacttccaccagccatcccgcggggggaagacggagcgatcttttcgggaagtgcagtggttgataagaacaacacaagcggtttcttcagcgaagaaggatcaggattagttgcaatttatacgaatgagggcaacgtggctcagcccggcaaaccacaggtgcagggcatcgcttacagcagggataaaggtcgaacttggataaaatatgaaggtaaccctgttttgttcccaacgaaaacgctagactttcgtgatccgaaggtgttttggtatgaagaatcgtcaatgtgggttatggttcttgccgtaagagaccgcgtcgacttttacacgtcttcgaatctgaaggaatggtcttttgcaagcgatttcgtttccgatattccgggtatccatcgagggatatttgaatgtcctgaggtatttaaaatccaagtggatgaggatcccaatatcactaagtgggttctgttgctaagtgtcggggatagaaatggtgtgaatccaaacgattcagaaccaccagcaggcggttctggcatgatgtattctataggcaactttgacggtaagatatttacaagggatgaaacgttggaatcattcgatacgatcaaatggatagattacgggtctgacttttacgcggccgtgacatgggatggtattccgaaagaagacggacgaaaaatctgggtcggctggatgaacaactggcgttatgcctctacccttccttcaaaggaatggcgtggccacatgtcaatctcccgagagattcagcttaagacatatccggaaggaattcgcttaatccaagtacctataagagagttaagttaactcagaagaccgattatgtctctgcaagacttaacgattaagccaggtagcaacgtcttatctgatatttctactgcaaaggccgaattattgcggaatttgaaatcggtactgccgtggaattcgggttcaaggtgcgttcctcttctactcaggagacaaccatcggatatgatgtcttgaatgaggagctgtttgtcgatgggacgaagtcaaacgcaattgatttccattctgattttgctgcaaagcaccaagcccccatgaagccagagcatgaacggataaccttgagcatttacgttgattggtctagtgtcgaggtcttcggcaataaaggaaaaacaattgtttcagacatgattttcccggacttggaaagtagaggactagaactctatacccttggcggagaactaaaggtcgtgtcgcttcaaatcaatgatctggtaagcatctgggaaaatgagacggtttagactttagcaatggcttgattcgacgaaatggttacagtccggttttgggcacccggatctgaacttggtaccccaaactaattaacgaagcaatcactcctgaaaacgaataaggactacagcgttgcggtggtccaggaagtttgactctatctgtgctgtcagtctgtagttcttagctaattgacactaaatcaaattctctcccaagggggtgtctaattgcgatccaagatattaccgatgcagtatccggcaatcacctcgtggcagtggcaggcaaatacgtttgccgtcctagccaattacccgcaagcaaagccgtggataatgacacatttcattcctctccagctcaccttaaatgagggaagttcctatgtggacttctaccgtactcctacctttgaattttgtccttggctgcttcgccaacatttaagtcgtcagttggttcgaaatttcaacaaggatatatgtacttttctgatggattgtatagacatgaataattatatttatttgcttcttgatcaagcgcagtttttggatattgaatctttcttctcacatgactcatttatttttggttatgacgaggagagggacatatttcatatcgccgattttacattcgcgggggggaagtactcatttaacgaaatcacatttgagcaaatgagacgtgcctacgagggaatcgatgatgatggagattggttgtatgcgtggaagggtggtctctctctgttacaattcaacgagcgagcagcttatgactttaatctaaactatgttattgagcaccttaaggactatttaaatggagaaaatcccgccgacaaatacagagagttgggttatataacaaatccatgtgtatggggaattcgtgtttatgacgagctgattttggatataacccgcatacgcagtggacaaattgaggaagataatcgcccgtttcaaatgatctatgatcacaagatcttgatgttggaacgaattggcttcatgaatcaaactggtgttctaggggaaagtaatcagctcaaggttcgctatcagacgattgccgacgatgctctattagcgcgaaatttgattatcaaatattcactgacgaaaaacgaagataacctcaaaaaagtggaagtgttaattaggcgtattcaagcctgtgagcgcgaggctatcgaacttatgatctacaacttgagccttgtgtcaaacataactccaatgggcgtagaggaggaggtctaacgttgagaaaacaactctgtttggaacgcatccaaaaccttattcatcaaaagattccggactacgataaacaacgtataaacgctaatgcgttacttgaagagatatggatccaaatgaattctatgcagatgattacattcgtcgtggagctcgaaaccgaattcggtctagagctcccggacgaactggtaggtaacatggcaggcagtcatctaacccttggcgacttggctgatcttattaaaagttaccaggaacgcttatagcaagcggtacttgatcatgcacactcacaacatgcagtctgaagcaatatgagtttggatcaggctgatgctctggcggacggcacgaatgcgcatgttgaatcacttgtctaagcatctcccatcgggagtgccataatagacggatctgggagcggtattccaggatggccgcagtcttctgtttcaaactgcacttgggaagtgaaatgtagactggatgtagattccgagctaggtcaatttcccattttatatcttgaccatagtttaaatacggtagatcttcgtagtaaatcaaacgggcagagacttccagatcactaatacttcgtacagcctgttcggccgcaacccgcacgataccgtgatccacatgtcttccgattgcaagcggaatataaatatgatcgtagtctgtaagacagagtcgtgtcaaaagaacttttgttgcctcagaaatcacgtccagctcggtctcgtagtcactacggaacagatcgtccagcttttcatatgagggggcaccgctgcgatctttacgatagatacattcctgcatgttcagatgaatcgtgtccacatcgagaagatcacatgcactaatgtcctcttctcgccgtaccttcatcacgtcggagcttagtccgaactttttgtgcaggatgcgagcaagtagggatagatctgtgccagtaccagtgaaaacagttgctatggtcacatgatagccagcacgaacaagcaaatcgatataatcgccgcaagaaataatagcatcatccagatgggcggagacaaacagacagtggtgattcaaggcttcaaaccctccctttaacagtgataagtaatatattactattataccttttatttattttttttggaattaaataaaaaaatcgaaactacaagttgaaaggatgacgtttatgtttgaaacattaaaaaatatcattgcaactgtgctcgaggatgactcgcttcgtgaaactctcacaatggagagcgacctgattaacgacgtcgagttagattccctacagatgataacgtttattctcggagttgaagatgcttttggggtggagatcgtttacgaggacctggacttggcttgtctgcgctcaatcggtgccttcatggcattcctaaaaggcatgaatcaagaggtcgggtagtatgttggttgccagcacctttgattcggaaacctattggcgtgaagaagggagtagcaggttgccttttattcctgatccttcacggtcgcgggtggtaatggctatggatgaattgctggcttccttatgcggcccggaggacacactgttgacccgctttgagatggatgaggcgcacatggattatttggcgcacatcggcttacattttaaacagcttagtgcgaatgtcccaagccatgaaccaaatctatttcgcgctctgtacgaagttccagagaccgacgagcggctgaagcagtttagtgaaatgactcccttttcagtcgtaccttacgttcacgagcttctcgacaggtacaactattcgaacaagctgcccacccttcaagacgttaaacgagtaaattctaagttgtattccgccgatcttgctaagagacttctgggcagctcctatagccagccagtgttcagcgcggatgaattggctgcagtagggcgagagcttatggggttgtcgaaaggggtcctgttaaaagacccctttggcgtagctggaaaaggcaatatgctgtttaaaaacctatcatctttggaacgtgtagtaagctatttgcgcaaacaagagcaagccggttcctcaacggcgtttcttgtcgagccgttccttgacgtggaatatgatttttcctgccaattttcaattgatgagagcgggtcgtaccagatcgtcggcttgcagcaaatcatcaatcgacagtttgcttatgtggggtcacaagcgatgcaggaggagaacagtcattcgctaatacggaacggttacttcgatgtcattgagaagcttgcttcctcactatacaaggacaggtacttcggccatgtttgtgttgactccatgatactaaaggacggcacaatcgtgccgattgtagaaatcaacgcccgtcaatcgatgggactggtcagtcatcgactgggggaacggctggaaaatgggaagcacgggacatttacgttccgaacggtaggcagtcgccatcggtttgattacgggaagtggctgcggcagctggatgatgacggcgttttataccctaacaataccggtgagggcatcattccgctttccccggcgtgcatgtttgctggctatggggaatcagattacccacagacattaagcgaaggcagtttcatcaaggggaggctttatctgtttgtaatcgcgagagatgtgcaggagcagaaaagtttaatcgacaagctaaaggaacgttttgaagtccagggaggcaagtggtatggatagtcatttgaagccttgtgtcactatacttggatccggtaactcactaggtgtgtacatgccagccgtacagctaggcatttacctggagcgttccggcatttcaaacgaagtctgtgtgctcgaaaatgtgtatgtcgacggcgtaaagaacaaagtgccggcttatcgcaaggcctttcatgataatttcgccatcgcccggaagagtgtggagttggctcgcgatatttcagattgcctggatcccaccaaggtacagctgctgctggaagattggtcccgtgagcgccggacgtcgttcattgcgttgactgggttctggatcccgattttggaacaatatgaacagtttgttggaactcggctcgaggtcgacatgcttcatctcgatgctacgctttcgccatcttatttggtctatggatctcgaagcgagcggtacaaccacatttggttttacgaaccgaccaagaagcgttttgaattacaacttccgatgacggacgaagcaccgatcccgtttcgccagcgagaagagagaatggtggtccatggtggcggctgggggattgggacctacccgcaggctgttcgagacctgcttgaaggaggtatggagctggatgttctggcttattttgacgaggatatccagcctgatccacgcatttgctattatcggaacgacccatcgtggagtccgtggctgaggaatagacggggggaattcggttttcctccatttgctcagatacaacatggagagactcccatttacttagacagcggaactactcccctgttatttgaacgaattcgccgttgcacagccattgtcagtaagccggggggctattccttgatggaatcgttcgccgctgcgacgcctatggtttttcttgatccctttggaagacacgaaaccgccaatgctgaatattggattaagcaagggtttggcgtgtcctttacggattggaagatgcaggggttcaacatcgagatattggaacgtgctcattgtaacctactacatgcccacgagtattgcaaaacttatggaggtgtaaattatgcaacccaaaacgagtcggaagtttgatgagcgtgtgtttaacgatctgaagcgtacaattatgaatatgtcccgggtcagtcggcttcgagcgaccgatagtcgctatgcgatggagatcccggaagatatcgggatcaagctgaacaacgggtgcaacttgcgttgcaagcattgctacgagtggaactcggacggctttcactgggacatgtccaaggaggagcaaggtaaagaaatcgatgtcgcgttggtcgataagctccttgcctttacccatgagaagaagtcgaaagtctatctttggggcggagaaccgctgtaccatagcaagttcgatcagattgcgaatctgctggaacgcgatcagcggacgacgacgatttgtacaaacgcgattcttctggaggaaaagttagattcactgcttaagatcggtgagggacttgttgtactagccagtctggagggattcgaggctgagaacgacgcgattaggggcagagggacctacaaaaaggtggttagtgccatagagcgtctgctggagttgcaacggcagggcattttcaggggcagagtatccgtcagcttgacgatgaatgatctcatgattcccaaaatgtttgattttatgaagtttttcgaggagatgggcgtggattcggtctactttgtatatccgtggtatatcgcacctgagtctgctcaggagatggacaatttcttcattaaagagtttgactggttggatccaatccgtcagggtaactgcagttggaattcattcacttatcatatctccggcgagaaggtgggggcactcaaggaggaggttctccgcatctccgagcaaacatggggaagccgggttcgatttatgcccgcattggagcaagacgagatagaggattttgtcactggcgtgcagagaaccgggatgaagcggaaggaatgcttggcgatctccacccgaatggacgtattgccgagcggaaacgtcactccgtgcaagttctttcctgagatggcggtcggcaacattagtgatgtggatgtgaaggaggtttggaagggggaaaatttttccaaacaccgagaggtattagcttgcggactgatgccggtctgttcccgatgcgggttactttatcattatggccggtaaacgttatcgtccaccttctagttcgatttaattgttaaggaggagcgcaattgacagcgatccatgtggtgcagttagctaaaaacttcacctattacaccaaagaggtcggaatgcttcattccattaaaaacctcttttatcggaaaagtttgacgaagaaagcggtgaaaaatatctccttttcgatcgaagagggggaaatggttgctttccttgggcctaatggggcaggcaaaacgacgacgctaaagatgctctctggcatcttacatccaactagcggcgaacttactgtactgggcttcaagccttatgagcgaaataaggaattcaagaagcagttcgctattgtaatggggcagaagagccaactatgggttgacttgcctgcggcggaatccattttgctaaacaaatatatctatcaggttgacgatcggcattacaaacaaacactgaacgaactcatcgaactgttggacgtcaagcacattatgaatgttcaggtaaggcgtttatcgctaggtgagcgtatgaagatggagctccttgcggcgcttattcataaaccgaaactgcttttcctggatgagccgacgatcgggctcgatattgttacacagaaaaaggtgcgggagtttttgaagtattacaatgaacagcataggacaacaattattttgacaagtcattacatgaaggacatcgaggatctgtgcaagcggacgatcattattaatgatggcaggctcgtcttcgacggggatctgaagcgaatcgacgatgttttgaacgacacgaaaatcatacagttaaaatttaagcaacacgtagcgactggacagctgcagttgtacgggaaggtgcgtcaatcggacggatttcatgccacgctggagataagtaaggagcgcattagcatggcttccagggatttgcttgaacactacccgattgaagatattacgatcgaagatattcctatcgaggaagtcgttgtatccttgtatcagcgggatgatcgggtatccggatgagtgcctttcccaaatacggacgcgtgttccagttaggcgttcagtcttcactcgaatatcgatttgactttctcttttccttgatcagtgcattctttccgattctgatccaatattatatttggtcagcggtctatggaagatcggaatcgtcggaatttttcggatatacctatggccaaatgattttatacacgataacggcagccatcgtgacgaaaattgtgacaacggatataggtcaaaacgtggccaccgagatcaaggatggtgggttgaataaatatttggttcaaccggtcagttttttcgctctgaagctatttactatgctggggcaaaagattttctttttttcagccatgctatgtatcttgctgtttacactcgtttacttgaccggaacttatggtatacggattcccttggcacatattctactctttatggtgtcaatggtcatgtctttgttgttaaactttcttatctcttatacgctcgcggctgttgcatttatattgtctgaaatctcctatttttttgaaatgaccggcttatttgtcatcattttaagtggtggtgtttttccgattgaggtgtttggtaagaccataaataagattttagactacttgccattcaagtatacgatccattttcctgcgaatgttattaatggcagattgtcaatggacgaggcagtacaaggaatcgggatgcagttcttctggatgatcgcgctgcttgccttttcacggatcgtatggcgcgccggaatgaagaagtatctcggattggggggctgactggtgagaggatggctgggaacgcttcgcaactacctaatgatttactttttgttcattaagaactgttttattgctcaaatggaatacaggacgaacttcatactcgggattgctgtggaaatcgcatacttgtttgccaagctgctttacgtcgtagtagtctatgagacggacttgcatatcggatcgatcacgcctgatggtatcttgatgtttgtcggcacatacacgattatgaccggtctttattccgggctctttttccctaatttcgtcagggtatccgagtatatacgcagcgggacgttggatctactcatggttaagccaatttcactacagtttttggtttcgcttcgatacatcgatcttgggatgccaattccgaatttcatcgcgggtggaacgatggttgtgatcagttggaatgcattaaatatcccggtaacggcatggagtttattctcatttttgttttacttggggacagcgttgatcattacttactgtctcatgttcatcccagccttgttatccttctggcttgttaatacgggagggctggcgggaattttctattccatttgggacgccaataatatgccaatgccgatctattcacgtttcatccaacgaatcggcgtgtatttattgccttttctcgtcattacgaattttgcgcctatgatggtgatgaatcagctgacacctgctttggtggtatggggcgctatcgtaccaattgtgctccttgtaatcgttcgcttcgtttggagtcgggcaatacgtaattataacagtgcaagcggctaaaggctgacaacttaattgagggagggaggaatgacatgcatatgcttcgttggccggcaaccggcattgccttagtatgtcctatttgcaagtcaaagctaaacacatccgatcagatgttggtgtgcggggagtgcgcggtcagttacttcttcggtgatggtggtgttccgtttatgctggctgatctgcaagggcaggaaagcggggaaactgcagtcctcaaaaaggatatcatgaagatgttcactaactataatcggtccttggacgagagtggcttttcccgtttctcgacatttatcaattgggggttcgcctccgagttcaatcaggccccagcaagtgtcaatcaaaactccatccggcttctgcaggagtgcttggatggtttatatctcgaggataagaacattttggaggtagcctgtggcagggggggaggcgtgcgagagctctgtcgaagttacggtgtgagaagcgttgttggcttagatctgaccgaagccaatattgcattttgccaattgaccaaccgtttcccaaatgcctatttttgtgttggggatgccgagaggcttcctatcggttcgtcatgctgtgattttgtcctcaacatggaagcgtctgatctatatccatcgattaagtctttttatgacgaggtcttccgggtgctgaaaccgggcgggactttcgtttatgcggacgatttgccaacctggaagtttgacgatggtgaacgatatttgcttgaactgggcttcgagctgcttatatcacgcgatatcacgggggaagttttgctttcaagtgatcaagttctaaagaatcgcatagccgcttttggtactgaagatcagatggatactgcgatttggaaaacaatgggtgtgccaggcacttccttgtacgatgaaatgaaaagcggggaacgccagtacaagatcatgcatttccgaaagcgggctcatcacaatgtatgagaaccacgtgacgatcgtcgattattccgtctatctcccgaagtcccgtatccatgtcacgaaagcgattcagcaggtgaaggccgacggcgtagaatttcgaatgagcgattcggaatacttgaacaaaggctttgagctggtgcccatagaagaggaacttgaattggaacagatgattgctaccgtgtgtaggccaattctgcgccgggctctgcagatgaatgtacagatcgcggcggtcatgtttgctagtgtaacgaataatgaaaacggtgaacggaatctttttgatcgcctagcagatgaattcgcccttgaggcagtctcatttatccctttggaggaatattcttgttccacgatgcacttatccttgtgcctggcgtcgaactacttcatggccccgcgtcagcaaggtgaaggaatcttgttcatcactgccgacagagccatgaattcttatgaacggagcgatccgttcatggtgttcggtgacggcgcgagtgctgctttatatatgaaggggcagcgtcaaggacagcagacacttgcttcggttatgagagtcgacggcctcgtatatgatctggctccagatcgtattcaattatattactcaacgttttatttaggggtcagacaggcagtaagagcagcattaagcgagtccggtattcacattgctcagatcgccgtgatcttttgcaccaatttggggctacacgtatggagtatgctggctcaagtgctgagggtgtccctggaacgcttctacaatctaaccctctccaaggacggacatattcataacaccgatatcctaaataatatcgatcacgctatccgttcaggtttcttgaaagaaggggacttgtatatgacgatttccgttggctttggaggctattacggttgtgcgattcatcggtattccaagaaggtgaacgagctatgtatttgacatttcatcatgctgaggccgctgtgggattagaaatgccatggggacggataaccgatctaattgaaaagaataggaattggaccgaaggaattgacttgctctgttactgtcatcagacggactttgaagctggtgttaatggctgtgctaaactgagacaagaattagggctaaatgaggttatgcccatttccgtcgggcagtctggtagcctttctctatctaatgcattaacaatattagactggatgttcaatagcggtacaaaaaatcatgctctttgcgtcattgccgactcattcattccagatcatatcgacaaacaagggagttgcttgagtatgaccgcactgatcggtgtgtcgactatggccggtgattatcgagttgaaagctgccgtaagcttccaggcaccaacgttaaagcaggagcaaaaagcgcagttgaaccgatcctaaagcttggactgcaccaatcagagtttacaagcgatctggagatggaagtcgtcacgttcgatgctggagtcttcggtgcaagccaactgaagttacgacgaacataatttcctcgtacccaccatcttaccaaggccatttaggagaaggattggttttttccatgcgctccatcgtgacctcgggatattgcttcttgtcgagggacaagaacattgtgtcattgaagtcgctattttagcggcttttttattttatcggtaaaagttcgtgtcccgatccaaggacaagaacttttaccgattgccgattagatgtgtatcgctattttaggaggataggacgacttttattgtgggatgaagttacagggagttgaaagtgcttttcaccgatcaaggggttcggtgaattttaaagtcagattttgaatattgagagtttgtaaaaaaggacctcagaaactgaaaaatttcgaggtcctttactgcggatttggattgaaaacgacgttgacggcaagcatcatctaagaggactcccagcgggtgaccttttttttgtaaaacctttacaaaaatgcgtaacaggcaggaagcccttgattgggagaaagcgaatgctatgagtctatggaaaaaaggcaattcaatgagtagacatcaacaaccacgtccatgggaagaatagagggagatgagcgtattgtatctaaaagcatttgatctagatttaccttatataattaatgatgaaaatgttgaatcaatgaagtggggcttttataaagttttatttatcatgaaataaattagagatgtataatttatcaaataatcttgaaaatcgcaatgctcgttatgagtgaatgcgccgctagacatttagtcaaaatacggattttgtgaagatgtccaagaggaaccgcgtagcgacacggtttcatcggtccatattattcacagcattacgcatctcttcatctgttaagtgagtatatatcattgttgtttgaatggaagaatgccctaattgattctttagtcttgggacatcgttattttcaagatgatatcgcgttgcaaatgaatgcctgagcgaatgcactgttagagaaggtttcccaaaggcagttgcatatttttcaatcagcttttcaattgatcgttgtttcagacgacggctttttcctttacgacctacaggagctgcaatgaataaatagttttcttgtttatctggtaaatatcttgtttctctgatctgcagataactttctaaatccattaaagcctgtttgctaaagtaaacgtattgttctttatcacctttacgtaccactcgaactaaagctttattcatatctaagtcatccatattaattcctgcaacctcagacagtctaagccctgaacctaatatcagcgaaacgattgctgtatcacgctcacgattaaactgatgaaacgtaaaaatacgcttgttttctttatgtttttcaccaaaatcataagctacaaattgcctgaatagttcgaaatcatcatttcttagaatttttccttcaatacggtttgcaatggtttcttggctttctttgatagcattcaaatccatcttggccattacatttcgttgaatataaggcttcaagtcgcttgtttcagccttattctgaaggtaatcaaacaacgattttagagaggacaatttgcgatttatcgtaagtttcttgtttccaagttgataatccaggaatgacaagaagttttccacttcacgtattgttaataactccaatgtttctaaggttatttctttccgatttgatgaagttagattctctgcaataagccaatcgaaaaaaataatgtaatcatgacagtaattaagaagtgttgttggagataacttgcgttttttgctatcgataaattctgtaacgtaccaaggtaaatcagatagtttatcatcaattcgttgcatatagtgcattttcatttgtttatccattatatgtacgtacctccgtattttcaatatatctcattctcatttattcgtcaaattattattttacgtaattttaatattcatcttacattatggcatggtaattcggaatatccctatgaataggagaattttgtttttttcagcacacgttcaacccaaagtcttttggcttctgctttatcttgagctagcttggttccacagttaagaaaacccgcctaagcatgggttaaaaagttctaaggcttaacatctgttttatcattctcgcgataccgagtattaatctaactttacccatctatagaatatagatagcatttcacctagatttcctgggccccctgcagaaaataaactgctctcgatattgcagtgaatccagtcatcatcgcttctctctattataagcgcattaaattttttgtttctagttctgtttcttttaaattaattttaatatgccatcctgggttatcaagcgttgttatttttattcgttcttgatgctcccaatcttcatcgcagtgtaaataataccattcttgtaaccaagttaatatatccaatcattacactccttatggcttacgtaaatttttcgtcacaggcaaaaagattggatttttggatcatcataattacaaattgctaaaacttttattttatcagtacttccatcctctagtaaaacctcaccatattcacctatttctgaataacatatcagtttagcacctcagtttcattaagcatttactcaccttgttctttctaaactttgatttgttgattttcacagattgatctgttctaataaaattcccttgagtatcccactcttctaaatgataattctgcaatgaatggatttatttcagtttaagttcctttccctaataattttctatatcgtccattgcatctataacttaacatttctatactgtgtttgcctaagttgcttccagtacttttcctcgcgctcttcctgagaaagcttttcaccatgttatcctgtcgttcaaacaaatttaattatcgaccaagcccctgttctgccataaaaaaacaactcaccaggagttgtttttaatattcatgcttctttgtaagaacccacgtacctaatctgtttaaaatctttggataatccatggataaatgtatttctaatgatctttaatattcattagatactcaactaaggtcgcaaaaccaatgattgaggagaaaatccttcttgatgcgccttcttcatgacttcgctttccggccgacgtgtccggtttgaaattcttattttgcctgttatagatgcggaggacattagctcttgcttggtttgcacattatccgtttcgttgcacaggcctccgccaagatttttaaagcacacggataaagattgaaggcaaaaaaattcaactcaggagttatatatatctctattcaggttcacaatgtcttggtgcgaatatcctccagtagctgccgatagcttctctatcactttatcgcgttggaatggagctttttctttatttgctttttttaatgcttcggttagttcctctttggtaagttctgtgcagtacgcaggggttcctggctgttgtcgccacgaatcacttaaagatccgctatctactgggtcgaagccgagctcatttactacgttcatggttatttgtttatgcgactggttatcaccagcaatcgctatggcaagtcgtccactggtaccttcgggagctcctttatattctaacgtataggctaataaattgttgaaagctttagtgataggtctccctaactgatttgatacccaaacactttcaaccaacccattctcaatttcttcaattttattgtctctatacggataataatttgaagtgtcaacaacgactacttcctccccaactttatctacaatgctgcgaatgcttggcagtgcgttgaaagggatcgatatgactagaacagcaatgtttgttattacttcatctacactcactggtgtacctgcaagttcttttccctctagccgttcaatcccgcgagcatctgcaattttgacatcatgtccattctcaattaatttttttgcgatattcgacgcgatgggtcctgcacctataattccaaatctcattttcatttctccctattctaaaagttattttacgtcgctgatcgggtagtaagaaattattattatttattttagacttccgtattggtagggaactcccatattctctgtagaacaaaccgcggtcctgcaaaattgggacaaccagttccacaaaatcagcaactccatcataggctatatccagaacaaccgagaagccgtcacatgcctctgccaaaaaccattcttccaagaagtcagcaacttgtaagggggtccctgcaactaccggatgatagttaatgactccataggcaagtatgtctcgtatcgatagcccttgtttaacagtctgatattatcatagacggctctaattgctctttatcgagtggctgatactggttttcaaataataccatggattagaggtaaccgcggcttaagagcaggcttatctcccgacagaataccgatacatagccccacccacggaatcacatatttaggtaaattcgtttgattagctgccttaaagatggcctcccgttgtttctccgtcagggtttattcgcataagaacgaacagaggtatgattttgaagtaattcaagcgtattattcaaaggatgggtctccgtttttacttaataccagctgccaactcatcaaccacttcttgtacagtttggatctttttgattggcgtaattccagtaccaacagtgataataccaccttcgccgttaccttcaagcataccgatacggattacacttgaactacccccaaccttagcaatttcttcacgagatgcgccctggttatccatagccaccaatttttcagcaaacggtgtaggcaacgaacgatagtaagctggtaaagtacggtacaacaacaaatctgctgcagatgaatccactatcatttgctttactgattgtgctgcggggttttcaacagtaggaataaaacggcttcctaaaaagacaccttctgcccccaattcaaaggcgctggcaacaccgcgagcatcaccgattccaccagcagcgataactggaatatcaagcacatcaacgatcataggagttattgtaaacgtaccaatgatacttgttggcaatgttccaccctcatcaaatccagtaacaacataaacatcaacacccatagcttgagcagcctttgcatcttcgatcgttggagtcaaaggacgataaacaatcttaatgcccgcttcctttaatggggtaatgatcttttcagtcaatgttccttcaacaccattaagaagaataacttgaacaccttcttcaatgacaacttctaaaattggccaagtgaacttcatatctgcatcagtaatcaaagttgtaccaaatgatttatccgtcagttcctttgttttacgaatctcgcggcgcatacgttctgcggtttcctctggagaggttgtaattgtcgtttgaccggcattcggaccaagaatccctaaaccacccgcattactcacggcagcaacaaattcagcattcgtaatccaactcataggtccttgtaaaatgggcttttcaataccaagaatttctgttacacgatttttcataattattatcctctctttagcaccattattggcataatactgtaaagcttaattggtctgctctccgggttatgttacaataatcattagcttgctaataatatttgtattagttagcagccttggcactatcataagtccatacgtttcatttgcaaagaaggcaatttaaatgaacgtagtacatatttttgtacttttagactgggagcgatatcatgagggtatgtaatgaaggatttgaaaaagagtttattgatgaaaaaagaaatatgtacgcaatagcctttacgcaaaatgtactttcggggcgatggaaatatttcattatctggtatctggaaggggaaagacgccggtttaccgagataaaaaatttcctgagaggcttgtcgcaaggctcgctcaccaagcaactcaaggagctggaggacgacggaattattcagcgcgatgtgtatccggaagttccgccacgggtcgaatattcgctgacagagaaaggaaacaaactgctgcctgtcctaaagaagatggaggaattcggtaaagaatatggggagaagcctgaattagatgaaggataaaggctaccccctaatcagccagcacataaaatctcgccatctggaccaaatgtatgttcaggattgctccttcagccagccattctagtccacctcaaaaggaatggccttgccactacttctaattgcataacatatcgagtaacagtaagttaagccaacctttggggctaggcccaaaatatcgaacctggtcaaatcggcaatagtaccatgttcttgtccatttcggcaaagggaccaaattcttgtcctttgcttaggacaagaatttgtaccgttaaaagacaagaacttgtacctattggcgttttttgttcgccctctttactttatattagcataataaaaaaaaactttgaaagcgacagacatggtcttgtgtgtcctgcattctttctttgtccccaactcttctaatgaagctatttaaaacccctaacaattaatgttaggggctaacttcaagtgaaaccagtatatcgcgcccgttgtggccaaagaatacgtccaatgatccatttatcattttacttttaaaaagtgtataactcaatttattaccaaggtaaaagcaaagcttatcaagaacatcgaaaaaaatcctatttcaaaattattctttgcatattgataagtctaacaaggcaattaattaaaatcttgcattaagtcatcaatcactgcttttacagttctaatctctttaattggagtaatacctgtgccgacagtaatatagccatccacttcgttaccctctagcattccgatacgcagaccacttgctccgcccattgcttttgctcttactgatcaccccttgttccaccaattgcgaaccgtgcttgttctgcgggcaactgttccgcaatttcttcctgcggtgcatctggttgaattttgacatgaacgagaaaacgcatgtttcactcctcctaatatgttaatatactgtataatccaaatctcatttattatagtttcacacgatcaataccaatactttcactacaagcatcgagtagggtatttttattgaaataaatgtgggtacgtgggtacagggaaggaactcctccggcaagaccctgctgtacctcccgacttgtagcatcagtcaacaatctcgtagaggtcggcttcaatcccatcgattgcggttctagagatgtcctttggagatgatttaggcgcatggatgccagctgtcatgtccgtgtccataaacgctacatgcaatccggcacccctaacgttcttagcagctaattctaagcgtaatgcttttgttactccccattgagcagattttgcagctgaatatgcccctccttcgtctatattgatccaagataatacggataggatattcagaatcgaaccccctccattcttctcaatcactggtgcgaacgtgcgaatcattgaaagtgtaccagaaacatgagtgtcgaattacaaatgaatatcatccagctcacctgtgagcagagaagcacccgttgctgaaccagcgttgttaattagaagggtaacatccactgcgatctctgctgcagctaccacagatttcggagcagtaatatgagttgtagtggaatagcaccaggcagatcgactgattctgggttcctcgcaccagcgtatactttagctcctcttgctaaagttcaagagctagatgtttgcctaaacctcgatttgaaccgctgacaatagcaacttgttttgaaatatccattttgctacaccgaatcattaaattaaatacatttttatctcccatccaaataaaattggttcagcttcgttttacaagtacctgccgttctcctttgccatttcgaatgacaagctgctctgactattcggtttgcttggagtgactgcaggactcacgggtactctgtattgacaaggtcagttgttggtcttcttctttacctgaacaggtacattaaaatcatcgacgttaatatgtccaaatccgcctttggattgatccaccaccttaatgtaaagcacctggccaatataatccgacgcatcccaaatctttcgttgatattcttcataattggtcgctgtctctttaaataactctttgccgtccgacgcccgaaccagcgcaacatacagacgatctatatcccggccgccgctgataaggaagttgatcttaccgttcccaccaaggacgaaattttgagatcttagcgctccggttaagctgtcgccgccggcttgctcgttgaagccccacaaatggtagccgcccggaattttatgcgacgggttgaagtaaatgttgtcccagaagaactgggtattggtcacatggacattctggaaggcgtctccttccgtcatccatcctgttaagtcgcccgtagcaaaatcatggttaggcaactctgtaatatccttatacacagaattatcccacttatcgggtacatagaccggagcagccggtttacccgttaaggcattcatatcccatacttgcatggatttgatattgatatcgccatcggcccagatctgtaagcctaaggagtcgtatctgcctacatagacacgagttgtcagcttcttcttgtaatttgcaaaggattcaatgaccgagcgatcgagaaagatatggagtttcaagttctctccttcaagatctacatatcctccttgaatgccgtccacacgcacatccggatcaatgctgctcttggttcgatccacattaaacgtcccgttcttcttgtcgtagtaaatgagcgtctcttcgtggcctttttccgagcggcgtaccttgagaccgaatttctgggcctcacgcggatcaatctccatcacaatctctagcatgtcgcctttgacattttggatcaattgattggcgctctccaaatttttgtccgaaaaatcaacccattttttccctcgaaggctctgcagttctttaatcggttcgatatgcaatttatcatgcttatcgaggcttagggaaaccggcaaagataaattatgagcccatccagattgatattcggcttgcggtgttcttacattttgcaccatggaaaatacgaccgttcttccgtcgggtgtgaccagaccgctctctgcggttaaatagccgtcacctacatccattttggagggtgcctccgaatcaggaataaatttaaagttatcccggtcccaggtcccgatccagtaaaagacctcaacatctctttgcacatcgttcgctggaggaacatgctccggcttttcatggggattaatcatgaaaatatattttttcttgcccgtactatctgtgcctaacggcaataacactggtagctcccataccgtacccaactccggataacggcttctgtcactaacgtataacggccccttatattcccaattgtacatatcatcggatacatacaccaaagctgtgccgctgctgaagtctggaagaccagatgtcactaactgataccacttgtccacctctttgtcgtaccatacaaacggatcgcggaactcgttgtggatgccttttccgttctgctccgttaccggtttaggatatttcacccatttttccaaatagggatcggacaaatccgccggagatgccaaccctgttctttggttcggcgacaaggagtcgttgccagcggtatagaacagaacgggattgccgtttcgatcatacgctgcactgcctgaccacgtgccgtccggatctagggtgcccgcttcgggcgcaagagcaggtcttacattttcccagttcaccatatcgtcactcacccaatgcccccagtggatttgatgccagaatggaccttgcgggttatgttgataaaataaatggtatttgccgttatagtaaatcggtgcatgtgcttcattcatccagttttgcggaggcatcgcgtggtactggggacggtgctgatctccgtcaaacacacttggatcctcatcaatgtccgcattcggaattttcggaattgaacctccatgaagcgccttcacgctctcatatccagcaagtatctcctggttcgtaagggctttattatgcagcttcacttcatctaaaagcccgctgaacatattgaaggagaacacccctgctaactctacaggtttattatttttcccgatgatcagactttcggtagatggtgtgatcggaacgttgacgggggttgcttgggaagccacttcctcaccgtttagatataacttaatttttccatcttctttactaaaagtagcggccacataattccacttgtatttttccaacgggtgatcctttacccatacctgaatccactgaccgccgatgcctacttgcatcaaccatgtaccgtgccgatacataccaagagaaaagccttccgctttatcctgatcggattggtttacgatcgcagatagcttgtttccgtctccccactcatagctacgcggtgcaacccatgcttcgatggttaacgcgtcgcttacaggcacagtatcctttgcattgacctcaatataattcgagtatccatcgaacaataaggcgccgccttttattccgcgcggagtccatctcggatccttcgatgccatatacctggcgttgttaaatacatagttcacatcgtgcttaagattgtgtactttctccaacgccttctttcctgcgccttcatcaaggtttaagtagaaaatagtccccctaccacttgcttggaaacgatcaacggcaatgctggcttcattggaatgatcgacaacctttacatagagcttcttgttgtagtgttcttgcacattccatgagattttctcgttcacgctgacatttccggttttcataagcaatgtgttgctgttcgcatcgtaaagtgcaacatatgcattttccggtttgaggatatccaaaacagtaaaattaattgttccggttccctgaagcgtgaaagtattagaagtgatggagcccttttcttgcagggaggatttggcatagaagttcccttctttgctcgcatgagcttcatcagtcacttcaaaagcagctccctcaaccgtccagccatcgagatttccggtttcaaagcttggattatcgatttcatagcgcttgaaatccggcttgatatctgtcgcaacaattccttcagctggctccgactcatggtacatggagaatgcgtccgcaaaaatgactccccaatccgaggttgcattatcgacgacctccacatacagtttctttcccaaatatgtggaaagatccgccttgtattgcaccatattggcaagccgcatgcccagcgcgggatctgggaagcccacgtcggcgaatgcgttatttccgtaacgggcaataacttgtcccgtatcgacttccacaatatttataaataccttgtctgggttcttcgcaccgccaagcctgaagctgatccagccgctgccgcccagcacgaaagtgctggaacgaagtatacctgtcgcagattcgtcatacttccagccgtttaaatgataagctccttcctggttatacggtattttttccgcccaccaagtcgtttcgtcggttacgctattcggaccgaacgcatcgcctttgacaacggtccatcccgtcaaatctcctgtttcaaatccaggattccggatttgatagaccgaatccgtaactgacaatcccacgtcattcttaggaatattcttgatttgataaaccgcattcgtaaccgacgagcctacgtcatttttaggaatgagcgtgttcccagcaacagctctagattcggctactgcggagattcctggaacaacaagctggagcaccatagcccatataagcattcccgatatccaatattttcttatttttacctttctcattctagatcctccttcgaaatttcttgcactttcaaacatcgatacttcatttcgaaatgctctcctagtacaaagatgaaagtcaagaagaaaggagaaaatatatgaaacgtttccaattagagaaaagtgaagttacttgatcatttgctgcatgaccccattagtaaagagctcctaagcaatcgtcttaccaaatggactgcatatcccatatatccaaggatttaacaaacggttctccatctccccaaatctcgagtcccaaagcatccatacggctcgggtacacccgggttgtcaggcttttcaatccgtttgcataggcttcgaccatggagcggtccaaataaatatgaagcttcagattctccccaagtagctccagcttaccgccctgaatccctctgcacttttctcccggatgcagtgtcgttttcgaccggtcgaccatgagcatcgcttgattccaatcataatacagcagagtttcttcctctccgtccggcgtacaacggaccttgattccaaattgtttggcgctgccgggctccaattccaattgaatctcaagcatgtcaccatgaacattcctaagctgtacattagtttcagccaatgactggtcccgaagcgatagccgcttgggtccacgcagcgattgaagctcctgaatcggctctattcccagacgtccgtcatccctcaaatacacgcttaacggcaagcctccgttatgagcccagcccgacttatattccatctcggacgtccggtcgccttgggctatcgtaaagacgatatttctgccggtcttcggatcaaccattccgctcggtccggtaaaatggaaatccccgacgtcaatcaattgaggctcttcttgatcggggatgaacgaaagattttgcttgtcaagttgcccgatccaatagaacacctcgacatccgctcccttccccacagggctgacaagcaggagatgtttgttcaccccctgcttgtcactgccaaggggaagaagcacagggagctcccagatgggtccaaggtaaggaaacttctgaatatctgctttaaataacggccctttatacgtccaattcagcatatcctgtgacgcaaatgccagtgctgctccaccttcgataccggacccgaccagagcataccagccgtcatcgtccttccatacgaatggatctcggaaatccccaaatgcgcccattcccttcttctgcacgatcaacggctctggatgtttgacccactgaaccagatccgggtttccgtcaagggtataagtgcttcgggcaagcgctacgctctgattcggcgaagcgctgtcattacctgccgtaaagaacaagacaggaagtccgtcagcatcataggttgcgcttcccgaccagatcccgtccggtgcgagctgatccttttcgggcgccagggccacgggtagatcacgccaatgcaccaaatcctgacttacccaatgtccccaatggatctgatgaaagaacggcccctgcgggttatgctgatagaacaaatgatattgcccgtcaaaatagatcggtgcatggggttcgttcatccaatgggccggcgggctaacatgatattgcggtctgtgccgatcaagtagcagtggcgttcggtccagcttgatctcgtcatagtttaattgaggccggttaccttcatgaaaggtatccagcacatgccgataagaagcggccacttcttccgcgctcagcgcccgattataaatcttgagttcatcaatgataccgctaaacatgtgcaggctgaacacttccgccagcaggctgctatggttattcttgccgataagaagatccgtgtccgtcgcctcagccaggcgggaaccacgaggcacggcagctgaagcgatttcactgccgttcaaatacagcttgatttccccttggttcccatcgaacacagcattcacgtatgaccattcattcttggacagttcatggccgtctggcgaccaaagttccttccagtcccctccttccagcccgacttggaaggaccaggaaccgtgacggaacatgccaagcagataaccttgcttgcgatccaggttgtagcggttcacgatggcggacaatttgccatcatccccccattcataggagcgtggggctacccatactccaatgcttagcgctgatcgatactctggctcggtgttctgatttccctcatcgaacgaatgcgcaatgtaagtcgaataaccatcgaacagaagcccatttccaattaccccctgtctccacctaggagggcaaggtttagtgaactctgcttggttaaatacgtactggatattatcctggacttgggatacgctctccagagcgcttgtaccggaatcctcattgaacgcccaatacatgatcaatccccgattatcggttgcatggctcatacttcaaccctccttaatgtctgctccgttggaccattgggaatatgaatggagttaagagcatggatataaaacgagttcactacaacttcccctgatttcgcacttatctcaatacgatccatcggagcatcagggaatatttgatccgtcagtgcaaccaaaccctcattcgcgtacacttcaaccgcgttgcgatccagccagatatgcagcttgatcttcccattctccgaaaccattctagcaccgtgcttgcacgcaaacgatgagtggaaatcagtcaggcccgatttcgaacggtcgatgaatagccattgacgccaagggtcataaccgataatagtctcactttgcccagaggacttcattttaatgtgaacctcgtccccggaacgaatgtcgatatccgcttcaatttcaagcagaacatcatttattttttgcgtaaacggcgcctctggcgtaaccttaacctcattccagcagagcgttcctttccgcagctgctctatttcccgaacaggcatttgggtcagaactacgccctcgtctcggctggtcaatgacaagacgcgaggcagagtcattgtgcctctccaggccccggtaggcgtttggttagcatatttccagttgctcatccatccgatgatcacacgccgtccgtcctgctcagctatatccgaccaggtgacccccgcataattgtcccggccataatccagccacaggatatgatcggccggattgtcattgatgaacgtatttccgtcgaactctccgataaagtattgcgtgcgtgagccttccggacagttgggattatctccgatgcttatgataagtacccatttggaatgtccgctgtcatcaaccagcaattcaaagagatcagggcattcccaaactccgtcatgcgagccatcaatctttccaaattcgcctgacaacgaccattcacgcaaattgtcggaacgataaaaccgaacgtggtctcccgcgacaagagccataatccaggattcacttggcgaatgccagaacaccttggggtcccggaagtcgaccagatcatgctcgtcgagtattgggttcccctcatatttgtgccaagttcggcctttatcactgctgtaagccaggctttgccgctggcgaggttgtccggtctccggacagatgtctgcatgagtgaagagtgcgatcaatccatgggaaccatcgaacagtccgctgctattattccagtcaaccacacagcaaccggagaaaatagcgccatgctcatccgggaacagagcgataggcatatgctcccaatgaaccaggtcttggcttacagcatgaccccagtgcattggtccccattggttactataaggatggtgctgataaaacagatgatagactccctcgtaatagactaatccgttgggatcattcaaccactcggagtgaggtgaaaaatgaaaacccggcctaaatctatcaccatcgtgctgtttatttgtctcgattatctgggtaatttcatctgtcgtcggcatagattgaagagcccctttccgtgtggttactaatgcacctcccgcattagcaaaagttagcataccgatgatttgctgtttggtcagctgattcaaagaaataccggcttccagtatcttatataacaagcagcccagaaaagcgtcgccggctcctgtcgtatcaatggcctttacttgaaaacccggcacatatccgtcatgaccagctaatcggtaatagcagcctttttccgctaaagttacgacgatcccggcgatgccgaattgttgttgcagctctagcgagcctttttccacatcagttgtacccgttataaagcggagctcatcttccgatattttcaggatgtcggcatacttcatgccccaaaggatattctgtttcgcttcctctttactctcccataaagcaaaccggatgttcggatcgaatgaaagcagggctcctgcctctttagccttcacaactgccgctcttgttgccgtacgggccggctcatgggtcatcgacaaagaaccaaagtgcagtgcatggcagttttcaatcctatcgaatgggacatcctgcgtgcgcaagtatgtatccgctcctggtttccggtagaagctgaacgatcggtctccgttgtcatccagatggacaaatgccagcgttgtattggcttcatctgtaaacgaaagcccagacacgtcgatgccgacgttcatcaaggtatcgtgcagcaaggaaccgaattgatcatccccaactttgctaatcaatgtcgctctagttcctaaacgggatagagcagctgctacgttagccggagcccctccaggattacattcaaactgctcgttgcctctcgcggtacgacctgatggcgtaaagtctatcaatacttccccaatggttattacatcaagcacagttttctccccacctatcgtttgattatttattttttaaatttgcattatatcggtccagccctttttgatagatctccattaattcgttcagccccatcttctcgagtgtcttcacatagctgtcccacttttcatctacctcgccatcgacgatgaacttgcctctttgggtatttacatatttaataagttctggctcgatccgattaattttatctagttcatccggttcaaagaagatgctcggatagttttcctttttcatatatggagtgtaatatttttccaaatactcagcacgcttctgagctcggggttccatatcaacaacttttccgaagtcatcgaaagtaatgacgcccggatttcctgtgcctggagccactttttgacggaattcacctgcggagactcctttgggaagcggcaggttcaccaattttcctttttcgtccttcttgaatacgacatccaacggaccccagtgaatttgagccgccatgtaagggtcatactgttgatcgatccaacgcatcgtcattgccggataacggttctcctttgtaatcacgaagctacctcgtcccggtcctccgccgttgttgcgaccaatcatttgatctccatttgggcctttaagcgggggcagcagagcataatccttactacgctccggtccgacaacttcttcgacttcccaccaaacgtaggagccgagcgtttcatctggtgttttgccttttgctaaatactgagcggcgtcctgggtgaacgattcagggtcaatcagcccctgtttataccagttatcatgaatatattttaatgcttccttatattgaggttgcgaagcggtaaagatcactttaccttcgcggacaatccgatgttccaaattatccggaagaccgaaagctccgaatatgccggcaatgtcactacaccactgcatgtgcataaagcttaatgggatttcatcagccttgccattgccgttcgggtccttcgttttaaaggcaatcaaagcctgcgtgtattcgtccagcgtttgaggtacttttaagcccagtttatcgagccaatttttattgatgacgtgaaagaaggggttggtatcgagcttattctcttcccacgacggcagcccatagatgtgaccgtctggtgctgtgatggctagtttaatatcaggccgacgatcgagaagcgctttcaaattaggcgcatatttatcaattaaattctccagcggaataatggttccgtctttaccgtaattgatcagctcgtaatctgtgaatccggccccgtaaaaggcgtctggcaaatctccgctagccaacaacaaatttttcttctctgcaaagtcagtgtctggaatgttttcccaattaatctttacgtttgtttgtttttccagccgtttaaaaatttccattttcgagtaatccggcgctaaagcagctttcggggataccatctttaatgtcaccgcttctttaacaattggaagaccagttttattaaaattcgcatcctgatctgggtttaccgcctgattttttgactcgccgcctcccgaacatccgctaagcgcaaacactccgaccagcactagaagcccagcacttttgaataatttcatcgtacacaacctcctgttagatcattccacaagctgaaaatttcgttgctcttcttatatagttgtctggatgatggacttatcgtttctgttgcacatcacccctttcaggcaccatgacaatgttagcctttgatcgagccgatcatcacgcctttaacaaagtatttttgcaggaaaggatacaaaatcagcaacggtagactggataccatgatgacaccatatttgataagctctgtaacacgcatcttcgctgcgtaagattccacgtctatcatcatgcccgagttggcctgattctggacaagaatgttgcgcagaaccagttgcaacggatacttgttttcgtcgttcaagtagatcaaagcgtcaaagaaaccattccagaagccgacaacatgatatagtaccattacggctataacggacttagacaaaggcaatacaatgctccaaaaaaatctggtattggaacaaccatcgattgaagctgcttcccacatttcatctgggatggtcgactgaaaaaaagtccttacgataatgacattgaacacacctcccgctccaggaataacaagtgcccagattgtattcagcatgtgaagatcttttatcagcaaataggttgggatcagccctccactaaaaaacatggagatcagtaaaaaccacataatcgccgattttcccgccagtcctttacgagctaacgggtaagctgcacatacggtcacggctactccgattaatgttcctagacccgcatataaaatcgagttggcataaccaatccatatagatgaatcactgaatatccgcccgtatccatccagcgtaaaaccctttggaaaaaaccatacttctcctgagtagatgagattggggtcactaactgaagcaatcagcacaaaatacaacgggaataatacaagcagcataactatggtcaacatgaagtagttgacgatgtcaaaccacatgtctcccttgctttttctctttaataattgattcaaaatgaactcccccttaccacaggctggtttcagtcaacttcttggcgatccggttgacggtgattatcaggataatatttaccactgaattaaacagtccaattgccgtagaaaagctgtattgtgccttttgaatcccgatttcataaacataggtcggaatgatattggaagtggcataattcaaatcgttctgcataaggaaagccttttcaaaaccgatgcccataatgttaccgagtgcgagaatcaataagatgacgatcgtcggcaaaatgcttggaatatccacatgcattacgcgcttccatttgcttgctccatccataatcgcagcttcatgcaattctggattgacccctgccagtgcagcaaggtaaatgatggtagcaaaacctgtctcttgccaaacccctgataaaatatacaaaggacggaaccaaccttcgtcggccaaaaacataatggggtctcctccgaacaaggtgatgatgtgattcacgattccgctgtttggagatagaaaaacattaagcataccgacgagcactacggtagaaataaagtgtggtgcgtaaattacagtttgtacaattttcttgtatcttttggccagcatctgattcaacataatcgctataataatcggagctggaaagctaaacacaagcgatagaacactgagtgtaagtgtattcgtcataatcgtccagaagttataggaatcgaaaaaatcaataaagtgcttaaatcctacccactcgcttccccagattccccgacttggtgaaaaatccttaaaagcaatttgtattccatacatcggatagtacttaaatacgagataaataataatgattggcaacaaaaacagatacagttcataatcacgtttgacctggttccatattttgcgatttggcttgatcgtggaatgatccaactcactagttcttgaattcaccattacactccctttcttgtaaaaggatattttcatttttgaaacgtttccaatttattataagaaaaacgtcagtcggtgatccataccataaatccaccgaatgagctgaagtttttccaatgtaaaaaaacttgcctaagataacgggagatgatacatttgctgattcaaacttattccttcgatcttttaacagagtagtctgattgtcaaatgaaacgtttccaattttctataagagaaagtcaagtttgcatatccagactgtgatccgactttacgaattaatatctttacaattaaaatcatgtagtttcgccttgtctgaagataacggggagacgatacacttgctgatctaaagttataccatcgatcttttgatacagtagtctgattgtcaaacgtgccatctcctccactggctgcctgattgtagacaatatcggatgaaaataacgatgatcctgaatgccgtcgtaaccgatgacctttacatcctctggaatacgaatcccctgcctacctgctctttctatatatttggcggcaaacatatcggtaatagcgaaaatgccgtccacatcctgatgcttagatagaaattcgccaaaataggcttcgtcgtccacaataggatctggtttctcgtatacaacatagtctacacctaattttttcgcctcatcaatgaaaccttttcttcgattcatggtttcactaaaaacggaagttacacttcccataaaagccggtttctgggcccctgctttaacaagttccctcaaagctagacggcctccctcataattatctgaggttacacaagtgatttttttgttgaaatgcctatcaatacttagaatcggaatgtcattgcttacgctattttctatatcattgtaagtaatgccgacaataccagctactttgttttgccgtagcatatccaggtaatacagttccttttctggcttgcctccgctattacataacatgagcttaaagccttcccgatccaactcatcctcaatgtaataagctagttcagaaaaaaaaggatgccagatacttggaagcagcaaggctaccatcttggattttctcattttaaaatttcgagcgacttcattaggaaaataattcagttcttgtatagctttctccactttccttcgtgtatctggttttacagagcccgagttattaataacgcgggacaccgttcccacagcaacaccagctatcttagctacatctctaatacttggcatttaacccccccatctctcttatgggaattataatagcactaagttggaaacgtttcaattattttttgaagcgctttttttctgacttttttcattgcctaccccgcatatgaatttcgtgccacctgattcaatcacacctattcgctttttattctatttttttacaaacttactcaatgtacttttcgaggcgacacaaacatgtatggcacgttctataaaattaaaacttaattattccagattaagttgatgcgaattgtagatctttattacattcatgcttcaaccaatcgtcaacctaaatccgaagaaaaaccgattgttctggcatcgctcatggctatgggtaccaatataggcttaacaaaaatggctgatgcaacgcctagtatcttagaatcattacgtccgctgaaccaaggatagcataaaagccggttacacccttaacgtgtgaaaaccggctatttttgtactcagaattccttagcgttgtaaatctgcgttatgctggtggtaccccttcaagatcgaaacattcgcagtatgtgtgtccgcgacagtaagaattgccctaccgaactacggatggacggagcacttaagaattagcaaaagaaacccgaagtctcataaaagacgcgggtttctcgtcaatctgagtagcctttaggactactttttatttcccaatattaaaccaaccgggcattgcttgaattacattccagagtttttctggaatattaagctggtcgagttttgaaacgttcaacttagaatctacctcggcttctcgtccatttgcgaccatttcaacccaagtaggattcataattaacgcatgcccaatggcaactagcggcaatcctaattccacagctttaagagcatcatccggtgttattatggaaccagcagccatcacagttaccttaccgtttgctctttcaagaattaattcaagccgtgttttttcatcttgactatctactggctttgaagacacattatctaatgaagcatgtatataatccaatttctgttcaacaagaatatcgattaattcatacgtgtctttcatacgtaatccgtccactttggaggattcttcaggtgaaaatcggtatcctaaaatgaatggttttgtagcatgtttttcaatgacatttttgatttcgttaataatcgccaatggaaaacgcaagcgattttcaagtgatcctccccattggtccgtccgttgattcgttgctggcgaccagaagttttgaattaaaaatccatgtgccccatgaatttcgacgccatcaaatccggcttctatcgctcgtcttgttgtgtctccaaaagcacgtacaatcgacaaaatctcctcatgtgatagttctcttgtttctggagttgaacctaaattagtaatttcgggttgcaatgcactcgcactaactgcatccaattcgggcaaagctttattgccagcatgaaaaatctgtaggatcacaggagagcctccacttttcgctgcctcagctaattttcgtaaacttggagtaaattcatcattgtacccggcgaattcattcgtaaaaccctgtccattcggtgtaacatgagtacaccctgtaatgacgagtcctactccattcactctttgtttgtaatactttacttcgtcatccgaaatggtaagatcgtcattgcttgaccaggttgtcataggtgccataacaattctattcttcattgttattccacttctgaatgtgaaggattcaaataacctactatatttttgattcatttctttaacctcgctatcttattttattttctgtttcagtgtaattggttaccgttacagtaggtcaaggatttatttttatatgattacatatagaattgttgtgctttcattctctttatgatatatatttagttacagtaactgtaactaaaggtgggacaagtagatgttgtattcaatgacatacgtagtggagaatttaaatgtatctgcaaaaacacttaggttttatgaagagcaggggatattaccaaatatatctcgtgacgaaaaaggccgtagagtttataaccaacaacaaatagattggatttcttttattcgttgtctcaaagagacaggaatgcctctttcaaaaatcaaggattacaaggaactttatgaattgggaaatagcacctttttgcaaagagaggagatgttgatacagcataaattggaacttcagaagaaaattgacgaaagttttaaacacatggaagaaataaactataaaattgccatgtatgaacttcagaaagaagaggttatgaaaaaccctaactataactttaaatgtcacggtcacggcctggagattaagacggtgaattaatgtaatgtacttgcgctaacggggaacgatagttcaatctccaactaagactaggctgccgatcaatgtcggcagcctagctctgtctttgcacattaacgtaaacaacccaacaagataaatgtaggtttattccatacgtttgagacgctggtatttctccaatcatagcgaaattcccagaacttatatttaacatatttatccatctactttgcccttgtgacagcgacgctggtactaccccttctttggatgattacacatagggatgcagccaataataatgcaccctttctcgttgtgttattaaatcagcaatgtttagcttgctaaatatattaaaaaagatggagaactcatgatagattattctccatttgttgcattaattgtcttaatatcagccgatcttccgtagaaatggattgaagtagtttttcctgctgttgtctccatttgatctcaaccggtgtctctaattctttgcctttgtccgttaggaaaatgcgcattatccttgcatcttgttcatcacgtttacgatatataaatccgttctgctccaatgatttaaccatgttcgttaccgtaggcggttcgcattttaagtgttcacatagttgcatttgtgttaccccatcacccaaccacagacgatacagcagattatcttgccctacataaaggttaagttccctgagagattcactataatttcgacgcatttgggaggagattcgatctaacgactgacgaatatcacaatccacttgatctgtcattaattcatcatccctcgactcgaatgttatttagcgggctaactatatcacgacgaatttgatgtgtcaaattaatttatgatgaacttcctcctgttcaaaaaagttctctaccccgcttcattttttggcatatccctgtttgtggagatagtccatcatttgtggctgaatgcttctttggagatgatcatgaatgtgatcactccatccttttacttttttcactgtgaaaggcgcgcttacagaccgattttcataatacttcaacatggtcttatcataagttgctaatttcaatttatcgagtgtttgatattggttttcgtgtaaaatcatagatttcggcaatctgggcttgagttcaggtttatctccagatagataaccgatacataaccccaccaaagggatcacatacttcggtaaattcaaaatgtcagatagttcgttaatgttacttctcaccccaccaataaaaacgccaccaagtcccatggattctgctgccgttaaagcattttgtgccataagcccggcatcgaatgagccgattaaaaggaactctatatattcaaggtcaacttcaggagctatttgatgattccggtggaaatctgaacaaaaaatccagaactctgcagcttgttcaatataaggttgattaaccgaaagttgcatcacctttcttcgaagatctggatctgtaattctaataatagaaacggcctgcaaaagactgaatgatgatgtttgattagctgccttaaagatttcttctcgttgttcttgtgtcagtggttgatttgtataaaaacgaatggacgtatgattatgaagtaatttaagggtattattcatatgaatatctccttcaatgttattatcataaataaaagtgttagcaaaaatagcaatgaggtcttagttataggtggcctcatatactaactcaatacaaaattgcgttacattacagacaatcctccatcaattcatgatgagcacccgtaatataagaggcttcatcactcgcaagaaacaaagcaaggttcgctacctcttgagactgacctaatcttttgatgggaacttgttgtgcccgttcttcaattgccttttcacttagagctttagtcacaatgtttgtttgtataggtcctggttgaattagatttatccgaatttgatcagtggcaaactgtaggaaaaaaaatttgagatcttcatccgatggttttaacaatttcatcaatcacttcttgacacgttagaatttgctgaataccaccagctgattcggatacactaacggtcccattaaccagatccccatctaacattcctattttgaacccttctccataatatttgtatgcttctgcaggctttccttgattaatgagttctaacgcttttttgcccgcttctgtaggaatggttctcaaatgtcctgtacctgatttaaattcaataaactcttcactttttaccttaatgatggctttctttgtttccatactagctggattttctttggtcactataaaccttgttcccatatatacaccttctgcacccatagatagtgctgctttcgctccccgaccatctataattcctccagcagcaataacagggatttttacaagtgaagtgatttgtggaacaagggaaagcgtactaattttataatcactcatatgaccaccagcctcataacctgtaacgatgagtgcgtccactcctgatttctcggcttctagaagcttctctacagttggacttaagtctctgtaaacgaccttaatgtcatgttttttaagtcgtttcagttcacgatcgaccacatgttgtccaatggcaataacgtttttgacattttctttaaccaatacatcaaaaactgcattagtaaaggggtcttctgtagcccctcccattgggaaaatgtagtttactgcaaatggtttattcgttaatgctttaaccttgcgaatttccttcgttagtcgatctgccatatcctctgcacttattgctttttccgtttggccagcatttggccccaacacacccattccacctgcattggaaactgctgcaacaaattccgcggaagtgacccatgtcatagcagctgaaataataggatactctattcccagtagttctgtaattcggtttttcatcaatgatttcgcctcttgtttaattgatttttttattattacttcttatacctattttcagggtaaggtagccctaaattcccccgaagtgtatcctcctcatattcctttcgaaatatgcctttatcttgcaatatgggtacaaccaatttaataaagtcctcaaatcctgctggataatcttgtctaatcagcaagacatccatgacgccttcttgataccaatgttctattttttctgcaacattctccgcagctcccatcaattgaggttttggcaatctataacctttaggcatccatgattcgatttctcttagcttttctaaggcttctttttccgtttcaccaacgatggggctatgtgaaggcataatcagtagatcgtttggtgaacgtccttgattttgcacttttcttttaagttcagcagtgaatctcttaagatattcaaactgatctccaggagccatgatgacttcggcatgctgtgcagctatatccatgaattccatggaagttccggcttgaaagacgaccggtctgccttgccgggatcgactgatatttaatggtccctccactgaaaagtaattcccggtataatgcagcggatgcatcttaccagggtcatagaatactccgcttttcttgtcacgtataaaggcatcgtcttcatacgaatcccagaggccttcaacaatctctaaaaactcctttttcatgggataaagatctgctttccttaaatgggaccgactgtaattggctaaccctcccggattagaggtgatcgcattccatcctgctcggcccttactaatcttgtcgagtgaggctatttgtctagcaacagtaaatggatcagcatatgaagtagctattgttgcggtcaagccaatggaatgagtcaccatactcaatgcagacaaaatagatacgccctcaaacatgcttagatagtgtggtatcatgccaggtccaatatgacttacgtctgctaaaaagatgaggtcgaaccttccctgttcaagttgcctggctttttgaacgtagtaatcaatattttcactggcatctgctggaatagcggggtgtctccatcccgtgtgattccaaccaacgccatcaataatccctcctatttttaactttcttccttccattgttgaatgatctccctttcatgaggttctttaaagttacagtcaaaaaaggaaagcaggttatctaattgctctggaaaatcatttaccccaataattctctggaccttagcaatgctcacatggtccagccatcagctgcagaagtcctaatgttttggagacttttcttagcatcacttccgtaatagacatgaacgaagtctaaaatcgaaagctgtagtctatttcctgtattcacttatcagtaactcctttctgtgttatatttatttagcttactaaatataaaaacgcaatcttagttaccctattaaactataaaacgaaaacaagaacattatcctttcgcattttaggttaattaaaattaattgttttggtttgttgacacaatcataaagtcattatgttcatttgcaaagagggcaatataaatgaacatagtacaactatttgtaccttaagattaggagtgatatcaatgagggtctgtaatgaaggatttgataaagaatttatggatgaaaaaagggatatgtacgcgatagcatttacccaaaatgttctttcaggacgttggaaatattttatattatggtatttaaaaggagaaacacgccgttatacggatataaaaaaatttcttggaggtttatcacaaggctctctcacaaagcagcttaaagagttggagaacgatggagttattaaacgtaatgtttatccggaagttcctccgcgagtagagtattcattaacaggcaagggaatcaaattactaccgatccttgagaagatggaggaattcggtaaggaatacggcgaaaaaccttaatctgatgaagtttccaaacaagcttattaccgaaattttgaatccaaagaaaacatttttatttaagtctttccatcatctcttcgacaatttgaaaaagccaatgaacatgttcatcattgggtttattgaaccatttatcccaatctaaacccgaatgaggatactgtagggcagggtattcaactggattggtgaatggtctgtacttcatcacgttatcttccagtgtttgaaatcctaactctttaacaaatttctttgtcattgtggaattccctgcacaacaaccaccatttaaccaatatacatgctttaattgttccttcaaatattcatcatttattttcattgtaatcctcctcaattttttaatattgagggaggtgacggattcttattggttttctgtaactgtaaaaccacatagtaaatccccctttcataatcttaatcaatcgtattcgacatattttagttaattccttccttctcgttatcctgcccgttagcgtaacaaggctgccattcaatccacggcagcctcatggtttagtttattgagttgcctcaacaaagacctcttcttttgcttcccgttttgcggtttcaatcagtgtttagacaatcttttacatatgtgaaatttgcaactttcccctctaagcctttcctcatcctggtcacttcctcttccatcatgagctcccttctaaaggaagtctttatgcataggtatactccggtcccaatcgttcgataacttgatccaactgtctggttagataaggcgaaacgtcatcaatgccagccactgcttctaacaagggaaagggttgcccactccacgggcctcgtggatcaaagacttgtctaccgattcgcaatcctcctatttccttgaagatgttcaatcgttccaatccttcaataagcagcccgaccggcagcgttttgttcctacgtcgggaccattctgccaagaaggacatgccgcgtaatatatcatattcaaaaaacctcggaaagcaaggcttcagccattccatatcgatgacgcttctattttgtttagaacatacaagacgatgctcaattaaataacgtgcgccttcatctaagaaaacgacttcctgttcagtaaattcacggtctgtatgccataagatagcttcaagcggaggaagtgttgaaacaatagagctctttttagaatgagtataagcttcagggtcgcagttcagcccgccatcaggtaactgatgctttaagagccattcgcgaatccaaggcagttccttgtccaaatcacagccatacgccattagaatcatatagtatacggcaagttcacaatggcagcaatccatcttcatcttatcactttcacttgttggatggtcatcggcggatatgatgaaggtcggccagacctgagtttcgagtaaatattttgctccgacaatagcagactcgggaattagtttcacctctcccatttcataaagagcagccatatgccaccaagctccatcccattttcgacggctgcactcgccgtgagtcatccccaaatggggagtagattcaaggaactgtatagattcttcgattgctaaacgaataattcgatttgtttccatctgggtatctcctttttgattacctctacttcatgcttcagttaagcaacgctcacctcgtatacccttccactcttaaaaaattcgatatgttattaacccatcctgtccgttagctcaacaggcagccgatattacggcaacctattcttatgataccatcgtgttgcgttaattatcttaatctctagatttgttacaaatcaaattcatgagattagtaaatactgtttaatatgttttttcggaattaagattacttgttgaactaaactgcccgttagcttaatgtaaaacggagcagctgctgacagcaaactgctccgtttaaatttaaaataatgcgtcccaatcgtctaataattgccgcatataaaaaatgagttcttcgatgacagaataacttcacgtcttgaacaatggagatttatctgaaccaccaatcgaatcaactgtgaaaaatatggagatgaagtgtcctctgggggctactgtttttactgaacttgaagtgagacgaacaagtgagggggcgttccccactttattcttaactaggaatagtatacttgttctactttatataatgtatgctcgatagttggacaaagttcggcatctactttgtgaaatttaactcgaaagtacaaacttttcaagaagttctttatattatttttttgcttaaaggcatgaagaaattctggatttttctccacgtcaccaaaactttggatccatttctctacataggtctgactaagtatttttctatttaaaacactaattacggatttcaccattctttcatcttccccatcggagtaaactcgatctgatatggtcatcttttcataaaccaaatcgagtatggttaagaggtcttttttgtccagttcggaacattgggccagatcgtccaaagcatctgctgcatgagctatggcatgagcccatcctttttcttcatcatacccacggtaatctcgctccttatgtatattacaaaatactttctctttgatctgatgaatatgctcacttgagagaaatggtgactccctgtgcctcataaggagaagcggtataactagcatagagaaagatctagtgaagacagagtctgtatttatttcatcaagcctgaaaagcaaatggtttttatccaaaacaacgggtaggagttgttccaattcgtttacagttagagcattaccaggaatccaattggataaggttgtataaattagctcatcacgtaattgggcatctaaagaaccgatgttattcatcatctcttgtatcaattggaatgtatcggaaggtgcttggtagtcatttgcttttatcaatatcaacttttcttttagattcattttacacactcctactatattgctattcattttaatcatctctattttagtaacattccaagctagttcatgtataactgaacatcatacttttgagcacctttgtttactttgtacagacctaaaactcttccaaaaccttggatttgtcgccatgaaccttttccaggtgatcctctccccaatagcataaatggtctagcgcgggctttaatccccagccgtaggaagttagctcatactgcactttgggtgggatctctttataaacctttcgtgcaacaatctcattcttttccaggcctcttagttgagtggtcagcactttttgcgtaatgccggggattaaccggcgaagctcagacgtccgtttctgtcctgtcatcaaatgatagatgattaaaggcttccatttccccccattacttctaatgccgcctccactccaactttatacttcttttgaacgctattttccctcttttcagtcatctcttattcctccgttaaaaggctgtgtttttcctacataacattcattcacttcagtccattattcaggtaagtttctagggcatctatctagggcacttccatgttcctaagggacctgtatcatcctatagaacttgaaagtacgtacttccagattattttagtactgttataatagcatcagccattgatcatggctacaagttagctgttgagaaaggtagtgaagaatacaagtatgagagtattaagcgttgtttcgcacccgataaaaattccctgacctctaaggttgccgatcgtttcgtacaaggtcttgccgaggctggccacgattacgagatattggatttacatgggattggctttgaccctgttttaaagggagtagatgaacctgactggtcagctgcggaacagtcctttacccctgaaaaggttgaatttttatacgagactttagactccaatcccaagcactatgagatgctgcttaaccaagctcatcatttagggttgaattatgccaaggaacagtagccttaagttaagtctgaactctatggagtctgtccaaggaaatgcgataaaataataatacgaaattgcaccttatttgagcagagaatttcaaatttattttgagcttattttgtcagaacgcccggagcgcccgcaacgttttgggcgtccttcttccttttcattggcatttgttcgaacggaaatgtaggtattgcgctaatcctcatccggatgttcgagcagcctcagctttggcatatgcatctctggaatatacttcagggattcctgacgaatgatatccacatcaccggagtctaccaagctccgcgtcagggcaatagtctccgggttcattattgcaatcaagctggttacggcacgaccagacaaagaatgaaaagttgcccgatcatgcaactggcggtacagctcatcatgagacatgccaaatggtaaaaaggcaatctctcccgtaaagcaagtaatacctctgtggatatgtccgcccaccatcatgcctgctcctgagaaacaaacttcaataaatgtcgcaaccgcaactgacttttcttcatcatatccctgcttctgatagaacccatacacggtcagattcatgttgttatccacaatgacttccatctcatgcttttcacggcggaatattagattgtctctcctgccaggatggcaaccgtataagttagagaatgactcttcacttcagccttgatgatgatgcaggcaacataagaaacactgcatcctgcaggacaacgggctccccattgacaaggtttactgtataaatcgatttctgtgctgcggcatttacaaggctgacatgatgatgtttgcaggttcatcgttgctcacattgacgttttgataagatgcgtagccgccaaatacatgaagtccaaagtggccttctgcaaaagtgccatccattacatctatgactttttgtctatccacataaactacaatatgcggcccattcgcttctattttcaccttataagtttgacatggctgaatgaaagtcggtactttcgcaagaacctgccgttcttcaaatcctccattaattttatagaacagacggatcgccttcatgttagggtctagattcagatagtaaccactgcgcccatcctcgctagccctgaacaaaatagaacctgcccctcctgtttcaccaagcatcatgtctgcttcatacgtaaaattctcagccttctctttagcgatataattcgcatcgctgaaataattaccacgaatcccattctcgctaactaaccatgaagcagcagacagatctttggtccatccactcaggtttgttcggaactcaccatctgtgactttaacgagcacactagcggatgctttaccatccggagtagatacggtgatcgtggactccccttcttttttcgcctcaataaccgcctgtgaattgtctattacgtctatggctattacttctttattgctggactcccacttaagcggttgaacgccaaaacctggtctgtactcgaccattgcctgcagtgtgtccgactcccctatacccagttcccgaaccctcgtatccatctttatctgagcttttgaattaatgtcctcattccagacggattgaagttgatgcactttcaaggaaacaacgttcacattcccgcctttcacgtaaaaactcatcgctctactggctggattcggaaatataacatctgaaaagacgactttgccgccgttaccaaaggcttcaacggaagactcatccacaagaatacgcatcttgacccgattattctccatttgcatcggcgcttcatgttttttattgaaaaggctggaaaagtccgttactccagatgcagttcggtccacaaacattttactctcgcttgcggtataacccacaaccgtcttctgatttgcaccctcacgaatgttaaagccgaagtcggtcactgtgctggcttcagggatttcaatttcagcttcaatttcgtaagcacctgaaataatgccttttagcaggttcccggaagaaggactcacccctttgttagaagcaaagtacaacggtttacgcaatgattccaattctttaattggactttgtgccatccgaattccatcttcggtcgttaccaatgatacttctctcggaatggttagttcacctctccaattcgtcgttgggaaagcgaacggatagtcccaattcgtcatccacgccatcatcactctgcgatgatcaggcatgttagcaaaagacatcgaagcgtaaaattctttaccaaaatctgttcttagcaccttacccgccggattatcattcacgaatttaccatcagctgttaaatgaccgataaaatactcggcatctgatccaccagtttttggattcgctcccgtactgatcatcataacccacttcttctgtgacgttccgtctaccggaagctggaacaaatcagggcattcccatacacctccgcggacgtaatccccgtatccccaattatctgtcaatgtccagtcaagtaaattcgttgacgtatagaaacgaatattatctcctccggacacaaccataacccatcggttattctcgtcatcatagatcactttcggatcgcggaaatcccatcccccagggtcttctccgctcttacctgggttctcgatcacgatcgggcggtccttcgaatattcccaagtgcgaccttggtccttgctgtatgccagacctatacgctggttcccattcgggccatccggattaaaggaagtataatatgcaataaggcccttgcctcctgaatccccgaataaaccggatgcattcgtcatatccgcaacagccgatccagaccagacatgtccgtgatcattccacggaagtgcaatcggaagccgcttccagttcagcaaatctttactgacagcatgcgcccatgtgcctccatcctgatggaagagatgatattctccttcgaagtagacaagtccattcggatcacttgctgaaccacgtattggcgtgtagtgatactgaggacgatatatttcgttataatattggctcgattccgtcacataagtatcctggaagtaagccgtcccctgattgacgacgattccggtatttccattcgtgtaggttgaatctttcacgtcgatcgcggccgtagtgtatccgtccaggaagacctgaattcgatttccctttgccttgatctccacatgatgtttggctcccatctgactcggataagtacgcagtgaacttgcaattattgttcctttcgtattcgtcaaacttacacggacctgatctccttccttcgtaagagtagcttcatatccatcagatccatcggcggaggaacgaaatgcgagagccgcaacagaatcaggacgaaggataatattcccttcatacacaatatcatccgcctgtttgttatagatttgctgtgccttgctctcatgtgctatcgtccctcttttgccgctgatatcaggctgccattttcccttacttgcaaccactgtacccaaattacctttcagatcgctcaccacgatgttcgaaaacaaggcggatccatcccatacatgaagtcccagctttccgcttcgatacgtaatgtcctgaacatcaatcaaaggtttatattgattgccccaatatacttttagcgaggaacccactgccttcactttgagatgatagatctgccccgcttcaacagaaactttacgctcctcctttaatttcccatctccattccttgcatctcttaaccgaatcagacctgtacccggaatgatttggagcatgtacgagctaaaaccatcctcattagaacggaacaacaacgtggcgtctgcctttgtatccctgatcttgacatcagcttcatagataaaatcatcggacaccgtctcggagatggccgttacattttctttaggctgcgaagtcagcaagattccttctgaagtatactctaataaccctttccctttcacttgccagcctgtcaaattggcgtttgatttggtagcgttttcaaaaatggaaagctccttctttgcctgtttacttgcttcctgatcagcgaacacagcccaacccgtagccggattagatgtaaaaacgccaattgaagtcagagctaaccccgttgccatcagaagacatattgcgaatttagatttatctttcattccttaccctcttttctaatggaattgaaagtagcggtcagcaactcgagcttaactgggcgagtcctggcagcacaatataatcaacaatgtgatccagtatgacactagagcttacatagccgttcaggttctgtagcacagcctttcgaatcaacgggaacagctcttagctgacttaattcacttatgggtgtttggattaagcaaattccctccgaatacgtcctaagctgtatctctcgggggattgacatgtgaccacgctattcttctgaagaaagagtggaagcataacgccaattgttcatccagccgacccaaaactttcgcgcgtcctcgttcggaatgccatcccaggtcacggccgcgtaaaagtcagatccgtaatctatccatttgatcgtatcgtatggttccaacgtttcatccagtgtaaataccttaccgtcaaagttccttataaaatccaaacgatttctatccccgatacttagcatcagaatccacttagtgatattgggatcttcatccacttggattttaaatacctcaggacattcaaaaatatctctcgatggatacccggaatatcggaattgaaatcgcttgcaaaagatcattccttaagattcgaagacgtgtaaaattctacacggtctcttacggcaagaacccttacccacattgacgattcgtcataccaaaacacctgcggatcacgaaagtctagcattttcgttgggaacaaaacagggttaccttggctgtgtatcttaaggggtatgttggtagaacaggtgatactctccttcatggtaaaccatgccgttgggatcattcatccaattttccttaggctaatagtgtaattggggctgtatttatctttataaaaaatattcactggtccttttctgctacttatctcaccagataaatgtatttctttaatgttactcaccctccttttaggttatttaggatcttaatagaagtgattcaactagcttggcaactaaattggaatgcgtgcaaataactgcttagtgtacctgaaaaatgcatctcttatgaaccaaaataatccaacagcgtgcatttgtcaatttattttacttcatgtcatatatttttggatataagagcttgttaattttacatttgcacaaaaatatattaaataacttgaaaatggcaacttttatttaattttatctaatcgtccttctttattttgtaaactaaatgtatctacaaatgttcacaagttcttgttctttccggcaaagtaaccaagctcttggtctcgccgcggcagctacaacacgtccgatcctcctgtaaacggtccgatttcttccctatctggaaccctcccttaaaccaagcctaggttgcaaccaggaacgaaaaaaggacgctcattaatccatgaacgcccttgcttcagaactcacaactttatttgacaccttagtcaccctattttgactaaagggtgactaaggtgctcatgtttattttattattcacctctgatttttacaattttatgcttcttcattcaagactaaatatccactcatttgccttgaaaaaatattaattctatcgccttaaaaaacgacactacatattttctgcagtgtcgtctttaatccgattatcttaagtaatttagcgatataaaatcttacttttcttttgcaaatatgaactgcaatcttttcattgagttattcagcttgccatatatctttcaatttccaataggtcaattcatttactagtgcctctccaccctccgttatgatttctatgcctagcaatttctcactcggatagatgcgacttgtcatcgtagcttgcccttcattcgcaaacatttcaatggatgagcgatccagatatacatgcaatgtcagtagcccctcagcattgaaggctgtttgacgtactccatctgtcttcttacctgatttagaacaattaagcataagtttctgctccggaatagaatatgtgataaacgtttcttctcgacctgttccacgaaacttcaagcctaccatgtctgcacttgacttcgtgaggtcgaacactaccttaagttcaagcaggtcggcttcaacttccttaaagtaacttccagaaatggcgccatattgacacaaaatatgttcactttgacgaagtaacttcatttcttctactggattcatcagtactttattattgtcacccaacgtaactaaacgcgggatcgtcattgctccacaccagccgtctgctttcgtcggcatatccgattcccacatatccatccaaccaatcgcaatgcggcgaccttgattatctagaaaagtttgaaccgcatagaagtcatgaccattatccaactcgatgaactctccatgcttatattcattactatcataattataatcgccaacataatatcccgtctggaacaagttattgtacttatctccctgcgcatcaataccttgtggggagaacataaatatatgcttaccgttcagttcaaagaaatcagggcactcccacatgaagcccatattcttatctccctgcagaagcacaccatgataggtccaagttctaaggtcaggagatgtatatagaataacacgcggcagatctcctttcgtgctgttgcctaggatcatgtaccatgtatcctcatgcttccataccttcggatcacggaaatgctgggagctatctatcggaggttcagcgattacgggattctgccttagttttgtaaaatgaatgccatctgtgcttactgccacattttgattttggaaaaagatattgtttggttgatcaatatagtgatggccagtatagatcaatgtcagttcgccgttattatctactgcgcttcctgagaagcagccatcaagatcacacgcatctccaggtactaatgcaatcggacaatgctcccaatgtacaaggtctttactcttcacgtgaccccaatgcattggaccccagttctcatcataaggatgatgctgatagaaggtgtgatactcacctttaaattgaattaatccattggggtcgttaatccagtttgctggtgccataatatgataacctaatcggtaccgcttgttcattttcgcttctgcctgtttcaatgcttcctcagcttgcttcgtattgttattatatgtgttcatctgtcttcctcctatgctgtttcaatatgcttgttaggcttggggttcagctttttcggttctttctttaaggtaaagattgagattgttgtaaaggcaaatacaaaaacacccataatcacgtacgtatttgcaaagcctctaatgtcataagacataccggcgattggcgagaagattgaagctcctacctgactcgtaaactggtatcccaccagatacaaaatcgaagacagacgcgtatcgaaattagcagccaagtacttaaatacggagatcagcatgattggcagttccaatgcgtgaatcaatttcatagctgagataccataaggtccaataactaagcctgaacccatgatccggaacgccatcaagaaccctgccaatatcagacccttttttgctccaattttgttgacaatgaaaggcgctaagaacatcatgcctgcttccaagaatacttgtagggaatttaagtaaccgtaaacttgattgcctaaagcaaccgttgagaacgtcgatgaaaagtaattcgggaactgctggtcatacacattgtaaacacaggtaacaccaagaacatataaaatgaagaaccataaatgcttatttgcaaacaaatagccgatttgcttaaagttaacagattctgctcgctccatctcggaatctgtcatttcaactttaattgtcaccataatgataaacagaatgacagcagatacggatgcaatccagaagttaatgttagggttgatattgaagagttgaccagcgaaaaatgtagctgctgcccaacctagcgagccccacatacgagattttccgtattcaaagccatattttcggctgactttctcgacataagattcgatggctccgattcctgccaaaaaagaaatacccaagtataatccacctacaatggcgccgagaaatacattgtattgaagtaacggcccatagatatagatatagaaaggaccaacaaataagagtaaagaactgattagaaataaaatatgcttcttcaatccaattttatcagatatatagccataaagcggttgcatacatagtgcaaagatagcgtttacagtaaagataacacctgtttcagcaccattcagactgatttcttgccctagccagatggagaacaatgagtaacttgctgaccaagtaaagaagaaaaagaagaaataggcacttagtttccagtacaagctctttgactttctcatatcgaacgctcctctaagttaaacatttaatgtaaatgaaagcacttccgtatttacagatcgattatatgtcaaccgctttcatatgtcaaccgcttgacatatttctaaaaggaaaagagctctcctctttgatttcaattactctaataaggatagctccatcttatatcacaatgctgaaactatgaaaattgtattaagctgtactagcttcaataagtttcactggtagataggtttctcgcgggacatcactaaatccaccttcaatttctttaataagtaactctatggaagatctcgcgatctcctgtattggttgctgaattgtcgttaattcagggagaagattgcgggttgtttctgttccgtcatatccaattacgcgaatatcttcaggaacacgttttcctcttcttcttgcttcagcaataaaagacgcagccaccaagtcattactcgcaaacaatccatctacttcatgatgttcatcgagcaagcgtttaatcggttcatcgtgattctgttggtggaagggatcgtgtacttcataggtaattgcctttcgaccatactgctccatcacatcttcatatgcttttcttcttaagcttgccggtgtttccaattcaacagggccgttgatgtgtaagatatgcttgcatcccttttcaataagcaactctgacgccagttttccacccatataattatccgatccaacaactgggattgaatcggataggaagcgatcgatcgcaatgacggcaatattcttctgttcataatttacgatacctctgttgtgtgtaccgacgataataccgtcaacttgatttcgcataagcatatctacataagattcttctttatccaactgattcaaactgttacaaagcaacagcttatagcctaatgacgcacaaatattctctatatgaaaagtcagctctccgaaaaatgggttgcttgtagttggaatgattaatccaattagatttgttcgtttactaaataatgaccgagccacatcatttggtaaataattcaattcctgcatcgctttatgaacttgatccttcgtttcttgactgatatagccacgattattaagtacgcgagaaactgtagttggtgaaactccagctaattgtgcaacatcgttaagttttggtttcattgattcaacctgccttctctccatgccaagtctccaattattctattattttaacatggttaaacgtgaaaaaacatctgaccctacgagcccttttcattcaaatctgtaatatcatccatatgcagtggtatttgttttgtaggttgctactgcctccttgaaccatggatgttcgctgcttgaatgattgataacaaggtccatgaaaccttgactccctttcggtccgcttcttccatcaaggtgcgaaaatcatttagactcccacacagcgggtatactgatagtaatcagttacatcatatttatggtaacttggagacggattaggagcataagccagaggcagttgacctccaaatccaccccgaatggggtttgccatcgtttaagtcatcaagtttttgtgtaattcctttcaaatcactgtgtccgtcttgtgaatatacttggttgaattattatcttgtggaatatggataaatgtatccatttaagtgtatacatcccgatatttttgtcattttatatggactaatatatgaacgtaccataatggaatgaatcttatgtgtgatttcgtagaagaagatggggctgtgttaccgcttttgggaggcatgctttacatgggaaactggtagtatacaacaaaaagcgaatatgattattgcatatagcgtcatccatccatgacaatggtttgtccagtgagataaccaatttttggattggcaagttggagcacaagctccccaacctcggattttttacccaggcgacccagcggtgtattcccgataatcccttccatcacagcgtcatttaatgaatctgtcatttccgaagcgatcgggcccggcgcgattacatttcacactaatattgtattttgccagctcacgggctgaagatttggttaatccaatcaatccggccttggaagcaccataatgagggccgaagcttcctctcgtaaagccgctacagaggaaatattaataattctgccttcttcacaaaggatctgtgatatgccacgcaggtgatgcaattttgggcgatctcttccgatacggatgcgaatggaatgtattggtggcctgggtgtgttagatcgcaatgaatttcatcggaaaggataaggacctgatgcttgacgcagagcgtgccgagtttctcaagaacttgtgtgtcccacactttgcctattgggttatgcggattgcagaaaatcataagcgttgtgtcaggatcggctagcttcttctccacatcgtcaaaatcaatcgaatatcggttgtctttgtaaaccaaatcacttacgagaacttctcgttgattgttctttatggagttgtagaaaatgttatagacaggcgcaaacataagaactttgtcgccggctttggtcattttgcgcacgatcgatgatatcgctggcactacacccgtgcaaaacataatccattctttttggatcggatagtgatgtctcttttcccaccatcgggcaactgcatcatagtaagtatctggtatcgaggtatatccataaatacggtggtttaatctcttttgcagagcatcgactatagccggcgaagtctcaaagtccatatccgctacccacatcggcagctctcccggaccaacatcccatttataagagttagtgaccaaacgattcgtcattttatcaaaatcaaaggacaaatcgatcacctgctttatccagctcgtatcgggtgtaggcagcgttgatttctttgtcattgatgatgatttcgccgatatccttcgctttgatttttccggagattggattcttcacgctatcaattgaggtcttggtttccacctcaatggttgaatattcgaatgccaagtcggtattcagaatcgttccgttctcgatcacgagacggtccatgtagcacattccctgattgctttcgatggtgcagttgataaacgtgatgttcttcgaattccagcctaaatattctccgatgatcaatgaatcataaacggtgatattctcacaattccagaaagcgtcctttgaaataagctttgcattgcgaatctccatattctttgctccgtcgaatgcgtagttccctgccaatgtgaaatcgtcgatggtgatatttgcgctattcattccaaaataatcgccttttgcggttacatgattcaagtgaatatctgcgcaattccataaggtttcttgcgcgttgggtagatcgacatttgtcagtcggatcccgctcgaacgccgaaatatctttggtgcctctattacgctgtcactgatggcaatttgatgtgtataccatattcctgatcgggccatttcaaggaaagtgctgctactaacacgaatattattgcaataccataagggatacttccatttgaaaatgctattatcgatagtaatatcgttgctttccttcagtggggactcgccatctgcaaaaatagaattggtaatagttagattgcttcttttgaaaagtgctcgttctccagtaagcatttgttgatcgatcgtttgcataatactgtctccaatcactcagtactagcttcaaatattccctgacctcatattcgtttgatgaatatccgcagactagaaaccgagggttcttggtttatgagaagcttcaatagaaacggcagcattgatgtctgccgtttctgtgtgttacttcatttatattaaagtttagtataatcttcatccattacgggttctaaccaatctgtttgtcctggtgtaagagctaagtgaacaaaccagctgtccttcgtagcaccgtgccaatgttttacgtttggtggaatgtttaccacatcgcctgttttgagtaattgggctggctttccatcttcttgataccacccttcaccgccagtaactaacaacacttgccctgcatgatgagagtgccagttattacgggcaccgggagcaaaggttacattcccaattgctgtattgagtggtgctggatcggtaaacaccatttgtaagtatgcgtcaccgataaaatttttttcgactttttgacccaatgggaagagtgtgctattgcttaagtgctcattcttcattttttatccctgctttcttatatttttattattatccaacgcgatgctatcgacttcttacttttcaggaatcattaacactattgggcttgctcaatcgtcatcgtgaaactgccgttcatttttacaagcttttcaactccgacctcaatatgacctagctttacaagtccacttgaataaccaaaatcttgataaaatatagccaaattgccccaaggagaataataagtaaaatctccaacggaaggatcgatgcctgacggcgcagcttcaatggacaatcttttctctagcctgctgattttttcggttccagcataatcctcgaaggttatagtcattggaagtcgctgtaaaaaatcttggctgctcggattatcgtacatgcttaccattacttcctcgttgttaaatatcaattttatttttatattagttgtttgattggccacagtttttcctccattggtattaccgacacaagccatgagggtaagggtcatcaaaaaaacaagggatagagaaatcggtttcttcactaaattctctccagctattccggaatgatttcatttaagcaacttaaagtgtttaatgttctcggaaaacccatatatggaaggcagtgagtgatggcagtgatcatcatatccttgtcattgcccacattcagattgccccgcacatgtgccttgacttgactttcacaaccgcccaggctgcttaagatacagagggtcagcagctcccgtgtcttcagatcaagacctccacgagtatagaagtcgccaaaacagaaggcagaaagatagtcctgtatatgcttttgattggatggagcattatccctatttttttcaatgatatcgccaaaaatctctacctgcactgcaagccctttatctaaccgattctcttcttcaacctgcttttggcattcgagaggtaacactatattttcggccttgaaaacttcattaatctccgcgatggcatttagcgttttggggaatcctaaataaggcgcacattggtaaatggcctctttgatttctaacggtgtcagcccaacgttcagtgcagcctgagtatgggccttgagctgtggcaacgtttggttcgttgcaagcaccaccagagtaataagctcacgttgtttatcgtccaattcaccttgataaaaaacttccccaaaaatgaagcggctcagaatgtcctgaaaatcaggattagtagcgtatgccgctggcactccatcgccaaatagctttttatacgtcacttgattcttttcaattcgattcatacatttacctctatttctaattttagtataagccatttcgtggttcctccctttctttttttaaaaatagtccaatgagcgactttattgatgtacattaggtgttggtttcgcgcggtgcctccttgattgtcgcctagtaccaatgggagttatgctcgtagtaggtgcgtacatagagtgagtcgccaatactcctttgatatggagtacatcaaacggataatttttttatccctttaaccagaatgatataggtaattatagataacaaactggtagaaaaaataataattccaaaaggtatagcggaattttcgcctgcaattcccacaagcggagacgtaacggcacctaacgcgaattgtaaggtgccgagcacggcagaagcgctccctgcaatatgcccttgcgactccattgctaatgtaaaagagatgggtccaatgatccctatggataaggcaaataagaagatcgaaataaacatagctgataatgctccatgtactagtactataaataaaaccgcagcggaagatataaatgacagtattaatccgatcaaaaatagtcgactttccgttacccggcctgcaagcagtttgacgaattgagctcccaagacaatagcaaggccattcaacgcaaacaggatcgaaaacagttgcggcgacacaccgtatatgttttggtaaataaatggggtacctgcaacataggcaaaaacacctgcgaacaatatgccattgacgagagcatatcccataaaagaccgctttcggaacaagctgttataattcttcatcaacgaacggagactacttggagcacgttgctgtacaggtaagctttcctttaacccccatatggttatcccagttaatcctatacctagcacccctaaaaatataaatatacctaaccaagagctgtatgacatgaccgtacttccggccgtaggggaaattaacggagcgacattgcttatcaccgttagcaacgatataaacttagtcatttcaatcccactaaaccgatctcgaacaatagcacgcgaaataacgagtccggcggacgcagcacccccttgaataaatcttaaaaatataaaccattctatgcttggtgcaaaagcgcatccaatcgaggaaaggataaataatatcatggaaatcaacaaaggccggcgtcttccataaatgtcgcttaacggccccattatcaactgtcctaaccctaatcctaacaggctagtggttaaactcgcttgaacggcagttgcacttgttccaaaaaaaacagcgatttgcggaagtgatgcaagatacatatcgacggtaaacggccccagcgccgagaatgtggccaatattagagcaaaaccgagagaatttttttgggtcttatatttcattcctttaactcctatgattgattaaatgcacattctttaagccaacgcatttgctttaggttttgtcgttttattaccctgtgacagtatacccctccgatatacaaagggtcttagataaatttcggaagatatgtcttttccttatccaactcaagggcacaccacccggcgtgcccttgatatttttttgctgcactgaatccctattcgttccccattgtgctgatatcgatgacaaatcgataccggacatccgaagcaagtacgcgttcccatgcctcatcaatctgattagcggagataacctcgatctcaggcgtaatgtggtgttcagcgcagaaatcaagcatttcctgtgtttcccgaataccgccgattgccgatccagcaaacgaccgacgatgcgggataagagagaatacttgaactggcaatgcctccggcggcgcaccgacattaaccaaggtaccgtccactgccagcagtgataggtaggcattcaaatcaattttcgcgctcaccgtattcacgatgagatcaaacgtgccggccagcttcttaaatgtctctgcatcgctggtggcataataatggtccgctcctagtttcaaaccatcttcttttttcttcaaggtttgagataaaaccgttacttctgcttccatagcatgagcgagcttcacagccatgtgtccgagtccgccaagtccaacaactgctaccttcttgccggaagcagcaccccaatggcgcagcggagagtacgttgtgatcccagcacataaaagcggagcggcgacatcaagatcaatgccgtcaggaattcgaaccacgaaatcttccgttacgacgatgtgggtggaataacccccttgtgtatattgtccatatctgtcgatagctgcgtaggtacccgtatgtccattaagacaatattgctcctctcctctacggcaactctcgcactctcgacaggaatcaaccatgcagccaactcctactcggtcaccaacagtatactttgtgacttccgagccaacctgggcgacaacaccggcgatctcatgtcctggaacgatagggtattggactggcccccaatccccacgagcggtatggatgtcagagtggcaaatacccgcatacttgatctcaatgagaacatcatgcggcttaagatctctgcgctcaattgtagttagtatgaacggaccttccggaccgaacacagcacgtgcattagcattaatcatatataacctccagtgaatacaattttatctgttagtccttttttagaaattagtaatgattattcacatttttttattaactaccaagtgaacatccctcctttctaaatttaagttctccttttaggtaatattagtgaaccacaaagagcggataaacaaaacttgttgttttatcaactcacgtctattattataaaaaagaagcctaagttcaatggttaaaaaagcgcaatttgttgaaataacaacaacatcacgaaaagtgttcattattttgagttggtcagggggaaaagactaaatgataaaagtagatcggagaattctaaaaacgcaagaatccttgaaaaaagccgttattgaactgatggctgtaaaaaacttcgatgacattaccattcaagacattgcagaccaggcaaacgtaaaccgtggtacgatttatcttcattatcaggacaaatatgatttgttggataaactgatcgaatcacacatgaatgaattaggcgaaatggatgaatgggcatgtaagctggattggagcaatggacttgtacctttttttgagtattttgagaaaaattatttatttttttcgactatgttagccagtaaaggagccccctcttttagaactcgtcttcttgattatgttatgggaggattcagaggtgagattgatagagaaagtggaagaaatgtggatttaaatgaagacgttatgttgcaatatgctggtaccgcttatgtaggggtaatagaatggtggattagaaatgaaatgccgtatccgccacaaatcatggctgaacaagttggagccttattggagagaagtctatagagggttaaataataggtttaaatagagtctatactgattgaagataactgcccgttagtttatcaaaaatggagcagcaaccaaccggcaaactgctccatgctattttcaactaacgtttctcgtttgctcaatgatatattagtaatcacttcgcccatttccttgaattattcatttataccataatgcacaatattttcgtagctcaagccttgttaatctgatatgttcaaaattgaaataccattgaaaactcactgccgtccgggttgctatacaatttggtttacagaaaaaagatgtaaataatattgtcctatctcgggtacccattcccaagctgaaccacccatatggaacccaagtcgtttggtggcatttctccaatgccatctctccggacataatagtgcatggtacggattttctttactttttttgcttagacgggaaacacttcctttcaaatcgccgattccatcagcattactatcttgaaaactacgtggatatatctggtatacaacgatttctttccaccaatttttatttttcattgttcattacaacccttccaatacacgaataggtgtttttatctcaatcaagtcacagcatacaattactcttttaccgatcctacaacaattccagtcacaaaatatttttgaagtagtggataaatcagcagcagcgggatgacagcgactacgattttggccgcatttaaatttttgtttgaaatttcagtcaagttgctgagttgtgctgagttggtgccagattgaagaagttccgcaatgttcacgttaagggactgaatataagtcattagcggataattgctgacttgggtcatatagatcaaaccgctgaagaaatcattccacgttcccacgatactgaatagtgctaccgtcgccagcgcagggatggacacgggaacatacactttgaacaggacctggagcggattcgccccatcgatgaatgctgcttcttctagcgccttaggtacagcggagaagaagttcatgacaaggatgacactgaatatagggaccgcacccggcagaacaagcgaccaaattgtattaagcatatcgaggtttttgatcagtagataactcgggatcatcccgccgctgaacagcatggcaaaaatcatgacattcatataaatgtttctacctctaaattcccttttcgacttggagagcgggtatgccattaaaataataagaatcatgttgagaataagtgtaagcacaacacgtagaacagatatgccaaaggaacgccagaactgagcatcatcgataattttcgtatacgctgctgttgtaaaattgactggtacgagacctacagcattagctgacacggcctcgctgctgctgaatgaaatcgcaacgatattccataacggaagaaggcagatcaatgccagcaatatgacgatggcattgatgacaaaccggccaattcgatcttttaggcttacagaatacggcataggctttgcctccttagaatatttttcggtcggtgtatttcttggccaaatggttggcggacaatagcaaaacaataccgatcactgacttgaacaggccaacagccgtaccgaagctatactgtcgcccaacgagtccaatccgatatacataagtatccagaatatctcccgactcatagacaaccggattatacagattataaatttgatcgaagccggcactcaaaatattggttagactcatcactcccatgagcaggataataggcagcatacctggcaacgtaatatgccatacttttctccaccagctggctccatccattcctgccgcttcatacagacccggatcaatcgaagtaattgcagccaaatagacgatggaactgtaaccgaactccttccacacgtctgtcccaataatcaacggctggaaccaggtgttgctgccgagaaaattaatattctccagaccgaaaaaagccaaaatttgattcacaatcccatccaaactgaacatgttaacaaccacggatgctagaactacccaggatagaaagtgtggcagataaacaattgtctgtacggattttttaacgaatttgatgcggatctcatttaacaagatggaaaaaatgatagccatcatggttcccaatagaatcttggcaatggcaatcaccaacgtattactaaaaacctgtgcgatgtccggcagcttaaacatataaataaaatgcttcagccctacaaattcggagccaaacatccccttggctggtatataatcctgaaacgccgtaatgacaccgaccatcggaacatagctgaataccagcaaaaacaaaattcccggaagcatcatcagatgatacatggcacccgtgcccaaccgaccttttgctttatcatttccctgtttcatagatggaccccttcctgaagaaaggctgcgtatcgcagcccttctagcagttcatgattatttatttatcggatgcggcctcgtcttcaatttcctgaatcacctggtcaccgccttgtttcttccaattgctaacgaaagtatcgaagtaatccagagattctgcaccagtcacgattttgatgaaagattcctgctccatcttggtcagattagcccatgtctgtttcatgcttggtgtagttccagagaaagcaggtgtcatccaaacgaatttgttttcctgtgtcagtttgtcgatgagtcccactccgttgatacgcgagtgatatttcgaccaagctgttatgttatccgtatccatatcgctcaagtaggtttggatactttcaatattgttctttgattcggttgtccggacctgatccagactaatcccccctttaatcccgcgaacaacgtcagagtaatcatccagcagcgaggtagccgagttgacttcaatattaaaaggtctggtagaaccgtctacgccgttctcttgatacttggcggcttctggcatagatgtttccacatttttatcatttgccagtttatcgtagaaaaggtttactattttaacggcgagttccgggtgttcatatccttttctcacaacgataaactgattggctggattggcgtgtgccacgtgtacctttccgtctgcatcctccaaagtgtaagccgtgaatttcgcattcttatccatctgcttcacgctgctcagaccccagtcgggaatatgccatggtccaaaagcaataccgctttggccgttggtgtacagtgccgtaatatcatcaaatgtgcgtgttccaaattgcgggtcgatgatgcctctcttgaaccaatctgccatgacgcctaacatctgcttggtttcctttgttgttgagccataaacaatgctgccatcctttcccttcaaccagtattgagggaatgcacccttggtggaggcaactcccagcatggtataggcggaaccattatagtcacttgtattcagggtgttcacaaaaggaatacctaccggtttcccggattggccaggatctcttttcaggaattcctcggccgttttctccacatcatccagcttgatggccccgtctccgtctgcgtcaagttggattcccagtaaatccagccaatcctgacgaacccagaccatggttggcgcggaatctagggaagtagccggaagtcccattaaacgtccatctatcgtcgcattatctaatgcacggccctcataagattcgtaaatgttcttgatgttatctgtggcatactgtttgtaaatttccgtcatatcttcaatcagatcattatcaaccagttctttgagttcatccttggaatcgacacgcatcatgtcaggcagttccccagaggcgatggcgagagaaacctgacggctgtaatcttctccgttggcttcaaattggtctttaatctgagcgttaaacgtttctttgaccagccgagtatacgcgttgttctcatacgtatctccagccggcagtttcgggttggctgtagtcacacgacccatcgttacggttatttcgtctttataggcactgaatgggtctcccggtgttgcctcatacttgcccgcttcctccgcagtgggagggttggaggaacccccacaggctgcaagagttgaaatcatcagggcagacatcgacagcacggccagacgtctcgtcaacatgtttctttttatgaaccatttagttctcatcacattcgattccccttcgttctgaatatttctctatcattgttgtttgcgctttcattataagactcggagaagacaaatcgagatagggattgaacgtctgtttggatagagaaatgtatacggtttcattcgggatcatgaagccatagttggcttgtaagcatttatcctaccaaccgacatacatttgtctatccttacttactaatcaaagtgaagaacaaaaaaaccggcagctcctgaaacaggaatctgtcggcttgattaatggaattatagaagtgtcttgtagaatttatcgtatcacattcatgatagtcttcagcgatgattatgggctacggtcacctccacagtcacttgatcgcccccttgttccttccattcctcgacaaattgatcaaatgaatcgattggttcagcgcctaaaataattttcaaaaatgtatcatgttccagtttcgatagttcaccccaagccttctccatcgttggagttcgtatataggtaaggcttcgaactttatggatgtttggatcgaagaaatttcttccgcctacaagaagcgaataactccgcataaagctgtcgctgtgtttattccaataggaaataccatgttgatcataaggcttcaatttggtttgttttatcgtcgaaaccaagttctccagtaatttgtattcagacttgcccttgaaatcggcgggtgttttggttcccatcagaatatcctgcgcggccttcgattcatatcgtgcctcatctgccggagcaaagaaattgcggctcagcataaaacgcgtaccgtacttgaactcatcacgaaggtacagattgttaattttaatgatcgcttcgggatgagcatatccttttcgtaccaccaagaatgaacttgacggattatccaccttcacatggtatgctccgtttgcatccagcgggagtgcgtatgcttgccagttcgccttcggctcgttctgccaagcgctcggaaggggccagtacccagcatagaaaccttgaaagaacatccccgcctgaccgttaatgaccgtttcctccgcttctttgcggatgcccatttctggatcgagaaggcctttggcgtacatttcacgcagctttaccaaggcgtccttcgtttccggtagaaccgaaccgtatacaggttttccatctttgctcagccaatatcccgggaaagatccatatgctgcgaagatcggcgttagatcaaaagcaaaagcactgttgttgaaatcgttatacagtccagtgcttgaagcaaggccaatcgtatcccgcttactgtttccatccgggtcattctccacaaaggccttggcgatagcttccagatcatctaccgttttcggcggcttcagtccaagacgatccagccaatcctgtcgaatccagagcatgctgaagtcttccgctgtcacagaaggaacagccatcatcttgccatcgaaggtcacttgttccatagccaatccgtttgtgctatcgataattttttttatttccggtgatacgctgctattgtatgcctcggttagatcttcaatttctccagccttgatcatctcgttcagctgcacctgatttacaatcatggcatccggcagatcattgctggcgatagccagatcgattttctgacctagattttccttcgacacctgccataatacctggacatcaatgttaaggttttgtttaatcatcgttttccacatattcttctcaagtgtttctcctacggatagatccgcgcctgttgggtctaccacatatcccagccggatggaaacgggatgttcatatttccctaatggatcggcagcagcagtgtccgagattgttttcgttggtcccattggtgattcccggaagtatgggctgctgaaatttactgtcactgtaattaagctgacgacaagaacacatgcagccatcttcttaatcatcgctttcccttctttcgcccggattattgactcatctgggagaatacgctatttatcccctctgccgagctgtcgatattcgcttggcagcagacctgtcaattcgcgaaaaattcggctgaaatatttttcatccgtataacccactcgctccgcaatccagaaaatcgtgttggttgtattcaataaatactctttagacttctctattcgtataaatcgggagtactcattaaaggttttccccatcaaatccttgaagcattgactgaaatagcttcggctgatgttcagttgttgggacagacctgaagctgtaaaagcttggtccaaatcattttgcatgatcataatcgcttttttcacggcgtctacaatttcttgtgaatacgaagtctgttcatctgccttacgaatgcccacagaggtctgcttgatccaatcttctacctcgtaccaggattgaaaagaatggatcattgagattctacccagcgtggtctgagcaaaaaggtgattccattccataactatagagtatagcaaacccatcagctggcctttatgcagtcttagtgatttgaactgttcaatcagttggttgtagtaactgtcgttgtgggtccatggtgataggaaccaactttgcttaatacgatccatgtcttcatcctgcggttctattggaaatgagtcctccacattcatcgaaacggaaatgacaggatcacaaggattgtatgcatagaataaggacgtttctgtatagttcataatccagttttggatttgcgaccatgttcgctcttgtacatcggacagaaccagcaaggcgccttggggaacttgatccaggtattccttcagtttatggaacagctgatcctctacgtccatgggtgccgtccacatccagctgttccgttcaacctcccaacggatctcatctacattggatgtcagttcaatcggccagttctgtcctgacttgcgatccagtgaaacaagtgcatacacatggcgataaaggacattggtatcacttagcagcggcagctttcgtcttgtattcgccagctcgtcaatccgggtatgtattcgatgcagcacgtgttcgaattgctccttctcgagctgaactttggctatataatcgatggctcccagcctgagcgcttcctggatataatcgaaatcttgatgcagtgttaatacgacaatatgtagttctggatagagctgccttgcagctcgcatcagttcaatacctgacatcaccggcatcgcgagatccgtcaacatcagatcgaccggttgggatttcagaaaatccagtgctttcaacccgttacttgcttctcctacaacctccatattgaactcgttccacggcatcgcggagcttattccttttcgtaccaatttatcgtcatccacaatcaacaccttaatcatcctcagacatcttctcctttgataggaagtatgagcagtatacttgtccctgtacccaattcactttcgatcaccagttgtgcttgatctccgtactgtgccctcaacatgcggtggacataattgagtccgatgcccatccctacttttttatgttcagctatacgattgttcagaagtctttgaatcgcttcctcggtcatacctgctccattatcctgtattaaaatattcagcgttttggcgagtgtaacttcaatttgaataaaaccttcgtcactcagtccatgataaagtgaattttcaaccaacggttgcagaataaaacgaggcacaggtatttgtagcacttgatcatccgctgaaatacgcacgtcaaattcaaagtcatatcgaatttgttgcaggattaggtactgtcttagcgcatcaatttcctcttccatcgtggatacttgccctaatttacccaaattgtaatacaacagcttgttcaaggattgcaccaacttgtcaatctccccttgtccgttcataacggccagccagtgcacagtatccagcgtattcatcagaaagtgaggattgatctgatataacaatttttccacttccaaatctgcacggatcttttctttctgttgcacttccttgaacaggtcgccgatttgatgctgcatatttgagaattcccccagcagaaagtcaaactcgggaatttgagtgcggatctggctgcctgccttttgtggattctgagacattccgttaatttccgaatggaacagacccagtggtttgtagacggtcttccacagaagccaagcaagaaatacggtaaagccgaaaaaaaataaagcgaccagtaatatttgaagcaaccactggtttttctcctgttgatacttagcctgcgaaattaccgatatgacgctccaattctgagaggtgtcctccttaaaccaatggtaatcacgggatattccatcttttgcagtacctttcgataagctggagaaattctccccgaccttcatcgtttctggaatttcactgtaaacaatgttgccctcaccattcaggatcaaatgcgataaagctcctttgtattgattgtaatccagtatatcctgtgtaagtcgaaagccggattcgacgtaaatatatacatcgtccctttgaggcagttgtacctttcgcatagcagataaaacgagctgatcatcaaatcggttcatactgatatggggaccatagtacgcaatgccatatgatttgaatagcacaggcaaagactcgggggaaaaacgatctttgatgggaaagttagcgaactgtgtagtgccttctttctggaaatagtataaggtcagacctatattcggattagtaaacgttacgacatttaactcattctttaattcatctctagcctcaatcaattcaaatatattagaggaaggcttcaagacttcatccagtttcttacctaatgtacctctatatgacaattgctgagtaacatgattcaggttgttaattgaattctccagtgatgaagttacctgctgtagattgctccgaattccatcattgattttattcgcaaaaatggaatcaatggtatagtaagaaattacaaatatactaataaaggggatgaacgcgctgagaaaaaacaataaaaagattctttttttaagtgtcattccgacccattctccttaggtaaatgaaacagcaagcccctggttatggagcttgctgtttatgaacaacagctctatcaattatcgtattcctcataggcagcgacctatttgaaaattggtgacagctcaatccgtttcatattgaaaaaatcagaatacttccatctctgtgaggtccaattctgttcataattatagattgatattcaaatatgtcaaacgctttcatggaattcatagaacttattctctcttcctctttgcagacatctgatttgttgtgtttaattgcttattgtagtccttccgttcatcacgaaccaaaaagagaagcgacatcgttcaagatcccaaccatgattttttcttgtctttacgtgttttttctgttttccgctctacctgttcttgttttgccagtgtctgtcattctacttagattttctgcatacaaaaaaaggctccctccgtttttcttcatatatatacttgccgaactcctttggcggcaattgtttttccttaatatcgatttcaataaaattgttctccggccagattgggagcagacaccagtaacgcggcctgacgattcatatttttccttctttctgaggtttagctgtaaacctcttgtcccagcacccgatttacagccttgataaaggcaagatatccaccatcggtatcgttccgatgaggaagtgccaaaataggtataaagatcatcttaagatttagatggcagatgaaaaataaagagaccatgctccataagagcatgatctctaattacataatggtattgttacctagccatcatctccaacctgaagcatacggtaaccaactccgatatgtgtttgaataaactttgtttgagatgatgtttttctattttttctcagcgttgccataatgccatcctctgcccaccttctgttatattctctctcaatccttagtgtatcatgagcaaaatcagtaccgtattacgaatttgcctacagcgttaagattgcattaagatccgatcttatgtaataacatccttaaagaagcctcaaaatcctaattctgtcctagctttctcagtggaaggatagcagcacaaaataatataaaaaaaactttctcaggctggttaagcacaaatttaaaataattttcgtttttttgaaaatacagtcaatttttctgtttgtaaaaaaattctagattgcacgttgttgcaatctagctacagcgtattaaaggttccacgcatgaaaaataagaccatccttcgtcttttccgggagtccgtagtttgcgacagccgatagcttcgcatccgaaccgtctaactaccgaacatcggcattcgcctgtgcttcgggattaaagccaatcgtttgcaacaacaatgcgacaaaaagaacgatactccagatacgtctcaagatggggcttgccttcctcctcatactaaacttgattttattttacaaccaacttctcttgagagattaggagtaaataaaagagggtaaaaaacaaaatgtgtacgttttcaaaggagcaatcgtttacacataattgtactcagagacatggttttattcattttaacaatttgtcaatgcttatattaaagataaatttctaacggcttccccatctgctccttgatccgttcactccacattcttcgtttaaacatacgcttttctctgaaaatccatcttttcactgtttttagccattcactgactagcttcttgcaaaaactcttcgaatatgtggattaagttctcgctatgctattacattgaaggaatcatcccctttttagtactaaaatataaacccttaaaaccttgaaaatatgtccgtagcaatgcattgaccagtaaaagtatggatgatataatcataaaaggaaaaaatcattgatatagatccctgtgttaatgggcttttctcatagtttcttttgtaagcgcgtacaatgattattttccatatataccgtggaggaggtgatcaatgaatccattttatcaaaataaatgtctttctttttttttaacttttaatgcaaccgattgcattatctcccccactaaatattatcaggaggttgttaacttgctaaggaaaaaaactaggagttttatttcttggttgattattttatcactttgcttcaacttcttcggtttacccggcgtagcttcggccagtaacaccgattatacatccacctacacgaattccacagcaactgcccttccatcgacaaccgcttctatcacgtctaccgtaaccgcaacgtatgcacctaccacaacccctcaatcaactcaaagtgggttaacggttcactttaagaaaccttcaagctggaattcagcgattcgaatccattactggaatctgaatccgacaaccgttccgataagcggggcgtggccgggaatccttatgaagccggatggaaacgactggtacagctacaccattgccgaggcgacaggctcaagtctcatcttcaatgacagtagcggcaaacagacggccgacttgtcccgcagtgtgaaagagggctggtattacacagataacacatggtatgatgccagcccggaaatgcctaaaatgccggcgatttccgcctctcctgtacccaaaacttatgattcgtcccaaacggtgacgctttccagcaccaacagtgacgataagatttactatacgatagacggttcgacacctacgacatcctcgaccttgtatacctctccaatccaagttgcttcctctttgaccattaaggccttcggtgtcaactcaatcggtcaaactggaaatccgtcctctttcgcttatgtgattgacctaaatgcagatctgcaagctccgacaatcacagcgaatttgcctgcagggcattccgattcctcagtgactgtatcctttaacctgaaagataacaaggcggcaacgaccaaggcatactatacggaggatggtacagaaccaaccacaagctcaaaagtctatatcctcggcaacgcgctggccggattgactggaccgtctattcttatctccaagaccacgacattaaaatttctcgttatagacggtgctggtaatcaaaccaaacagagctttgtttataatattggaactaagggggattttcgggaagatactatttacttcgtgattacttcccggttctatgacggtgattcgagcaataacgtgcacgcatgggatgatggaaaggcgcgcaatccagattcggacccagcttggagaggggactttaaggggttgattcaaaagctcgattatatcaaagccctcggattcagcgccatctggattacacctgttgtgcaaaatgccagcggttatgattaccatggttaccatgctttaaattttgccaaagtagatccacggtatgaatcggcgggagcttcttatcaggatttgattaatgcggcccatgccaaagggctgaaggttattcaggacatcgtcgtcaatcatacgggtaatttcggtgaagagaatctgtatcccatgttcaagaaagatccagctaatcccgataccgctaacaacttggtgaagactacggataagttgccgccaaactatgattccatgacacccgatcagcagtatcaggcaaggctcgccttaatgaagtcagaggggacgaacaataacatttaccatacagagaaaagtctctcctgggaatcctatactgttcaaaccggtcagatagcgggcgattgcgtggatttgaacacggaaaaccctgcagttaacaaatatttaattgatacctacaatcactatatagacatgggtgttgacgctttccgtgtcgatacggtgaagcatgtaagccggtatattttcaataaatactatattcctgcctggaagacaagaggcggctcggatttctatatttttggtgaagtagccactcgttacagagatgtctggaacagtggaattccagcgatctcgacgccattctatacttggaaaagctcaaaatcgtatccgggcgatggaaagaatgactacgcctccaataaaacgtcagttgaacaagagtgggcggacaactctactacagcaggacagccaacctcgaacaatgctttcttaaacggaaatacttatcatacgcctgactattcgatgaaatcgggcatggatgtgattgattttccaatgcattgggcattcaagactgcacaggaagcattcagtatgaaaggtggcgatcaatactataatgatgctacctggaatgtaacctatgtcgactcgcatgactatgcgcccgaccaggctccggaaaatcaaagatttgcgggcacacaggacacttgggccgagaatctcgatctgatgttcaccttccgcggaatacccgctatcttctatggctccgaaatcgagtttcaaaaaggggcaaccattgatacaggtccaaacgcaccgctaagcaaaacaggacgggcatatttcggcgatcacatggaaggcaatgttacggtacaagattacggcaaatacacaaatgctactggcacgcttgcggaatcgctcaaccatcctctggcgaaacatatcagacagcttaatttaatcagaagagctgtacccgccttgcaaaaaggccagtattccacagagaatgtatcgggcaatctggcgtttaagagaagatataccgacagtgccaaaggcattgacagctttgcattggtcacgatttcaggaaacgccacgtttaccggaattccgaacggaacctatgtggatgcagtgaccggtgattccaaaaccgttactgatggcaagattaccctgacatgctccggcaaaggaaatgcaagagtatatgtattgaatggcagaggtggaattggagaaacgggaacctatctgaagtaaatggcagtatgtcttagttaactgaagcaacctcagttcggtattgaaccgtgctaaggttgcttcattaaaaagtagatccaagagagagtcggatattgctctggactaaatttttaaacaacaagatgcaccaacggcagcttctatgtgcgtacattcctccgtatatttaatgaccaacaaccatcaagtattaacgggttatcgcttctaccctgctctctggaagcacctgaagagttgcattctgaagacggtaaccagtttactggtggttcatagccctctcaaggatagagactatcagatgcttaatgaatgaaaaaaatgatttagatggtcggcaaacaatctatgattttccatggcggcgaaatgaccgcctttattcgctttctcccagtacgtaatattatagacgcgttccacccagcttcggggaggcgtgggcagctccttgggaaataaggaaacccccgttggaacagtaacacactggccttcggtgaaatgcagtggcattttggtgccttcagtatatattcgtatggaagaggcaatcgaattggtaaaccagtaaatcgatatgttggtgaggatatgatcaagtgaaaaagccagtgtttccggcttcgttctatgaagggcgctataagcaccttctcgctccaaccactgctcttcttcgctaacagatggtgtattttgagtgaggggtggcttgtagcttccaggaatataattgagatgaagtcccctcacccgttcagggtacatgaatgctaaccatgttgagacccctgctccaatatcccctccctgaaccaaataactttcataacccaaacgatccataagttttgcccacagcgtggctacatatttggaccccactcccggccgtgtgggtttactcgaaaatgcaaagcctggcaaagagggaataatcacgtcaaatgcctcttcagcgtgtccaccatatagcgatggggttgttagataaggtattctacaaatgatcctggccacccatgagtcagcaacagtggtcgttgggatgtcccttcaccccgaacatgcacaaagtgtatatcgaagccgtccacatgttcaataaactgtgggaaacgatttaaccaagcttcctgttcacgccagttgtattccgagccccaataatcaactaatctcttcaaaaaggaatagtctgtccccagagcccatggttctatagagaaacttgaaggccatcgaacctgttttagtctgatagatagatcgtgcaattgttgctctgaaattgaaattttgaacggttccattcattgtttcctcccttgtatattaatttaagatcagaagggttctattgtatgatggatctgttcattaataaaattgaaatattcaaaatcattatcatttttatcgatagaaattaaacctagggagaacaccgatagaaattagacaccttattacatttcagacgattatcgaaatcggaagttatacaggggcagcatcgtaactgggatacactcagtccacaatcactgcccatatacagtcgcttgaagaagagattggcggggagcttttcacttacgaaagaaggcatttgaaacttactccattagggagagaattaatacctctggcagaagatctactggctactcatgaccagattaaaaatatacgaagcaaccaggaagttaaaggtgttgttaaggtggctgcaccagagtctttacgatttctagattaagtccgattataagggaattctctttgaaatatcctcatgtcaaactcatccttaccaacggtacatgtgaataaaaccaggttgacttaatcagtggacgtgtagatgtggctttgatggtctacccggaaatacatccggtataagcgagagaacaccaaccatttttttataacgaatgaagaaagctgtagttatcggaccatgtttgaaagatatcttgtaaagcatgatattcatccatttcaaaccatggagttatggagtatagaggcgattaaacaaaccgttatgagtgggcttggattttcttttttgccttatattacagttaaagaagacgtggatagtggaaaacttaaaattgtaagtcattccgaaaagttcgatccgatatactcccatatgctgattaaaaagagaaagtggctatctccaacagtgaaagctttctctgaacttgttataaagtcgatacgtgaaacggataacgagatcgaaagatcaagatgagcaccattgttggaatcaagtccgaaggaaaacaacgtgtcaaaggcgtgtaccatatcctaaacgtaaacagctatcatagccgcttgaagaaatgtggcaggttagttgattgaagggtgttgttttaggcctacatttaatttaaggagaaaattaatgaaacaaggcagaattattataattactggttcaccagggactggtaaaagtacaacggcatcaattgttgctaaagagtctaatttatcaaagtcggtacatatgcacactgatgatttctatcactacattcataagggggcaatccctccatttttaccggaatcacaagaacaaaacttaattgttattgaagcctttttggaagctgcaaaacgttttgcacgtggtgggttcgatgtgattatagatggaattgttggtccttggttcttagagccttggttaaaaaccgtacaagatgattatgaagtacattacattatcttaagagcgactaaagaagtaacaatgaaacgagcaatcaatcgttccaaattggacgaagatgccaacattgagttggtagagaaaatgtgggagcaatttaacaatttggatcactatgaatccaatattattgacacaacaaatcaatcaatcgaacaaagtgtttcaacaataaaagctgtgattgaaaaaaaatcttctttactcactatttgatgcgatacaaaagttaaacaaacggatacgatagctcaataaaccgccttttcttcaaggcggttttcttataatcaaaaatcaacattagaatttaacatagccttagaaaaagaaaaatatacaggtattcgtaaaatcggcttctctataaaagaaatggtttctatgtgtaacgagataattagcgactttaatctttatcccgtttggtattgtgcaacaatcatcttatttacagtaatgttcgacatacggaatcacatttcgttagaattttatcaattaaaacttttgacgttaacggtctatgccagtgcttcatgaaatacgccacgacataaggacgcactaccggtgaagtatcacggacatgcgtgtttagatcacaaatacggacaggggccttaacggcagcccccttctattccgagctgtaagatgaaaaactgcccccgtttagaccagctccaaccatacctgcttcagcaagcatcttaccaaccaaattcgctctcagcttttcaataaaagaataagcactttatcaggaatatcaattacgagcaggtctggaacaagataaatagtttttgtatttttttaatctttctggcaactcaccagccttggaattaggttttaatgaaactttatataattcatccgcgtgctcgaatttcccggagattagaacatgcgaatgcgctctatcttcctccgcaacattgaatttaactttgccttgttcaacctccaaagtgccctttacaccgcaaattccgcatattgccggataattatcatcatgattcctgatttcaacgagtttggaatgacagattggacataaaccagattcgccaatatatttcgcttccgtagtcggattcattagtgtttcagccacatgacgaccagattgcctagctctgttcaattcattttccttaaagactactgatccgggcaaaccaacccaattgactagcattttgtctacaacattgatttgcatcggcagcgtgaaaagatggagcatgggcagtgcaagtgtgtcccactcactcccccctacagctataagagaagccactcttggtttaaagcttctttcatctgggcctttaccagtagttattcctctttcttcgcgttgcttcttggcaatcattcggaaggcaatgtcatgggaggggcccatccggtcattcaaagtcttcaacagtccactcggactcttctcataaatggctgagctcaagattaacccgtcgcattccattattttttcttcaataaatccaaaatcatcgttctttatcacacaatctcctgagtcacacttttcaagcaaactcactacacaagcattacaaccagtgcaaggtttaatttgcaggtcataaagacgtataagttctacctcagcacctatctcttcagcacccatcagagcttccttgacaaggatttctgaattactcattcttctaccgcaactgatccctaaaattttcattaatgtcctcctgcagtttatagttgttaggcatagattctgaagcaaacacaagcgagagtttcagcttttcccactgatttcgcataaatttcctcacgtaattccaaaaccatcccttcgcagagtcttcattttaaacaatattactcattttttgatgaaagtgttatttagtgcagcgtgtaataaattcagtatatataataaaaacgttatatcccatgtgctggaatttaaatatagtccgatatagtgacaatattttgtaatattgcacaaggattaaaaagtttttggaggctgctctcgtgaaaattcaaaaaataatcagaaaacttagcgactgttatctttccttgcccgaagaggccatgcaaacaaaagaaatcagtggatttactatcctacggttgagttccattttccaggctaataccgcttatataggcaagctttcggatttgccaaaggactttcctactgacacccctcttttctgcattcaggattgcgatgcacttgttgaatcttatacttgtcttacccttctgccaaatgaactggatctgctggatctttcgggaaagatttcatctatacttgctcatgagaatcggctcattgagcatatgcacactctaatttctgcactttactcaaacaaaggtttgcaatacttgacaaacgaggcctcccgcctctttggtaatccggtaatcattgtcgacgcaggctataagttactcgctatgtgtcaagcccctatccccagccgacctgatatcgaacagcagcgaaatttgggatatattcttgacagtaatattgagagcatgaagaaatccaatctgtacgaactgacccgtatggctcttattccttattattcatgtgatcccgagaccaacgactgttggataacagcttttgtgtacgtacatggtatagaattcgcgcaggtcagtgttatggagctggatcgcaaatttacagatattgattttgaactcgtacaatttctttgtgagctggtttcggtagaatcgcaaaagaacgacttttataattgcaatccaggaatgatgcatagtttattgctttccgaactgcttacaggcgagctcaatgatgctaatattatcgcaatgcgactgactcatctggaatggacgcttacaccttacctgagagtgatgaccttgacagacttgaagaacggcttttttgacgggaaagttcagctggttgcacagcatatgatccaattactgccggatagccgttggattgtatatcagggacgtattgtatttctcatttcccttgttgattcatcctgtaaaatcattgctgaagacaaacgaattctggaatttctccaagtaaacggactaactgcttcgctgagtgactgctttagtcatttaacttttttgcgaaaatattataagcaatgcctaactgccaacgagattggtttccaacttaattctaacaagccagtgtatatgtatgaggactatctctgcgagcatattggaaagatcatatcggaacagaatgatctcgctgacttctgccatccggttatccaaaagttaattgtttatgacaatgcccacaaaaccagtttgctgcctacccttgaagcctatcttcaatatgtggacactccaaatattgctgctaaaacactttttattcatagaaatactttgttctatcgaatcaacaggatacgtgagctttttgagattgatctaagcgatggtgatattcgcctgaaacttcaattgactcttcattttctaaaactgaaaacacaacgcgacgatcctaaagatcagagtatagaagggtaagaaaatgcaaaaaaacatgcagacaaaatttcttatcgatactttgtctgcatactggtcttctctatctattttctttaatttttccaattctatcattattcagcttaccagctttaggccaactgctgaaccgagtaccatcgcgatgaacagaattctcgcggtattacgcggttcactgtaaaagatcatgcccaatatggcaccgccagaagctccaataccggtccagacagcataggccgttcccattggtagtgtttccatggccagggatagaaacaagaagctcaatccaaagcctgcaagtaggtaaaaagcagacaggaaattctggtctttatggagcttattaatcatgagaactcccatcatctcaaataggcctgccaaaattagaaatacccagttcatacgtcagtccacctcttttccttgtttcttctctttactcagtattttgagccctacaactccgagcagaagcaccccaattagcaacaatttagatccctgtacctcagcaccaaacaacaaaatttctgctaatacagtgccggccgttcccaacccaacaaatattgcatacaccgtacctaccggaagcgtacgggaagccataatcatgaggatgaaacttactaaaattgcaactaaagtgcccccccactctaaccagccgctggcatgtttcaggccgatgacccatccaacttcgaataatgccgcaactacaacagataaccatgtcttgttcattctgtgcttcctcctttttgataatgctgcaaatgtagtatggatttatagcagcaataaaaaaaacctgagagaatactgcatacagcagtttttctcccaggcttttatccctccgtggcacagtacgacgactgtgagttttctctcggaccagccgatattacatcgcggaaccctagaaaacatttatgaattcaattatagttaaaattatacacattagttaataaattacaatataaaataataaagaattcttatatcatcctaaacttatatcattgttttggtcattatgaaatcaatttgttcttcatcacccatataaaaggagtgtgcgccagtttgaacaaaccccattttcttataaaaagcaatggcgttttcatttttttcccatacgccgagccagattttctttttattatgctccattgcaatttccatagctttatttagcagatatttaccaagcccatgtttttgggatttgttttttatataaatcctctcaatttcgagcgactcatcacccattttttcagattgggcgtcattcatatttacctttaaatatccagcaagttcttcattaaaatagatgaaaaagatttctgaagagacgttggacaattcatcctccaactgctgaaaattaaatgctctttccagataggctttcatattttcaggtgaattctgatctttaaaagtatcgttgaatgtttcaatacttatttcttggagtatttgtaaatcttcacgtttgcactttattatttttacattcacttaatgtatcgctccttcatgtaaatcaataatttctcttgttccccttttttacaaattcccagtcttcccctatattttctctcactctttgaagaagattgaaaatggtttctacttctctttccgaaaatccctctaatgcaacgttattggaataatcattttctctttttataaaaggataaacattgttccctttatctgttggaaagagttttttaattttttggttatggttatcttctttcttttcaataaagccattaattacaagtttttttatagcacgagatgcagttgttcgatctacttttatcatctcagctaacttttcttgaatgattcctgggttttcacatattcgcacaaggtacaaatactgcccttttgtaaggtcatattctttaaattctatattacttatagaatctaatgcccttgcgatcattccaatttcacgaagtacttccttcatagttaactccttcgcacctactttattgcaaatgcaataaaaatgatatatattgaatttaccttatttttattgcatttgcaacataaaattatgttaaagaggtcgagtaaagtgagatatgtttttttcgtattaggaatttttatattatcccttggaatttcgttcactatacaatcagaccttgggacttcaccttttgatgcacttttggtaggactgtccataaatgtggggcttactgtgggaagttgggaaatcataatagctataatattgatatgttgtaattcgcttttaaaaagacaaagaccagaagttttggggttgttaacggcatttataacgggtattggaattgatatgtggcttttattattacacaatttgataacacctgaactatggtacagcaaagttgtttgttttggaattggtttagttgttgtaggattaggaactgcaacatatttacagacaaattttgcaccaattccagttgaccgattaacaatgatcatacaagaatttactagaacaaatctatttttttcgagaacattcatctaccttatattcttgatcatagcagtcattttaaatggacccattggcattggaactttgttaaccgtttgtttaggggggctaatactcaattactttatgccacttactgaaaaagtacttgaccgcatattaacacactctgatacatcaccaaatcatgagaaagataaaaagcattctatatagaatgctcagattgtcgagaaagtccaaaggactttccggcactttattttttgtttggggagactcaacttttaaaacaaaaatcgatttaaaacgatctgaggacctatttttaattgatcaaaatgaccattttaaacctcattaaaaaaacagggggtttctcgacagcctgagcattctatatagaatgctttttatgttgttcaactaacttggtctgttaaaagatgtactatcataacgttgattttgatacagaaatgtactttgtacttaagtttgtctagaagaattggtactgttatttgtcactccattggtactttaattgtgtctaattcatttttataatgtgtttgtattttgaaggtcaattattaaaggagtgtagctttatgttctgtggattatctgcttttccactcaccccagttaacgagacaggtattaacgaaaaagcatttgtaacactaattcaacgattagttgcagctggtgtagactcaattggtgcattgggttcaactggaaattatgcatatcttaatcgtgaagaacgtttacgtgtgcttcgacttgctgtccgttcagctgaggggattcccgtgatgacaagtataagtgcgattcgtacttctgaagtacttcgattagcggaagatgcacaaagagcaggagcaagcgcagtgttgctagcccctgtctcctatcaaacactaacgaatgaagaagtatttttactctatgaacaggtaaccagttcactctccattccactttgtgtatatgataatccgagtacctcgcatttccattttagtgatgagttgcacggtcggattgctgagctacctaacgttcgttctatcaagattcctggagtaccttctgatcctgaagcagccaaggcacgcattagaaaactacgcacgaccattcctccccatgtaactataggagtaagtggagattcatttgcagtcactggcttgaatgcaggctgtgaagcatggtactcggttctcggtggtttgtttccaaaggcgtgcctaaaaatgacccgtttggcccaggacggttttgctgatgaagcggaacgactctcggcgctacttgaacctatttggacgttatttcatcaatatggtagccttcgtgttgtttcagcagcagcagaaataagtggcttgatctcaagtcccagtcttcctttgcccttacaaccattgaatcaatcagctagagaacacttggaattcatactaaaggatcttcagtctacagaaacattctgttgcccattcggctaatagcttttcgaagagaagactactaagcacgtttgctgtaaaatttttcgttatgagtgttggagaaacaacagatgtgagcttcaatcatagcatttttttcgggactaacgcctgtgcttgttgtcctgctagctactttgctttgggaagagacacttacttttagtgcagctagtcgaattctgcatcattatccttctcgcttatcgtcgttaaatacaagcgagatctgcaagtaggacattaccgaggctagcaatgcagcgtgctggctatcttgtttcatagcttcacagacctttcctcgaaacaagctttactttacggagtatctattttgcctatgtcgtcaagagatattcggtttaattctagcattgattggaattatcgtaattaaaatgatgttttaatcaaacttatgtttaaactgcatatgaattcaaccagcaattgctaaataaagaagacccgcgtttattgaaacacgggtcttcttttgttaagttcattgagcttattcaaagtggtatcttttaaataatcaaaacaattcgtaacataaaatggagctaatccatcttataatcttcccttaatatataatgtgcataatcaacctaaacttgacgaattttataatacttaaattttcaaatggaattatttttgctgttttttcaatgcaggcaagggcagtcggacaagccgccgccctctgcacacgcaaagtgaaatcattgcatcttagaaaacagatttagaaaacaaagtcgatggaatccggcgagaagccttccggttgctcgtccgagttcacctgaatatcgcttaatagcaaatctggattgatcccaacctgggacaggatcgctatcaaatctctggttaatctctcaatagcgtcagctccaaacagcttcgtgcaatattcaaacgaacccttgatttccccgtcttcatcactcatagacaaagtcaaatcgaatttggaaatacgatgctcctgaacatacggactgaaggacagcatttcaagcttcgcttcctgtgactccatattttccagtacaaacatagtgtcgaataatgggttacggcttgcatcccgtgctacatccagcttttccaccaactcttccagtggataatcctgatgctcgaaggcttgcagcgtacgatctctggcttctagcaagtagctgtggaacgtttggttgcccttcggctgatgccggatggctagcgtgttgacgaacattccgatcagtggctccagttcaggcaacaagcggcctgctaccggcgtaccgatgatcaaatcgtcctgaccgctgtatttggacagcagaacggtgtaggcgcttaatagcaccatgtacagcgtgcttccggtctgtgccgcaattcggtgcagttgctcggatacattcgcgtccactgtaaattcatacatcgcaccctcgaagctgcgaacagcaggtctaggataagcaattggcaaatccagtaccggcaattctccggctaaatgctccagccagaagtgttcccggcgttggtatgattcacgctgcgtctcctgctgctgccatacggcatagtccttgtactgaatttgcagcggctttaattcctgcccttcgtacagttgtaccagctcctgcacgatattgttagacgatacaccgtctgaaataatatggtgcatgtcgtacattaggagatggcgctctggtccggtttgaataagacggacacgcagcagtggtgcctggcgaagatcaaagctgcgtacaaaggactcgatataggcttcggcttcggactccctggcctgcaggtgctctactgcaaactccacttgatcgtaaacgcgctgaacgacctcgccttccaccatttcaaaggaagtccgcagcgtttcatggcgggctattaactgacggaacgcatcctctagccgatcagcctgaagcggtccctccacagttaatacacccggcatattgtagctgagatccccaccttccagatggctcaaaatgtacagtcgtttttgagccgaggaaaccgggtagtacgcctgttgcgccgccgcagggatcaccgtataggtgtctgtcccgtgcgttgcgatgagctgggcttgctgctcaatcgtaaagtgttggaacacctcacgcagcgtaatccgactgtccagttcctgatggattttggccaccagcgtcgttgcccgcagggagtgcccacccacgtcaaagaatgagtcggtgactcctacgctggacagcttcaagacatcctgccaaatttgggctagcttggcttccagcggcgtccgcggtgcaacgtactccaggcctccttcgagacgtgcttccggtgccggcaacgccttgcggtcgattttcccgttcggtgtcagcgggaaacgatccagttgtaccacatacgtcgggatcatgtaatccggcagcttcggctgcaacgcattgcgcagctccggcaaactcagggactctgaagctatgatataggcacacaggtccttgtgcccgtcttcgttttcccatgctgtgaccacggctttctgaatgccatccacggtcagcagctgtgcttccacctcgcccagctcgatccggtaaccccggattttcacctggtggtcgatccggcccaaatactcaatgctgccgtctggcaaccaccgtgccaggtcgcccgtccggtacatccggtttgcgtgagtgctgtccgcttgatcggctgcatcagtgaacggattcgggatgaacttctctgccgtcagctccggcaagttcaggtatcctcgtccgacacctgcacctccgatataaagctcaccagcgatcccgatcggtaccagctgttgctggctgttcaggatgtacacggactggttcgctatcggcgttccgatggataccgtatgctcccctttttccagcagtgcgttcagggcttccatatcttcaatcgtataagcagtcgcatctaccgtggtttcggtcggaccgtacacgttggtaatcaccggacgatacccggaccacttgtgcaggaacacatttaccagctgcacggataatgcttcgccgccgatcaggtaatgcttcacttccggcgcttccgtcacattgacgctttcgttcaaaatatgcagatgcgcaggtgtgccgtccgtcagatcaatccggtgcgtgcggtagtaggcgatcaaatgctctccgctcagactgacgtcacgggacaccacgtgcagggtgtggcctaacagcaagctggcaaagatttgcttcactgaagcgtcaaatacaaatgccgacagccatgcgacatgaagcggctgttcataacggctgtatactcgctccaataaagcatctaccagattgctaacactgccctgctcaatcatgacccctttcggctggccggtggtacctgacgtgtaaatcatataggccaggttatgcgggcgggcgacagggattagattgctcgcatcctgtgttcccagttgagcttgaacgtcctcatcattcaagactacagctcgaactgtgctgagcgacaggttggcaactctgcttgtaatcacgaccttggccccactgtcttggagcatgtagtcgatgcgctcctgtggatacatcgtatccatcggcacatacgcgcctccggccttaagtacccccagaatgctcaccagaatatccgcagaacgttccaacaatacgccaaccggttgatctgcttcgaccccttccgctcgtaacacacgagccaattggttcgcacgctcattcagctcagtgtaggtcagcgcggtggccccagacacaactgctatccgctcagggttgcgcttcgcttgctcttcaaagcgttcgctgagcgaacggccttgcacctgtctgtgttcagcacaacgcacactatgtgcattcgggtcattaaatacctccagaatctgcacggtttcttccgccgtaatcagttccaactcacccagcttcgcatccgggttcgccgccaccgcttcggccaaacgaataaagtggcgtgtcatccgttccacggtttcccgttgatacaacgcggttgcatactgcaatccgaactggatgcctgcctcttcctcactggcctccatcatcaaatcaaacttgactggcgtttgttctaagccgtatggacggaagctcaggtccgccagctgcagcttgccttcctcagtcgtttgcagggtaaacatcgtatcgaacagtggatggcgactcatatcccgtttcacgttcagcttttccaccagctcctcaaacggatagtcctggtgctcgtaagcttgcagggcacgcgtcttgacatcctccacgtagcttcggaagctttgctctgccgtcggatagttccgtaatgccaacgttccgacgaacatcccgatcattggctccagatccgcatgcggtcgtccggcaattggcgtgccaactacgatgtcctcttgcccgctgtattgatgcaagagcgcggtgtacgctgccagcagcaccatatacagcgtggagcctgtgtgcgccgccagttctttcagccgttcgctgacttcacgttccagtccaaacaccaccgtatcacctgcggtacttcgcaccgccggacgtgcaaagtccgtcggtacatccagcactggcagctcatcccggaaggtttcgagccagtacgcttcctgacgttgcatccattcctgatgggcttcgctttgctgccataccgcataatccttgtactgaattcgcaatggcgatagctctttaccatcatacaagcggacaaattcatcggtcagtacccccatggacacaccatccgaaacgatatggtgcatatcgagcatgagtaaatgctgcggttcctgctcggttccttgtacgcccaaatctaccaagcctacccgcagcagcggagcggcttgcagatcgaacggacgtacaaactgccgcacccgttcttgtgcttcctggctgaccatcgtatccgtagtcgcatcttctgcctgtacctttgtatattccacctcaaacggcacggtgtcctcaatccattgcattggctcactgtccaccagtgcaaagcgggtacgcaaggtcgcatgacgggcgattaattgacggaacgcgtcttctacccgtttcacatccagcggtccgctcacttgcagcaccgacggcatgttgtagttcacatcattcgggtcgaactgatgtagcacatacagtcgtttttgcgccgaagataacgggtagaagctgcgctcttccgttaccggaatggacgcatatgttacttgatccagctgttccagtacgactgccaattgttcaattgttggtgattcaaaaatactgcgtagtggaagcggcttgttcagctccttgtgaattttcgaggccagcgtcgtcgcccgcagcgagtgtccgccaatctcgaagaagttttccttcacaccgacctgcgccagacccagcacatcctgccaaatttgcgccagcttcacttccacccatgtccgcggcgcgacataatccgctccgctttgcaggctgtcttccggtgctggcagtgctttgcggtcgattttcccattccgagtcaacggcatctgctccagctgtaccagataggaagggaccatgtaacccggcagcttctggctcaaagcgctgcgcagttcacttgccacaacttccccatcggcgaccacataagcgcagagctgcttctgcccttgctcatcttcacgcgcgatgaccacagcttcttgcaccgcttccagcttcaacagttgcgtttctacctcgcccagttcgatccggtagccccgaattttcacctgtgcgtcgatccgtcccttatattccagcgtcccgtccacattcaagcgtaccaggtcgcctgtgcgatagcagcgttctccgctgcggaacgggctgtcgatgaacttttcggacgtcaggtccggacggttgcggtatccacgtgccaccccgtcaccgccgacgatcagctcaccccataccccgacgggctgaagccgcatcgaacggtccacgacatacgctgtcgaattatggatcggtctgccaattggcaccgattccgattgcataccagtgatcgcatgcactgtggaaaaggtcgtattttcggtcgggccatagatgttactgatccgcaaggatggatgagcctccagcgcccggttcgtatgtggtacggacatcacatcaccgccgaccagcagctcccgtaccccctcgaacagcgccagatcctgctgggacagctggttaaagagcggtgtggtcagaaacatcgtggtaatgccgtggctacgcacagcctccttaagcttgggggcgtccaaaatgacatcctggctgactagcaccagctgtccaccattcaatagcgccccccaaatttcgaaagtggatgcgtcgaaaacaacagcccctgtctgtaaaatgcgcgtgtcggcatctaattgcgcgtagtttgtatttttcaccaaacgtacgacattacgatgctccaccataacgcccttcggctgccccgtcgtacccgacgtataaatgacatacgccagatctttcggaccagacaacgattccagattggaactatcctcgtgatacacgccctgtgccccattcagcaccagcacgttaccgtcgaaagccactttatccaccagatggctttgcgttaacaatagctctgcccccgagtcgtccagcatgtagcggatacgctcctctggatacgtcggatcgatggggacatatgcacccccggctttcaaaatgcctaagatccccacgatcaagtctaccgaacgttcggtcatcagacccaccagtcgatccttcgtcacgcgttgactacgcaaggtgcgcgccagacgattcgcacgttcattcagctcgcgataggtcagctgctctccttcgaagaacaacgctggctgttccggtgtctgcgccgtttgtgtctcgaacaagccatggatcgtttgcccgcttggatactcggcagctgtatctccccatacgcggagaatttgcttacgctcctgctcacttaccatatccagctcatgcactcgaatgtccggcttcgccaccacctgctccaacagctgtatcagatggccctgagtccgttcaacggcttcccgatcatataacttcgcattgtattcaaatcggattttcatcgcttcctgcggcatgacaatcagattgaaatcatagttggtttgttcaatcatgccggcattgcgaatttcaaaatccgactctgcaccttcgccaagttgctcgacctgctcctccaccggatagttttcaaacacgataatgtggttgatcagatcttgcttttgctcgctcaaggcttgaatttcatacagcggatacgtttcataatcttgagaagtcagcgcctgctgctgattcgttctgatcatgtcggcaaaggtgtcctcagccccactacggatacgtattggaatggtgttaatgaacaagcccaccatattttcgatccccgaaatatccgctggacgaccagacactacaccgccaaaaacagcgtcgtcactaccgttgtacttttggagcagcaatccccaggctgtttgcagcaatgtattcggggtcacatggtgctgcttagccaccatttccatacgtccggtcaaatccttgcccagatcgcacaggatatgctcaaattgtgcaccgtccgctttcacgcctacttttccggtcggaatcgaagtttgctgatcatagccgagcaaataatccttccagtaggaagctgctgcttctacatcctgtgcttcaagccactcaatatactgactgtatggagtcacgggggcaagcttcggctgtctatgctccacggctgcaaaataagcctcaaacacctcatccgtgactaacgccacacaccagccatccatcaagatgtgatgagagctccacacaaaataataatcctcgtcgcctgttcgtaaaatcgccacgcgcatcaacgcatcccgggacaaatcgaacccggctgccttgtctttgcgaataaattccttcacatacgcgtcacgctcctgctcattcagatgacgcaaatcttcgcatctgaaaccaacatccttgcggcggaaaataacctgcacaggctcatcctgccaaccgctgatgaaattggctctaaatatctcatgccgctgcgccaaatgattcaagctatcttggaaaatatctgcttggaagcgtccgtgcaaatcaaaggtcgtttgttcaaaataagcacctgacgctgcatccatcagactatggaacaacatgcctttttgcatcggcgtcaacgcatagacattttccagttcccccatgtcacgagtccgttctaccaactgatccagctcggccatggttacatgtttcagcatgacatcgcttggcgtcagctcttgctgtttgcggcctgtgcaatgcgcaatgatttcctgcaagctggttctgaactgttcggctaactgctccatcgtttcacgacgatattcctgcttgctgtagctgatcgtcaattgcagttcgccttccgaaatcagtccgttcatatccagcgtgtgcgatctgactgcatgggcactaagctctgcaccgctagcgtaaggagatacgccaatggattgattttgcatatcttggtcaaattgtcccaaatagttaaagctgatttc

SEQ ID NO: 24 - DNA, 317687 bp, Unknown
  Kingdom: Bacteria, Phylum: Firmicutes, Class: Bacilli, Order: Bacillales, Family: Paenibacillaceae, Genus: Paenibacillus
ttattccatacgtttgagacgctggtactaccccgtttgatatgtgaagcaatacataaattacagtgttatatcaatgagggcttcaatatgaaataaggtgtgaaagtagtaaatattggtgggagttcaattacaaatacatgaatagttataatttttcactttgtacgttagttgtatacttgacgttagtaaaattatataataaaattcaattgatcgattgaataattgacgtattaatcgagcgatacataatttaattggaggtttgatttctatggcaaaggcataacttcaaattacattgaaaattaatgcaccagaacgtgaggcggctgtaaggttttatacaacttataaaagagcagtcccttagtgagaaatttgtcaaatctcatagagtaataaatcttaaccttaacgaagttttggacttacaatacctaaaaggggatgttaatatggcagaaaaaacaattaacatgaatacggtttggtacaaagatgcaaagggtgatggacgcattaaaagtgacaatctacaaactcaaattgcaattccagtccccaaagggggaagtggtaaaggggctgacccacaacaacttcttatctcttctgcagtagcttgttacacgatgaccttagcatatatgttagataaaaataaacttcctgtgacaggattctttatggatacagaaggtaatataactcatggtgatctattaagtattatccatcgcccgcatgttgttctgaatccaggagcgaccaatgaagacataagcatgacagaagctttgatgcaaaaagcagaagaaaattgccatattggtcaattactgataaaggtcggcattcccgtaggaactcaaggaaaagtaactatcgattctggagaggatcttacaagtagctatattgcagcacacggattggaatagtaaagctgaatgtcaatgagtattattcgctctaatcaagtcgtataatgtccaggtttgcattattcacaaaaagacttcaaagtcacaaatatgtgggcttcgaagtcttttttagatgaggcttagattggttaatgtatatgaaaatgttcctgccactcattcactccgtcttccatacgatacgctttgaatcccttaacttgcaatttttgcgtagcaagtgccgaataaacgcataatggccctctacaataagcgaccacttcagcttcctccggtaactctcccattaatacgtctagatcttccatcggcattgaaattgctccttgaatatgtcctgtttcaaactcttctgtggggcgtaagtcaactaagataatggagttttcatctagttttttctttacttcatccatggatagggtatggatgtcattcaaattgtttaaaaagtcatctttcattctcttgatatcaggaatttgcttctcactaatcttccatagtgaagagagaaagtcagtgatctcaggatctgctagtgagtatatggcgtaagttcctttctttgtgaacttaacaagcttagcgtccagtaagacctgtagatgacgagaaacattagctatattcatttctgtacatgcggctaatttctccactgttctgggactttgtgatagtacattcaagatttcaagacgtttatcacttgatagacatttacctattctagccagttgcttatatagatcttccttgaaaagctttgcacactttagcatctcttccattcatttataacctcacttcaacttggtgatatatgttaaggatcctacactatatgttttgaccaatatggcaaatcaaaaatgcttctccatacactgaaaaaaactatgaaacccacaatctcttcataataagtactatatcaattgatgaatagaattttaacatgtgtagagacgaagtcaagtttagtccattattctgataaaaataataagataaaattgcaatactgtttgcgagcgatactctgatttaatgaggaggagagaagttggaggagataacgttattagtagtatttgcagcaggcgtactctcgttttcgtttttgtcgccttacgtattccctctccggtccgcgtatgtttcacatatatccgatacgatgattgcaggggtcgctttgtcgtgaatcgtaaaattctggtcgtacgttcattgggcttcatccttgtgatttagtgttatctttgtgatcatggggctactggctccgctataggtaattttgtctccttacgcagggatctgattgagaaggttggcggactattgattgtggtgttgggcctacaaatgatggggatactcaaactcaagtttttaatgagttctaagcagttgggaaacggaaaaaaatacggtggctggcttggttcatttatccttggattggcaattggggcgggctggacgccatgtgtggggctcgcactttcctcgatacttgttttggcagggtcgtccgaatcattgtaccaagggatagggcagttagcggtatattcgttgggtcttggaattccattcttgctcatttcgctgcttgttactttctctctatcgatggttaaacaagtcaatagattttttcccgtcctgagcatggcgaatggagttattatggtcatctaaattgaatgtagtacgtctcgaaataataggatctcgaataattccaataaatgagcttgcgcatatatcttaatatctgctgagcttaggatggaggaagtatagtatgatgacagtgattcgtcatttcaattggactgtttagtttatggttaataatacaatcgtggcctctacgatcccttactaatgtgagttttgaagattgggacctatctcatcaccgcttgcaaatgtgaagattctagatgtcagggatgtcagtaaatattcgactggacatattccgagttcattaaatatttcctttggcagactcccgttagtatggagcaagaatcttgcaccaaatgataaagtgatcatattttccagcagcttggttcaaaggaaaaactgctcgaattttggcgtgtggtgggtttcgtcaccgtatgccgttaaagggtattatctttcaatgactagtagggtgagctggaattatcaccataaagaaggttattgtaaataaagggtgatgggagtcaagttaacgaaagaacgaaactggtagttggagaaacttatatagggtgaggattgtcaaggcggctgaccggggcacgcacgttccatgccgatccgacttacggacggcaatgaggcgtccattatgtgaggtggcgaaaatgccaggtgcctgtcagtttgcggacttcggcgatcaatttaaccaacatgccgatcccatacgttctgcaaatcgtaggcaaagggaaaggacaaacgatactcgagattttatacgttgttaacctttctagtcggtttcattactcacgaattcgtagctgaggctaaaagcatataaaaaaatttaatacctgctcttgcatcccataaacaactactggggaaaattggtcgtctactggtttaggttatgatcttaaattgcggtttatatagtaaccatcttaatagggtatgtagcctttcttgtaatagtttacttgtggtattatataatataaatagtttacttatgggagtatataatatatttgctcttatcataaacaattggaattttgaaagatattctttaaaatgctattttatttgaacatccaaatagaaaggtatttgattatgatattcattaacaaaaaaactattaataagctaactgaatcgcatagagaacctaacatgcttatctgctattcaactcctcaaagcctttcggcttggacaagtcgagctatattactcctaaataatgataaaattattatccttttcctgaatctattttccactaaagtagtacaaaaagttgaatttgaagtagctgatttacaagaacaaaaatatcattccgtatatctgtcttctgcaatatggtcatttaacagtaaaggacagcactggaggttcaagataatcaaaaaaattatacctcttggctctatgcaaagggattttctgaatttcttgcaacaaaatattttaaattagcgactgagtagatcaccgatctccgaaaacatgtgcccttccagacgaaggcgaacagccaggtatctttcgtaaagtcgtttatctggggtttctttcatggtttttttcattacccaataggcgaatgaagtaatgttgttagttggttaactgcgtgttattatatcaaatgaatttgacaggttcccaaatctttgttagagtttcaatcaaatacgtataaccttttcatgggatgttaccgatagggcataacctgaattggcttgtttacactgtaagtgtatacaggctggtttgggtttttttattgtctatcacccttcgctaccccttttatcacacatttggaaggagaatgtttatgtccagttatatttttcctaaagactttttatggggaggtgctcttgctgccaatcaggccgagggtgcttatttggaagacggtaaaggattgagtctggtggatctgctgcctaccggagagaagagaagaagcataatgaaaggaaatgttccctcgctgactccacttgaaagcgaattctatccttcccacgaagccattgatttctatcatcactatcgcgaggatattgcgctatttgcagaaatgggcttcaaggcgctgcgtgtttccattgcctgggctcgtatttttccaacgggagaagacgctactcctaatgaagcaggtttgcaattctacgatgatttgttcgacgagttgcataaacatggcattcagccagtcgttaccctcgctcattttgacgtgccggtagatctggtcgagaaatatggaagctggcggagccggaagctggtaggcctgtttgaaacctatgccaaaacagtattcacccgctataaggataaagtgaaatactggatgacattcaacgagattaacatgctgctccatttgccgtttctcggtgccgggcttgtttttcaagaaggtgaaaacgttaaacaaattcagtaccaggctgcacatcatcagcttgtcgcaagtgcgctggctgttaaagcgtgtcacgagataatcccggatgcccggattggctgtatgcttgctgccggcagcttctatccgtatacatgtaatcccgaagatgtatatcagggcatggaaaaagaccgcgagtcctacttctttattgatgtacagtcacgcggcgaatatcctggttatgcgaagcgcttcttcaaggatcatggattaaacattgagatggaatcaggcgacgcagccattctgaaagatcataccgttgactatatcggattcagctattattcgagccggacgaccagcacagatccggaaatcgtcaagaacatgaccagtggtaatgtatttggctccgtagccaatccatatctggacaagtccgaatggggctggacgatcgatcccaaaggtttccgcatcacagccaaccaattgcatgaccgttaccaaaagccactgttcgtagtggaaaacggttttggtgccaatgatgtggtttcgcctgaaggagaagttaacgacgattaccggatcgactatctcaagcggcatattgccgaaatgggtgaggcgcttcaagacggagtcgaaattatcggttacacaagttggggacctattgacattgtcagcgcttcctcaggagagatgaaaaagcgctatggttatatttatgtggaccgtgacaacgaaggcaacggttcgttgaaacgtattaaaaagaaaagcttccactggtacaaaaacgtaattcattccgacggcgaaaatctgggcgaataatcgtaccacaagtaaataggatcggacgtcccgggcccacggggatttccgatctccgtttcttcattgaaagcgttgacaatcgttcctcttcgggctatacttgacgcaattccatcatttttaggattgttactgcgtagcaggcaaaacctaagccacgaataagcggatgttacagtcttgtttatttggcgtgcttcggtttttttctgtttacaataaagaggatggagtatgtgtggctcttgctggcatatggaacgggggatcgagatgaacatagcaaaggtcattaacaacaatgtaatcagcgtctaccagacggacggcaccgaactcgtggtgatgggtcgggggattgcttttaagaaaaagcctggagacaaagtagacgaaaccagaattcagaaggtatttgctctgaaaaacaagcagacgtccgataactttaaaatgctgttgcgtgaggtaccgcttgatttgattgtgattgtggaggaagtcattaatgacgccaagcataatctgaatagaaagctgaacgaaaatatttatgtttcactgaccgatcatatcaatttcgctgttgaaagataccgggaaggattggaaatcaaaaacgcgttattgtgggaagtcaagcaactgtacaaagaagaattcgcgatgggtctgaaaacgttggaacaaattaaacaaaggctcggtattgaactgcctgtggacgaagcggcttatattgcgattcacatcgtgaatgctgaaatgaacgaggaagtcattacgaccatgagtatcacaaagtttatccagcaaattatcaatatcgcaaaatatcattttaaggtggagttcgacgaggactctctgagctatttccgttttattacgcatctgaaatttttcgcccagcgcgtatttaagggaaatcactacgaaaataactatgatcatttgtatgacatgattaaggaaaagcataaggaagcggctgcttgtacagagaaaatcggaacttttgtgcaaaaagaatacaaccacgaattgacgaacgaagaaaaattgtatctgaccgtgcatattgaacgggtggtgaacagataagtcgaacgtttttaacgaaaaaggaccaagaatagacgattaaaagtttttgttgacaaatatggtagaatgattatattatgagagtaacaggaatttaataagttttaactgggattgttactggttatgcaggcaaaacctaagtcatgaaaaatcgcgggactcaagtgcccaccatttttcaaggcttaggttttttgtgtgcctaaatatgtaaaaagccccttagaacatggaggtgtccatcatgagttatgaaaaactggctaaggaaattgtacacctggtaggtggcgaaaaaaatgtagtatcgctcgttcactgcgccacacgcctacgttttgtgctaaaagatgaggcaaaagcagacaagggaaagttggaaaaaaccgacggaattattactgtcaagcagagcggtggtcagttccaggttgtagtcggcaacaaagtaccagaggtatataatgcaatcggccatgtatccaatatcttgaatgaaactggaaaagaggatcattcagctaaaggcaacaaaggatttggtgccgtaatcgacgtaatttccagcatttttgcacctttgctcggagttatggcggggtccggtattttgaaaggtctgctgctgattgcgagtaaccttggctggttgctaccgaaagacactacctatatgattttgtatgctgcggccgacagcttgttttatttcctccctctcttgttagcggttacaacggcacggaaatttggaggtaatatcttcgttgccctgaccattgccggagggttgctttacccgaccattgtcacgctaaaaacggaaggtacacctacggactttttcggtattcctattgttatgatgagttattcatctaccgttattccgatcattttagccgtcatcgtcatgagtaagctggaaaaatggtgcaatcgagtgatccacgagagcgtcaaaaactttattacacctttgattctacttgtaattatgcttcctctaaccctgatcgtgtttggtccagtcggggtgtatgtgggcaacgcgatcgctactgcactcgttgctgcatttagctttagtccattgctagctggagcaatccttggtgcttgctggcagttgctcgttattttcggtgttcactggggtcttgtacctgtattcattaataatattgctgttaatggcagagacggaatcaagccttccgctgcggcttccatctttgctcaaaccggcgctgcgttcggtgttatgctgaaaaccaaaaataagaagctgaaaactttggcgggttccgctacacttaccgctttattcggcatcacggagccagccgtctatggggttacgctgccgttgaaacgtccgtttattgcaggtattatcggcggcgccgttggtggtgccattatcggtcaagcgggaacgcaagcatttgcctccggcgcacctggattgctgaccttgccgatcttttacggccctggtggacaaggattcccgggattgattttagggattaccgtttcattcctggtgtcagccatcttgacttatattttaggttttgaagatccagttgaagaagaggaaactactaacaattcggctaaagaatcgacctctacagttgttgtttctaatgaagaggtactcagcccaattgaaggaactgtggtcgctttgtcggaggttcccgatcctgcatttgcttcggaagctatgggcaaagggatcgccatccaaccgacaacgggcagagtcgtggccccgttcgatggaaccatcaccgtggcgttcaagaaaaaacatgcgcttgcagttgtttcgcatcatggcgcagaagttctgattcacgtcggagtagatacggtcaagctggacggtaaacattttacgtcccatatcaaagaaggcgatcaggtgaaagctggggacctactgcttgagtttgatgttgagcaaatcagggcagagggttatcctacgattacgccagttatcattacgaattcttccgaatatactgaagtccttccaatcgctcaaggagaggtaacggagcaggccccactgttgaaactgtctagtgctctgaatgagaaagaaagcattgcctaaatgtcttaaggacaaggctctgatgatccatattcccggatcatcagagcttttttgtcgtcattttatgtagctggtaagcctacttgtaattgacaatatgtcaattaaattaacttgtatgggggtaaaaactaatctataattttttgtaattatgcaaattttctgaaaacatagactagaaaatcaatggattgatcagggggaaatacaaggaatgttagagcagtgggcagaggcagtaaacggcgtcatttggagcaatcctgtggtatatgtctgtttgggtgtgggactgttattttcgatcatgactcgattcctacaaatcaggcatttcaaagagatgatccgcctagtatttaaagggaaaagttccgaggcaggtgtatcctcctttcaggcctttacgatggcactatcggggcgtgtagggacggggaatattgctgggattgctttggcggttggtatgggtggacctggggcgatattttggatgtgggtcatggcctttatcgggtcggctacagcttttgtagaatccacactggctcaggtgtataaggtaaagcgcgatggtcagtaccggggcggtccagccttttatattgaaaaaggggcaggcttaaaatggtttgccgtcatttttgcggttactgcgttggtcgcaatgtgtttactgatgccgggaactcaatcgaactccattgctgtagcttttcacagttcgtttggcatggaaatgaaggtttcggggattttagtagtcgtgttgctggcgcttatcatttttggtggtgtaaaaaggattgccaatgtggctcaggttgtcattccgtttatggcactcggttacatcctcgtttctttctacattatgatgacgaacattactgcacttcccgatgtattttcgctgatctttcgtagtgcctttggcgtggattctgtgttcggcggtatggcagggacggcgattgcttggggtgtaaagcgggggatttattccaacgaagccggacaaggctctggtgcgcatccggcagccgccgcagaagtgtcccatccagcaaaacaggggctagttcaggcgttttccgtgtatgtggatacctttttagtctgtacgtctacggcttttatggtcctgtttactggtatgtataatgtgaagggacctggtggcgattttattgtgcaacatcttccgggtgttgaagagggaacccaatatacacaggctgctattgaatcggtatttcccggttttggatcgagtctgctgtccattaccttgttctttttcgcatttacgaccattatctcttattattacatcgcagaaacaaatatggcctatctggttgcagattataaagcaaagtggcccatgttcgtcttaaagctggttattctgggttcgacgttctatggaacggtcgtcaaggaatcggctctggcgtggacactgggggatatgggtgtcggcattatgctttgggtgaatctgattgctatgattctgttggccaagcctgctcttcttgtgcttaaggattacgaacagcaacggaggcaagggctggacccggtgttcgacccggagaaagcaggtatttcaaataccgagtactggtcaaaggaatatcagcctccttcagatgagttgacgatcaccgccaaaccgagcaagcttcaagcctaaataataagatagataagtaagatcaaaggtggctccgcggggagtcatcttttttcgttatcttgcctttacattccaagaagggtacatatgttcactatttagtctataatttagacagaaggattttgaataatcctgccatggatatgtggggaggccacatttgcattagagaggtgatttgaatgagtacatccgatttatccataactgacgacgagtggagagctattgtagaaaacgacaagtcatatgatggggtatttttgtacgctgtgaagacaacgggaatattttgtcgcccctcctgcaaatcccgacctcccaaaagagagaacatccgtatatttaaaacagtagagcaggcattggtcgagcatttccgtccatgcaaaagatgtaaaccgacaggacaacgattgcctgatcatgaatggatcgcactggttacagaatacgtgaattctaactatatgaaggacttaacattgcacatcctggctgagataagtcatggaagtccgtatcatttacatcgtaccttcaagcggatcatgcatataactccaatggaatatatacagcagaccaggcttgaacaagcgaagacgctgctcatttgctcagatatatctgttgcggaagtgggggagaacgtaggtctgtgcaatgcaccttactttattacgttatttaaaaagaatacaggctacaccccattgcaatatcgccaactcaaattgaaagcaacacaaaatggaggtacacagcatggcacagcaaatacataaaacgatctattggtcattgttgacacatgaggattggaatttatatattgcagctacatcggaaggactatgttatgtaggttcgtccaatcaacctgtagaggaattgttttcatgggcgggaagacgatttcccggcagtcctttagttgaagaggatgctgctttacagccctatgccaaggagttgattgaatatctccaagggaagcgcgcccaatttacattgccctttgattttcatgggactgcgttccagatggcggtttggaatgcgttgtgtgatattccgtatggggaaacactatcctattcagacattgccaacgctattcaaaagccagcctctgttcgtgcggtgggggctgccatcggtgctaatccgattttggtcacggtcccttgtcatcgggtcatcggtaaaaatggagctatgaccggatatcgtggtggtttggacatgaaggtgaagcttttgcagctcgaaaaggaaagtgtggcatcggttcagtatgaaaaatgagtattacaaatcccccaagactcttttgaataaagggaccggcttcttgtcaggatatacacattcgttgaacccgtatacaggttgtacctttggttgctcgtattgctatgtacgccaattgccagtctccacatttcggaaggaagcgtgggggacatgggttgatattaaaaatcaggctgcagatattctttgcaaggagcttcgtagagccaaatccaaaggtaaagtcacgattttcatgtcgtcaagcacagatccttatcagcctgccgagtacaaggaagaggtgacccggtctctgctgaaggtgatggtggaggatcccccggattttctctttttacagacgcgcagtccactggtacggcgggatactgatttactgctccgattgggggatcgtgttcgtgtgagcatgactgtagaaacagaccgagaagatatacgcaaacattttaccccggaggctcctcccatccaggctcgtctccaaacgctacatctcttaaaagaggcaggtgtaccgacgcaagctacgattgctccgatgcttccaagcagtgaacattttgcagacaagcttttgcctctggtcaaccgtgtctgtattgatgattattttatgggagatggcagtggggggagacgaacgcgtagcttgaaaatgggtgtgctgtacgagtcattggggctggaagaatggtatcatcctgctgcctataaggcggtttatgagcgttttctccatgtttttccgaaggaacagctctacgtgagcaaagaaggtttcgaaccttgatgtaaaagcagtccatgccattgaatcaagagtgaaccatataagggggcaacgggagaacgaatgcaaaccgtaatgaccaaaaactttgactatggggaaaaggaaatcaattatctaaaaaacgtagacaccgtacttggtgcagcgatgacgcaaatgggcaaggtagaacgtgtgatcattcccgatctgtttgcggcgctcgttcatgcgattgtgggacagcttatatcggccaaggtggttcagaccatatgggcaaggatgcaggagaagttaggcgtgatcactccacaaaatatagctgttcagtcggctttagatattcaaagctgtggcatcaccatgaaaaaggccacatgtattcttaatatagcccaaacgatcgagcagggcctgttggatttacaggaattatatgagctttccgatgcacaggtgattcagaaattgtcctcgctgcaaggaataggaccttggacggctgaaatgatgctgattaattgtatggagcgtccggatgtcgtcagttggggcgatatggctattcgacggggaatgatgaagttgtaccatttagataccttgaccaagcagcaatttgaggagtaccgccgagtctattcgccttatggttcggtggcctccatttatttgtggagtatttcatttcgttaagaatcagggagtggaaatgatggagaaaacaattagagaacagatactgtcatatgtggatgcggattttcagaaatttacggctgcattgcttccgacgattaataatgtgctgggtgtacgtctgccagtgctgcgtaagcttgctcaagatattgccaaaggggattggcgcctctacctggagaccgctgaaagtgaacacttcgaagaagtaatgctgcaaggtatggtgattggttctgtaaaaacggatatagaggaagttttgagttataccgccaagtttgttcctaaaattgataattggtccgtatgtgatagtttctgtgccggattgaaaatcacgaaacatcataaagaacgggtgtgggagtttattcagccctatctattctccaagaaagaatatgaaattcggtttggtgtagttatgcttcttaatttttatattgaggaacagtatatgaagcgggtgtttactttactggatcagacccatcgcgaggattattatgtacaaatggcggtagcatgggcgatatcgatctgttatatcaagctacctgaggtaaccatggcgtatttaaatcataatacattagatgattttaccttcaacaaagcactgcaaaaaatcacggaatcatatcgggtggatcaggccacaaaaacgaccatccgcagtatgaagcgaaaaagaaaataggatcgggctcagcagccaggtacgcactttgctttttttggaatctaataataaaatggaagtaactttcgaaaaggagatgacgtgaattggcagagcaagtgcgtcttggtaaaacagatttatatgtaaaaccaatcggtttgggtgcaaataaagtgggaggacataatctcttttccgatttgaatgatgaaacgggcaaagaagttgttcgcacagctttggataacggcatcaattttctggatacggcttttatttatggacctgagcactcggaacggttgattggtgaggtattgaaagagcgtggtcagcgtgataaagctgttattgccacgaagggtgcccacaaattcgtaaacggagaggtcgtttttgacaactcgcctgcttttttgcgtgaatccgtcgaatccagtctgaaaagattgcagaccgattatattgatctgttttatatccatttcccggacgaaactacaccaaaggcagaggcagtcggagaactgaagaagctcaaggacgaaggcaaaatcaaggccattggtgtatctaacttctccattgaacaacttaaggatgcgaatagtgacggttatgtagatgtgcttcaatcccaatataatttgtttcaacgggaagctgagaaggatctgctgccttataccaaggaaaatggcatttcgtttgtgccttatttcccgttagcttcgggattgctgggggggaagtatacgaaagacatgaccttctcggacatcagagcgaaaaatccattgtttcagggcgatgcatttgctcgtaatttggacaaagtggagcaggtacgggagattgccaatgcgttgaatgcagaggttgctcatgttgtactcgcatggtatttgacccgtgattcgattgatgccctcattccaggggcgaaggggccggagcaggtgctggcgaatctgaagacgctaaatgtccaattgagtcaggctgatatcgaaaagattgaccatattttcaaataatgagtgcaccttatatttgcaattatatatttgttccatttagagaagctgccggacgggcggcttctttttcgtgtacaactcgcatatccttgtagggtaagttcaacgctgcgggggggtcggatgatgagaagaccgcaatggcacagcgcacctaacagaaggcgacgcggcagacgtaggtttttttttattgtggcactggcgctgctggtagggatcatacaaatggctgcttatgtggagcagcatttgaagccgcccatgatgcacctggcaaaagtgcgggttaaacaaatggcgacggaggctattaattcagcaattacagcacaggtagagcaggggaagacagctgataatttgatcgaatggagaacggatgcacaagggagaacctccggttttgttctgaattatgcggaacatatgagaattacgtcagacacgctcaaagcagtcaaggcaacgatggacagcatgagccattttgatgagagcgttccgattggtcaggcattgggcagtccactgttggcagcttatggaccaacggtccccctaaaggtggagccgcatggagcaatcaaggtggatttaaatacccgtcaacaggatgcgggcataaacatgatcttggtggaagtgtacattcggattacgacggaagtgtccgtggttataccgtttgagatgcaacctcagattgtggagacggaaattccggtttcttatttattagtggtaggcaacgttccgatgtactactatgacaatcagggtaaaccagtgggtaaaaatggtgcagccgccccgcagttggcgttgcctccccattctatagagagtagcggcgctatagatcccagcacagtaagtgttccagaggcacaggaaaaccaaaacacctctagccagtccccaacgccatagagcggaggggaatgacgtgagctgcctaggaaaaacaaaagggcccctatgaggagggcccttttgtttttcctgttttgagcgctttgcgttcggactgctcccactgtcttaataacggatacgggtcaaaggaccaatctgcccaaccattgtcccgatatataccatagtgcagatgcggtggaaacttgccttgggtaccgggttttccatagcccgagcttccgacccagccaaccgtctggccgggtgtaacgatgtcaccgttgtggacggttttgtcaaagccggaaagatgcgcatagtagtgatagcggttgttgagatctcggattccgattcgccatccgccgaagggattccagcccttcatttcaactacaccgtagcaggtactgcgaactggaactccatagccagcaaacagatcagttccttcatgtatccggaagccgccccagctgcgacggcttccccatgtgctacggtagctataaatgctgcctaaaggaagggggaaagcttgactgaccagatccagcttgccatacgtccgatacagcttagcaaactgctgaactctttgaactgcgcggctgttatggtaatattcccaaacggcaataccaaattcatcctcgttgtttccataatttccgagataagaagcgatgctaaacagcaaatccttgtcattattgcggtcagcgattccatcacccgaaccgtcttgtcccagcccggaaaatagttcaatggaacgcggattttgatcctccgaatcagggttcatcaggccggaccagactggtcccgtgatgaaaatacctatgattcgttccgcatgcttccgatccttgggatgggccaccgtaagtgtgcgttcatactggtcgatggcggccagcctgtaccaaggaactccagtcagggcttcgatggaatgatataaagccagcctggacgtatacaacgaagactgagcatgtgaagcatctacatttgcggtcaggctgctttcggcggacgaggactgtaagtgattggcaaaggcatgggcaggaagcggacaggccgttgtcagtgtagtagcacataacagcagcgataacaaacgaacagctcgggctgtccgtgtagggtaaggcacgtgaaccgacctcctatagaagggcttgatcgcccgataaattctaggcccgtatacaatagcgtgaatagggcgcttttgtttagattgagccatatccgccgcttttatccatgtaaagagtttactttttccggcatcaatgtcatatcaaaaagggaacaatgaatggaggtttttccatggctttcatgttataatgtatggcaatgacagcttaagcttatcagaaagaaggtctatgccattgtctagaaaagtaaaggaagctaagcccgactggattcgtattaaacttacgacaggcgataactatcaggaaatcaagagcatgatgcgttccaagacattacataccgtatgtgaggaggcacgatgccctaatatatatgaatgctgggccaataggacagctacatttatgattttgggtgatatttgtacgcgtgcgtgtcgtttttgcgcagtaaatacgggaatgcctacggaactggacttgcaggagcctgaacgcgtcgcggaagcggctgaaaacatgaatttgaagcactgtgtcgttaccagtgtggctcgcgacgatttgaaagatgggggcgctactatatttgcagaaacggttcgtgcgattcgccgccgattacctctttgcagtgtagaagtattgattcccgattttatgggcgatattgaatcgctgcgaatcgtcatggatgccaaaccagatattctaaatcataatattgaaacggtggagcgtatgtccgacaaggttcgggctaaagcgaaataccgtcgctctctggagctgcttcaacatgcgaagcaattaaatccggctattccaacgaaatcaagcatcatgctaggtgtcggagaagagtgggacgagatcttacaagccatggatgatctgcgtaaagtcgattgtgacattctgacaattggtcaatatttgcagccgtccgagaaacatttatatgtgcaaaaatattatccaccggaagattttgcgaagttaaaggaagagggattacagcggggattcagccacgttgaatctggaccgttggtccgcagctcctaccaagcgcatgagcaggtgaagtcagccgctcagcataaggaagaaggcgccctttcgcaggcttgatccgggaaaggcggtcagaatagcttgtttcaaatcggtggtaaaaactatgaattgttgcaggatcacaagaacgggtggaatcccgaagcgtttcgtgatcggtatagtgaagtgctggatcgctatgattacattattggtgattggggttacaatcagctacgtctgaagggcttttatcgagatggccatcccaaagcaaataaggatacatctatagtggtactggacgattacattaatgaatactgcaattttggctgtgcctattttgtgttgcaaaaaagccgtgaagtggtcaataaaaacggcgtcaatgatgaaatcattgctccagatattcagcagttggtagatgctcaaagggaacaagcgggaacgttagaacccgaagagcagcaagaagtattgcaacatacagctggagaacaggagtggccgcaaccacagcaggattcctcagctacagaagaatcgcgagtggagcagcctcgagaatcccgagaaccacgtgaattgcaacgtcgggaaccgaaggatgcccaagaagtacgtgaacgacagccgcgtgaagctcgcgaaagtcgtccatccagagaaagacgtgaagcaaaagatggacggaatccgggtgaagggcagcaaacccgtgaaccacgtagacagcgcaatcagcagggaagtttcgataaaaaagaatcgcgtggatcacgctatgagcgtcaatcaaaggaaaatcgggagggacggcaagttcgtgtctctcgtgaacctgagggccagcgtcagacccagccagctgctaaagccgaaagagctgagggaagtaaaaagaataaaacatttacagctccacaacaaaacggttcctgaattttcaggaaccgttttgtttgtaaaaaaagagtcagagtcggctcttttataggttctaattaagaaaagcgttgcgtactcgatcccaaaatgggaaaggacggtaacgagcgaagctgatcttctgacttgcgacctgacatcgaacagagattaagtcatcgacaggaaagttcaggtgatctactgtcaataaaagacgctgatctttccgtgaaaaaatatcacaatgatggtgtttgggcagtagcaatggcgatcctagtgtccgatacacgcggttattaatggaagcgatctcagtcaattgcaacgcttcaatggtggggtgaaccatagctccgccaagtgctttattataggcggtcgttcctgagggggtagaaacacatataccgtcaccgcgaaacatttcaaaggtaatatcgttaatatctacttgggcaacgacagtgccatccaccccttttaacgtaaactcattcaaggcaataaaagaagcattgcctgacttcttgtgaatttccaactcaatcagtggatacttaacgattctcgggttaagcggtccctcagatccgctttgactcatcaggtggattagctcctccagctcgtccgcccgccaatcagcataaaagcccagatgaccggtatgtacaccaacaaaggcaatatccggaatgcggtcgatgaaggtatgaaacgcatgaagcatcgtaccatcgcctccaatagacacgacgatttccggcgattcggcatccagcttgaaattcttttcttgggcaagacggtgaaattgctgactcaagtccatggagtgctgatccccgcgatccagaacataatatctcaagatgaaaagctcctttgtcatgggtatatatcgatcataatcaattatgagcaagaacacaatcgttcattgcctgtgtgttcttctcaaacgtacgtataagcgacttgtacccacactcaaccatgagagactaagcattcctgtcagtataaaggaaaaaaatagcagactttgcaacagcatggcggacgagaagccaggagaccatacgatgtcgtatattggagaaaagacgggagagcttccctgtcccatcagaggccgccataacacgagagctagcagtgctgagatgatgccatgtgcagcccgggccaacaaaaatggcatatagcggagatttgtcatatttaaaatacttgcaacctgcgcatgaaccgacaagccgccccaggagagaacaaaagcggctgcggataccttgaatggtaacgctgctgccgtggcttcccctgcggcttgcgctcctaaagtgacttcgaaaataccacccacgatggactccgttaacgtaggaggaagaccacatgcagtcaataggcttgccgtaagcagatgaagcccgctcattaaaccggagttcgtcaaagcttctaaaatgacgcagaagaatacaactagccctcctacgacaataataaggcgtagggaggaagtaatcgcctgacgaagtaactcacccaatgggcgaccatcttccaaacgagctgtatgcatggcatataatgcttggcgtagggggccaggctgcctattgcgacctgctgcttttgtattcgtggacttcgaccaggctttttgagtaggttgagggcggtcgctgcgagtatctgtttcccctgaacgggaaccgtggaagcgcataagcagcccgatgatgagcacgccaccataatgggccgcgcccagtacgagtgcaatttctggttgatggaagaagccaacggaaaccgcaccgattaaaaatatcggatcagaggaagtggtaaacgcgaccaaacgctctccttcaatgcgtgtgatccatttttgctcccacagcttggctgttagtttagctccaatcgggtaaccggatgcgcagctgaccgcagcgacaaaacccccacagccaggtacacggaataggggctgcatcagcggatccaacagcgcacctatgaaatgaacaattccgaaaccgaggagaagctcggaaataacgaaaaacgggaataaagacggaaacagcacgtcccaccagatggcaagcccccgaagtccggcattcagagaagattgcgggtatacagccataagcataaataggaatagcagtgtaaggatgagcagaggaagcgagtaacgacggtatagcgacatagaggcccctcctttggagttgtactaatatacctatgtcggggatggacaaagagtacaaaaaaatcaaagaaaacgattacatctaatgctgtatttttgtaaatagtatgttaaaataggaaaacaacgatcccataaccttaaggatggagtgatcaggatgagtatcgttgccggtctgttcgtatgtgcttttgtgtatgttattcgtgtctctctcgtccatcccggtgaagaggattggcggagttattagttgtgtttatagaatgacgaagctgtgtgcaacgaagcacaccctcttcatatgttaaattgataaaatgacgcttatttttagcgtcattttttgttttttgttataatacgggtgtatatttattaccatagcacagaaagttggagaaaagtgaatcctagcctaagcatttatgacaaccttgggggtgcggaaggtgttcgtgctattattgaggccttctacccgagagtttataaagatccgttgttaagtcccctgtttcctaaagacatggaaccggttaaggaaaagcagtatatgttcctgagccagttttttggaggaccgtctcttttttctgatgcatatggtcatccgatgttacgtgccagacatatgaagtttcccgtaacggaggagcgagcagaggcatggttgtcttgtatggcaggtgcgttaacggatacgggcattgaggagccgcttcgttcaatcatacttaaccgtttgtctggtcctgcgcatcattttgtaaataccccgtaagctttcggggattgccgaattttggagagggttgtaaaaacattggaacttgaaccgttatatcagatcaaaatcgcttgcccacattgcgaagaagaatttcagacatcccgtgtcagaccaagcctaaagaaggccattcgtacggattcagatttttgtgcttattataagaatgaaaatccggatttttatgtcgtaagggtctgtcctcattgtggatttacctcgacagagcactctaccgttcagttaagcgatcagcaaaccaagatatttaaggataaaatcggtaaccgctggcagtctcgcgaatatggcgggcatcgtagctgggaagaggcattagaaacgtataaactgggtttactctgtgcccaggtcatcggagaaaaggaacgcgtagtagccagtctattacagcatatcgcatggatgtacagataccagggaaatgaggagcaggagcttcgctttctcaaatttagtctggattcgtatgttcgggtctatgagctggagggtgtcggggcgaataatgccaaactgctttatctgattggtgaactgcatcgacgtacaggcaactttcacgaagcggtacgctggttttcgcgtgtcattaatgacaaaaagattatggatgcagccatgatccgggcttcccgtgaacagtggtctgtactgcgagaacaaatgttggctaaaaatttccaactgccggaggaaatgcaggacgcaagctcctcttgaagaaataaaggtgtgcactatggccgatttaggctcatggttcacaccttgtttgtaaaacgggttatcttatcttacaactgcctcatgaattaatgatgacgcaatgtggtatctgacagcaaataatcgtcatcacaatccaccaaagtaaccttgttatggcagcatggaaacacaagcaactttttcataccttcgtgtatgagcttaagttcttttggcttcaggggcagcaaaacattatcatggtcgcaaaatggacaagactgtacataaacgtctcccatgacgatgtcataaggccaggttttatgaaaagggatcatgatttgttcgattctccgccgttcgggtcagcggtttcttctttagccagttcggccagcttttgcatcaaaatgtgctggggtgtatgcataaggtgttccagcggaatgccgagcttttcggataatttcacagccgtttccggcgaaatttgtaagggtctcatcctgttttcctcccaattgtagtgatttactatcacgatgtagctttattgtatatgaaaccacatgaattcgccaaaaaagaaaggtggaactattatgaaaacgccgttaaagcaaacatgggatctggaatctatttttagcggaggatcttcctctgcctcatttcatgcatttttggaagaaatggagagcaaggttcaacagctgcaatcccagcttaaagcagccaaagtaccacagacggtattggataccgagcgtctggatagtgtactgaatagcatacaggagctgtttaatggtgcgtcgcaggcgggttcctttgtctcttgtctaactgctcaaaaccagcacgacaagctggctgttcaattgggggcgcgtgtcaacacgctgtatgcccaagggaaaagtgctttagtatctttccagaacttgctggcacaaaccagtgaagacatttggcagaaatggatggagcgcgaatctatccagccgatttcttttgtcctgactgaatatcggaacgaagcacgtgaaaaaatggctcctgagctggaaagccttgcattggatctcgcagtggatggctaccatggctggggtgacttttatgataccattgtcaaaaatatgacgatccccgtgccggaaaatggcgagatcgtaaacctgtctgtaggtcaggctgctaataagctggatgaagcagatcgcagcgtacgtaaagacgtgtttgcacgttgggaagaggcatggactcaggtagaggactattgcgcggatacattgaatcatttggcaggctttcgtctgaagctatatgaaaaacgaggctggacagatgtgcttaaggaaccgttggaaatcagccgtatgtctgcacaaacgctagatacgatgtggcaggttattaatgaaacaaagcctattgtagtccaatacttggagcggaaagcaaaactgctgggcttagagaagctttcctggcatgacgttgaagctccgctggggacgtcaactactaaaatcccttacgacgatgctgctgtaacgattgttgagcaattcggtaaatttagctcgagaatggctgactttgcccaaatggcttttgagaaaagctggatcgaagcagaggatcgtccaggcaaacgtccgggtggtttctgtacatctctgcgtctgagcaaagagacccgtatttttatgacctatgccggatcaccatccaacgtttcgacactggcccatgagctcggacacggttatcatcagcatgtgatgaatgaattgcacccattgaatcaaaactatgccatgaacgtagctgagacggcatcaacgctggcagaactaattgtatcagatgctttgctggaagctgcggagggtcaggagaaggtcgctttgctggaggataaaattcagcgtggtgtagccttctttatgaacattcatgctcgtttcctgtttgaaacccgtttttacgagctgcggaaaaaaggagttgtaggagcgcaacaattaagcgagttgatggaacaagcgcagcgtgaagcgtttagtggtatcctggatgaggctcatcctcatttttgggcatccaagctacatttctatattacgaacactcctttctacaacttcccgtacacattcgggtatatgttcagtgcaggaatttacgcttttgcgaaggaaaatcctgacggcttcgccgaccaatatgatgccttgctgcgtgatacggggcgcatgacagtcgaagaattggcttccaagcacttaggtaccgatttaacacaggctgacttctggcgtaatgctgcgcaagttactgttcaggatattgagcaatttttacaaatgacaaaataacggatttacacttttgaaaggtctcctataagggaggccttttttgtgatttttgcagaagatgatgaacaaagtcgcaaaatgtcgaagtataattaacattacctgttggcgaaatttaaaatgatggatatacttagaaaatagttataaatacccaattatgttggttttgattgtaaggttaaaaatcttcgcatataattgagccgtaagacctattaattatttcttgataaggtatataggagggtttttgtaatggacgaagtaggtcaattgtcgttagcaaggcagatggatatcgttttaaaagaactggataatgaactcgcaggtttgtcgtcaggtatcgtatttgtacaaatacgtaacaatgtagttgggaaatttgggattcgtcataatccgcttgcaggtaaagggggcacatttgcagcagtagaaccggggttatcagcaaagcatcgggaggattttcggcgtatggctctagaaacgctaaatcataagcgtagctggactcatggtgagattgctttcgattttgccattagacaaggaacgattttggtagatgcaacactggagtccaactacaacatggcgaatctcatgatccgctacaacaagcctacataccgagcggctaattccgaataattcaattaaaaaaagtaaagaaaaggcggccttcctaagggaagaccgcctttgttatatacccgttataacacattttggtaaattacgatgaacggaatgctcatgtggaataatgacgcttattgacctgaacgacctgataattgctgttcggccagctgtaccaagcgtttagtgatatagcctcccagagaaccagcttcacgggatggcatgtcaccgtagtaaccatctgccggaatggtgatgcccagctcttgtgcagcttcatatttcaattgttgcaatgcgttgttggcttgaggaacaactaggttgttactgcgacggcttctgccttgattagcttcattcatgtgtagtcacctccttcggctgtgatgaggttagtatgcgacagagttatgaaaatatgcgccgaaggaagaaaagtgaatagaggaaaattacggatatatgatatgaatctgagttttgagatcgatggattgctgaggctccaaacggatcagtccggcttccccggcaggatcaggtgaattgggcgcatcaggcagacaggtataaggctcaatgcaaagatactggtcgcattcacctttggtatataaaacccaatacttatagtatagctcatctgctgtgtagcggatttgataaccgtcgtcacgagtcaaaagggcttcagcagggccttccgttgcccgcagcagagtgtctagatttgttcctttcagagaaagtcccgaagagagctgttccaagtcatctaacgaagaaatgatacctgtaggtagctgttcagcatcctgctcatatacgccgttcacaggtagctttaggcgccagcgctcaggttctccgtccaccataaaccaagtgtgatatcccaagccaaatggggctgctttttcacccaaattcgttacgcgcagcgtttgacttaatacagctccctgcaagcgatacgtcatctccagacgtaaaggaatggggaattgttccatccagtgcggatcactttctgttaaaagctcggtagtaacactgcaaccttcttcatcctcttcaatatcactgcagcgccaggactgattacgatgcagaccgtgtatatgattgtcattggctgtatttcggtcgaactgatatggaacaccgtcaaactcaaattgtcccttgcgaattcggcctggaggaatcaaaatgggcaagccaaaatgataaggcttttgtaaatagaaagccaattcttcctcaccgggccgacgtacgatatcccggttgagcttcagatcacgcactgaaataatattattcccgaggcgagggatcatcgtaacttccagttcaccactatgtagaacatacgtgtcgtaaccgttccagtgttctttggtcacttgtttcatatccatgctcctttgtccactataatcggttgaagcttcgtgtcattatgataacagatttttggtcgtagggcacaatcgtcatttgacaataacattatgcggaattatcattaatgtagtttagaaagtaatgacatggataacgcgatgatgaggacaagtaagctttcgcataagctcttcagaaagccggtggtggatgggaaccggtgagcctgcactgctgaatggaccttggagtgccgcacagaacaggaatttactgtcctcagtatgacggccgattgctccccgttaacggagctttaagattgcaggcagccacggagcatagctccgacaagtaataggctgacggcaatgaataagggtggtaccacggtctcgcgtcccttgaggatgcggggcctctttgcgttctaattttgaaatactgaggaggaagaatatgaaaactgtactttcaggtattcagcctagcggacaacttactttgggcaattacattggtgccatgaaaaactttgtcaaattgcaagaggatcatcaatgttactttatggtcgtagaccttcatgcaattaccgtaccgcaggaaccggctcaattacgtgagcagtcggaggcggtagcagcattatttatcgcagcaggtattaacccggagaaatccaatgtctttttacaatcccatgttcctcagcacgctgagttgggatggttgatgacaacactgacgaatatgggcgagttggaacgtatgactcagtttaaggacaaagcagcaggcaaggactctgtaggagcagggctgttcgtatatccatcgttgatggcagctgacattttgctctacaatgcggatctcgtcccggtaggtgacgatcagaaacagcatctggagctgacacgcgatttggcgggtcgctttaatcaccgttatggagattattttactgttcctgaaccgtatatccctgaagtaggggcgagaattatgtccctggatgatgtatccaaaaaaatgagcaagagcaatccgaatgcaggcagctttattgcgctactagacgaaccgaaagtcatacgcaagaaaatcagccgcgctactaccgattccggtagtgaggttagatatgatccggccaataaaccggaaattagtaatctgatgggcatctacagccagtgttccggtttgtcactccaagaagtgcaggatcgctatgaaggtcaaatgtacggaacatttaaaaaagaactggcagagaccgttgtagctatgcttgaaccgattcagcaacgctatcgcgacatccgggaatccggtgagattggacgtattttagcccaatccgcagagcgtgcacaagaagcggctgaagtcacgctgtctgcggtcaaagagcgcatgggctttctgccacgtgtacgctaaagcatattgagacgaaacggattaggccttttaaaggattggattaggagcggcgttgtcgagctttgaccacgaaaccccagccgatattgccgacagataatagccccagtagaatggcaagccatgcggaataactaatggatattgcggccgcggtcagcaggacaatggatgaaacggcgaaccatagggataaacctttgctcattggtaaaaacctccagtgttcgaatgttgaatttcaggaataagtagttgtaagcgagccataataatcttgcaagcttgcaatgaacctcactcacaaagaactgaaaggagattcaaatatgagcagacgtcgttcaaacaacctgcaagtaccgcaggccaacgccgctttacaacaattaaaatatgaggcagctcaagaacttggcatcacgatccctcaggacggttacttcggtaatgtcgtttcccgcgaaacaggttctcttgggggatatatcacgaaaaagctggtccaacaagcagaacaatccttgtcgggcagcagccgtttgcagtaatacacataaacactccatcttggaagctgtattatgagcaactgtgatgaagaaaatccggagcgatcatgctccggatttttttacgcatggcttatcaccattttgaatcacgcaagtccgcttcgtcaagagggcgctttcatgagaagtgattttttacgcgagtggccaaaaaaacagcaagctccagatgaagggagacttgctgtctgttgttcatacggcttgttgttagcttgtaggcaggttttaattcgtatgcagggaaaggcgtttttgcatcttttcgtcactgagccatccaatatagctgttgatcagtccgaactgcttatccatcgcgaccacagccacgaatggatattgtctccggtgtcgatacctgacgtctccccatcgcacaatgtagccccattccagttcctccacctcggcaacggcaaaggaggaaaaatagcgaaatgcctgcacatcgcgataggatttggatgcttctacggcaggatgtgtggatggaatcgcatgtttagtccaaaataaatgtttgccatttaatccgccaatgtcataacttccattctgatgagcttttaccacatgccaccggttccatgatacggtgggaatgatataatagatgtcgccctcctgacgctcattgtccatatcacgtaccgcttttctggttataaaatgactccaggttcgccaaatgtaatataggccaataataacgtacagcgtaataaataagggagcgggtggaatcaatccggtgacccacagcataatcgcagcaacatgggtgccaaaaataaagggatcgaaaatatggatgatattccaagatatccacttgtttgtaaacgggcggaatgcctgtgttccgtacgtattaaataaatctgtgaatacatgcaggcagacagcaatcgttacccataatgctacatgacctgggggcacatctctgaagatcaggcaaatcagtcctgttatggacaagatccatatcaaccagaagggaattgaatgcgacagtccacggtgattgcgaatgtaggctgcattgtttttcaaccgaagcaaagtgtcaaaatccggagcttgtgaccctacgactgtagcgagcagtacgactgcggccaactttggatctccggcgacgacaggatcagtgtaggccagcccggccaatccgattcccatgacaaagtgtgtggctgtatccatatctgtcgctccttttgtattgtttcctgtacttattactacccaaatttactgtaaacgatcaacaggggcgatttgccatcggaattgtgaacgttttgtgcgttttctgtcaaactttttggggtaggtatatgataaaatttatatcggagttcaacttactcccgaattcatacatctctaagggggagttactcacaatggataatataagttataagacttcttcggatgcggctacctattctgtaaaatctaaaccacccggcaaagcgggcacttggaaagattttattacagttaccaagccaggcatccttcgtaccaatctggttgcagcctttggtggtttttggttagcatcgcaatgggacgttgattatataaagctaattcttacacttttaggtacaatgctggttatggcgtcttcttgtgtttttaacaactattttgaccgtgagctggatttgaaaatggaacgtacacgtaatcgctcactgccaacagggcgtctgacccctacaacggtgttgtcatacgctattattttgggtgttgtcgggttagctgttctattcttcttctctggtgtaaaggcaggattactgggattacttggtatgttcgtctacgtcggtatttatacactttggttaaaacgttcgtctacatggagcacatccatcggcggtatttctggtgcaatgcctcctgtgattggttatgtggccgcttcaggtcgtattgatatgggcgcttggctcttattcgctctcctgttcttatggcagccgcctcacttttgggcacttgctattcgcagagtcgaggaatatcgcgcagcaggatttccgttgttgccagtcgtaaaaggtatccatcggaccaagatccagatgattccttatattgtattgctgattccggtacccatccttatgtatgcttatggatatgccggtatgatttttatgatcgtgtccgtgttattgtccgtgctgtgggcattctacgcctttaaaggttttacgattaaggaagaagaaacggattcctgggcaaaaaaagtatttttcttttccattaaccatctgacactcagcttcttgctgatgatcgtcgatacggttcataagttctaatattattttagaggcattttatagtgcaccatatagctgtccaacaggcaagcagccttaggacagcttttttgttattttcaagactaaagaacaggtggcgggtatataatgtattcttccaaccctgctttttccaattgagcgatcacatattcgtctggagtgccttctacgccagcgtatcctttgcgggtatacatatggcaggcatccggaaaagagtctgcaagcacaccccttattttcttccctgagctgtcattgtccataaataaaaatatttcgtcgtgcttggcccgcttgtggagggattccagttttatagagttgagtgtaccgaaggtgcataaaatgtggacctccgggtcaagtaatcggcgaagtttgctgcggtcatttttcccttcaacaatcacggttatcgccatttaagctcaccccttgtatgatacatatgctcgaaattccccgggaaatgaagaatatgtgtatagtgtagctccaaatagggttctcatgcaaaaaataacaaaacagcctgccagaagtggcaggcatgggtacaaagggacaacatgttagggcaattcagacattaaatccagcaagtacggagaatgatgacgagcaaaatataaagaacaagaatggtgccagttgaagttccaaaaacagggcaagggcttacaggatgacagtggctcacaggctgcacctccctttgttagtgaatgttcagtcaaaatagtctatgtggatagggggatagtgtactgtgcatttgccctctgaaacgacattttgggctttaaaggtagcatattagcataccactgccctcagactagctaggaatgataaggtcctgaggcagacagtggcggcgtcggagataatcgcttaataggaacgaatagcaggccagccataagaattagaaatgcgatgaaaaaaggagaaatgtgatcgggtagctgacctgccagtacaggcccggcaaaggagccgatagatgttgcaatagactgtagtgcaaaggttttgcccagtcgcgcacctccaattcgtatgaaaagggaggctagcgctgggaaaatgatacctttggcagttcccaaaataaaaagtataatgccaatcgccgcttcgggcgtggtggcgagtgcgtaaaaacttagagacatcaaaataatgccacaaagtagtcgcaccattggtgaatatttgttcagaaacagcaagctgagcgtacaaagtgctcccaaactgatgatggaaaagagcaatccggtggacatcatggaagcagaaccgttattccgtaatggaatttcgtaaaataaaatgccttgtgcacacgccaaaacaaaaggcaggagcaggtaacgccaattgaatggtaagcgagtcttttgtgctcccgatagcggagtaggtgtcgcatgaccatcagataattgggcctgtggagcgggtgctgttttgggcaaggtgaaataagccataagccccgtgactacgagaatgatgccaagggaactaaacgtctcactaaagccgaaactggctacgataaaagcgccggcggctggagacaggacagaggccaacgtatgaacgacaccatgtcccgacatatatttgccctgcgtaactggatgatcggatagctgtgccaacatggctagacaggccggagataaaaaggctaacacaaaaccgctaatcgcccgaagaaaaagtaattcccacggtgtgtggatgtatgattgaatgacaagaatgatgcctgcggctgttaggctgaacataatatatcggcggctgccgtgtttgtcgaccttggggccggccatcaaattaccaggcagatgagttagggagtaaatccccatcatccagccaataaaagtaggtgccgcacccaaggagatagcgaatggtgtcaaaataggatattgtgcatgcagatcgaaaaaagcaatgaataaaaagagatacagccagagggctgttttcatgggatgacccccttccctaatgtaaactttcatgttacttcgtattggcccttcctaagttgtacgctggattggacgaacatagaccactttgtatggacaagaattgaaagacaaggtatgtataagacctaagctgacaggacattgcgtaatcatgtataattacagagacaattttgcaattcgaatcatgtagttgaaaacgggagtgtagcgaaatggataagggcgtctggagagagtttttggaacataattggcagattgttcaagataattggctgtatatattaattgggcttgtcctattgttagtcatattgaaggttgtaagaactctcataaaatggctgattgtcatcgtcgtaattgcaggcttacttatctacagtggcatttcctttgaacaggtcggcaaggtcgttactcaggcaaaggatgatgcgattaacaaggttcagagcgaggccttgaacatgatgatcaaagagggacgggatgcccaatacacatccaacgcggatggtacgttttcggtaaccagctccaacttggaagttaaaggtccatttgatggtgacaaggtcaaggtatggtttcaggggatgtcgctgggcgagtggagtatgggcgataccgtcaagaaatatatcgaaggtgcgaaaggctcggctgtaacacagtcgccacagtcgccgtagagacaggaggaacacaatgaaaccatcctggctggagcctattcttcattggaatggcgtgacggtgtttttgattgtcattgtactgctgtcgttgattcagggctggagacgaggagcttccagatctgtaggggcgctgttcagtcttattgtggatggcatactgactgtggcgggtattttgtgctcgctcggattagccatgtggctttcaccgaaggtacaacaatggctggcggcttacatggaacatttgcctcagcgagaactaagtgggattgagcaattttattatacgttggtggcggggttagaggggtttcccctgctgcggttcgccgtattgtttatgctcagttatgcgatcgcccaatttgtactacgtgcaatttatgtgttgatggtaggtggcaagtcagattcttctttccatgagcatgaaaaaaaatcaggctttttcagcagggtggcaggggctggaataggtactcttattggtggagcacgcgctatcatggttatagccctgctattcatcggcgtaagtctgtatccagacagcgggtttagcagctacgtccaagcttcaccgatttataagcaaggtgcgcaatcggtcattgaaccgttgtccgggactctgattaaggataagctgcccgtatttacgcaggctgttaccaaggaactgaatggcatcatgcagcgcaaatatgaaataatcgaccgggacattccaagcgatatcgttcaggcagcggccaagattacagaaggggctagcggtgacgagcaaaaagctagagcgttgtatgaatgggtaggcacccgtattagctatgattacagtaaggtggaagcctatgagcaacgtggtgactggcatgaacagactcctagagatacgtttgatacacgtaaaggagtgtgcattgattatgcccgcctttactcaatgatggctcgttcgcaggggctacaggtcaaggtggtgacagggcttggttataacggacagggaggctacggttcccatgcatggaatgaagtatatttgagcgcacaggatcagtgggtaccgctagacccgacctgggcgcaaagtggggactggtttaatccgcctggttttgcccaaacacatatcaaggataaagtgatttaataaggagtggaaaagggcacatgagaaagatagacaacgagcagggaaaagacaatgagacgtctgatcggaaaagatttagctttcggatcaatctgttctttttcagctcgttcattatatttacggtcattattgtaagattggcgatacttcaatttgtagatggacctcagcttaagcagcaggaggccagtaatgttaccaaaaatgtaccacttacgccgattcgcggaacgatttatgattccaccgggcagaatagactggcgtattctacacctgtacaatcgctgtatatcacgctctccaagaattatagtgacagcctggaagaaaagcgtaatccagataaaaagctgttgcctgagctggaaaatatgacacaaaagctagcaaatcggtttgctcaatatggtaataaagatgagccgaaaatgacggcagagcaaattatggacgctatggaccgaaactatcagagatttagcggttttacgccgcgtctgattaaaacgaatcttaataaagatgaagttgcctattttatgcagcataagagtgagttcccgggcgtagatgtcgtagaggaaacggtacgtcattacgatccagatacggtggctgttcaaacggttggctacattaaaagctataaaagtgcgcgtgaaacgttggataaatatagaaatattcaaaagtctatgtcagctgaaaatgatccgggtctcatctatatggacaacgaatcggttggctttgatgggctggaattccaatatcaggaacagttacgagggaaaaacggatataaaacagttccaattgatccacggaatatgccggaaggcgtagattctgttacacctccgcaaaaaggggataatgtctattccacgattaacaaagaaattcaggtgaagactgaaaatgctattatggatcaattgagatggcttcatacacacgctgtatctggcaggactcatccttatgctaaaacaggctttgctgtggctatggaagtggatacaggaaatgtggtggcgatggctagtatgccggattatgatgcgaattattggcaaacgggtacgatttcaaaagacaaatatgaagaaataaaacatgtgtatcaaaacgctacaattaagaatgttggctcaggccaatctggacagcacccagattctaccgtgcttctcggatcaactattaaaccgctgtctgttcttattggattggaagaaggactgtttacaacaaatacgtattatcaagacacaggagcagcctatttcggacgtaacaactctgcacgggtgcggaactcatctggtcatgtgtacggttcaatggacccggctaccgctatacgtcattcctctaatgctttcatggtcgatatggttggcaagcgcttatataataaatacagaaataatgctacagaagaccagggcgttaacgtatgggatcgttatatgaaggagtttggattaggtgtttctactggagtagacttgcccggtgagttcaaggggcttttagaatatacgaaaaaagacgagtcagccctctccaaactggcatatgcttcctttggtcaacaaggtaaatatacacctatgcaacttgcccagtacacaacgatgattgcaacaaagggcaaacggatggagccacatttggtcagccaaattaaagataccaacggtaatgtagttcaaacgtttaagccgaaggtgctgaatgaagtgaaattcccagatgcttactggaatgaagtcatacgcgggatggcaacagatgttagcgcatttaaaggtttcccttacgactttgctcgcaaaacggggacatcgcagcaaagtgttggcagagaattgaaagataatggagtatttatcgcctttgcaccacgtcagaatcccaaacttgcagtagcggttgttattcctgaagggggctttggggcctggagtgctgggcctgtggcacgcaaaatctttgatgcctacgatgaagtatatggtttggacggggtacctaagaaaaaggttgaaacagcaaccgattctaacgcaatcaaacagccataatcattttatacgatatcatttcattaaagcttcccttagcctttgggctgagggaagcttttttatgttttttctacgttttcttacaaaattgtcatcttagaattcatcgtttattgctttcgatatggtaggatcaggaatatggaaccctaatcggaaggagtaatgaccagctaatatggacagaggtagtttggataaaaagttttcatttaaaaagaaaaatgttgaagagaatgaagggtcacgaaaaaaacagacggttttacgaaccaacctactgttttttagtgcttttgtgctgtttgccctgatcattaccagactagctgtattgcagtttgtacaatcggaggagctgaaagggcagcagcaatctgtaaatacgaaaaatgtcccgttagccccgagtcgcggcacgatttatgactccacaggtacggttaagctggcgtattcgacttcagtacagtccttgtatgtaactttatctaaggattatagcaaacgtacggagaaagatcgcaagccgggggaaaagctgctccctgagctcaatgcatttgctgccaagcttgctgccaaattaaacgaactgggtcgtaccgaaggagagcagcttaatgcagaggaaataaaaaagagactggacccggactataatcaatataggggatttaccccacgtttggtcaaatccgacctgagtcgggaggaaatcgcttattttctggagcatcggacagagttccctggtgtagaggttgtagaagaaagtgtacgccattatgacccggatcgggtggcggtacaaacgattggatatatgtacaagttcaaaggagctcgaacgaaccggcccaaatataaagagctctatgaagcgaattcggaggttttaaaaccggcacaggtttattcggaaagtgaaacggtcggatatgatggcttggagcttcagtaccaggacgagctgagagggaaaaacggatataaaacggtagaggtcaatcctcgcagcatgccggagggcattgaatccattactcctcctgaaaaaggacatcatttatattccaccatcaacaaggaaattcagcagaaaaccgaacaggccattatggatcagcttcgctggcttcatactcatgctgtatcggggaagcttcatcaagacgcaaccactggcttcgctgtagcgatggaggtagagaccggaaatatcgtggcaatggccagtatgccggattatgactctaatgtatggaaaagtggaagtacctcaccttcgatatatgatgaaattcagcataaaatgggaaatggaaccattaaatccgtccctagcggtaaagcaggtccacatccagaatcctcggtgcttttgggttcaaccattaaaccgctaaccgtgctgatcgggttgaaggaaaacctgttttctcccggacaaacttatctggatacgggaagtgcgtactacggcaaaaatcgctccagccgggtcgggaattctagcggacatgtgtatggttctttgacacctagcagggcaattgaggtctcgtcgaatacgtttatggtagatatgatcggcaagccaatgtatgacaaatacggaagtaatgcaggggtgcatcagggaattgacgtatgggacaagtatatgaaggaatttggattaggcgtaccgacagaagtagatctgcagggcgagtgggcaggcagacttgagtatacgagcaagcatgaaagtgcgctgacacgtttggtgcaggcatcctttggtcagcagggaaagtatacggcgatgcagttagcccagtatacaactgtgctggcaacaaagggcaagcgtatgcagcctcatttggtcagcaaaattgtagatgatcaggggaatcttgtacgtgaatttaagccgaaggtgctgaatgaggtcgctttttcagatacgcactggaatacagtgattcgaggtatggctacggatgttaaagcctttaatggatttccttatgattatgcccgtaaaacggggacttccgagcaggtggtgggacgtacggttaaagataacggggtgttcatcgcttttgctccccgtcaaaatccgaagctggcagtagcggtcatcattcctgaagggggctttggtgcgacgagcgcgggaccggttgcgcgtaaaatatttgatgcgtatgacgaagtttacgggctagatggtactcctaaaaagcctctggcagcaaagtgaggacttgaatttttttgtgggcttctctttttcatggtaaaatgtcgttggacataagggacatacaggaggaagagagactatgggagaaaaccaatataaatacaaactgcttgcgctcgacatggatggaaccttactgaatgataatcatgaaatttccttggaaacgattaactggattaacaaggcgattcaggaagggatccatgtatgcttgtctactggacgtgcagcgatgcatgctctgccgtacggtcagcaactcggcctggagacgccaatggtaaccgtaaacggcagtgaggtgtggaaatcaccccacgagttgtggcgccgttatttacttgataaggagctcgttcgcaagatgcaccagattgctgtagaaacagactcctggttctgggcgtactcaacagaggaattatataacagggatcgttggccggatacattggacacacaggagtggctcaaattcggttataatacggaaaatgacgaaattcgccaccaaattttgcttaagcttcaggacatgggtggacttgaaatttccaattcttcgatgacaaatctggaaattaacccggctggtatatccaaagccagtggaatcgctgaagtgtgcgatctgcttggcattactctggagcaggtggttgccgttggcgacagtctgaatgatctggcagtgattcaagcggttggactgggcgtagcaatggggaatgctcaggatacggttaaagaagccgctgatgtggtcgtggcttcaaacaatgacgacggcattgtagaagtgatccgtgattatgtgcttgtgtaatgaaacgaatgatgcagcaagcaagatgaatgaacgagaaggaggaggcccatggacgttgtaggctggattgttgtcattgtgctgttcattgtgggcatggctggggcggtatatcccgtattgccgggggcgctcgccatctattttgcattttttgtatacggctggtttttctcgtttgctccatacaatgcattgttttggattatacaaacactaatcgttgttgcgctttttgttgcagattatgctgtgaatgcctggggagtcaagcgatttggcggctcgcgtctgtcggcgatcctcagcactgtcgggattattattggtcccttcgttattccggcatttggtctgattttgggaccatttatcggcgctgtgctgggtgagttaattggcaaagccccgctggaccgagctattaaagtgggctttggctccgtattaggcctttttaccagcaccgtgatgaaagtgatcttgcagcttgccatgattattgtattcttgatttgggtgttatgacccgagatttgttttcgtttattatgatttgcagagacagaatcgatatgcggctccgcaccggtgatggctcaggccatgactatttgtgcggggcttttgcatgcgtgtgaacagcaagaaagaagggaacgcattttgtccaataaagaaacattccttaaaggtacgcttattttagccgctgctgccttggtggccagagtgcttggtctggtacagcgtgttccattggagcatctgcttggttccgttgggaacgcctcgtttaccattgcgaacaacgcttatttgatgctgctcacagtggctacggccggtattccaagtacattgagcaaaatggtttcagaacgttatgcactggatcggccttcggaagcacgacgtgtgtatcgtgcggctttgatattcgcggccgcagcaggcattatcattacagcgctactgtattttggagcaccttactttgccgagcatgtagcaggggttccacaatccgctttggccattcaggctttggcaccagcattactgctgttccctgccattgccatgatgcgtggatacttccaagggcgcggtaatatgaccgcaggcggtatttcacaaattgtggagcaggttgcacgtgtagcgactgctattgtactcgcttttattattttgaagctgggttatggagatcgcgaggttgcagccggggcctcctttggaggtgtcatgggaagtcttggcgctctagcggtcatgttgtactacacggtgaaattgcgccgccaggatcgacaggaccgccaagatcaattccaagaggaaagctccgcgctaccgatgatgcgcatttacaaagatattttcaagctttccattcccattgtattgtcctctctgacagttccggcggtcaactttattgatacgtcgattgtggtgagactgctatctggtcaagtgggattggatcaggcgactactcagttgggttatctaggctctcgggcacagagtgtggcgggaattccgccgattttggccattgcgctcagccaatcgctcattccgatcatttcagcagcatttgcccgtaaggatgagcagcatttacaaaatcagatgacgctggccctgcgtatctctattttgactggaatgccaattgtgctggctttatgtgtaaccgcctattctattaatggtttactgtttagctcgcttggaggcagtggtatcatcgctgttctgacactcggaacgatatttcagattacgatgatgacctctaattcaatactgatcggtatgggcaagccgcgtatttcaatggttaatgtcatggtcggtatcgtcgtcaagtttgcagcgagctggctgctggctggttggcttggaatttacgggatcattgccgcaaccggattatgtttcctcgtgatcacgttgctgaatttgcgtgtgcttaaagggatcgtctccttttccatcatgggccgtcgctgggcagggttcttaaccgcagtcgtcgtctcgggagctatcggatacggtgtaaatgaagcctgtattctgctggtgcatctgatgcctgcgcgtgtggccttcttgatcgcgtgctgcattgccggggcagctgtactggtatgctacttgctgttgctggttgtactgcgcgtattgcgcagggacgagctggggaactacccacgtatgttgcaaaaggtactgcgtccgttaatgcgcctacagcgtgaatccacaggacaacaaggctaaaagagtcctccagtctatcagtggaaaggttgcaagctgttatgggcaacgtgggccattgctgttttttggatgccgtggcgatgctcatggcgcatggcaaataacaggggtcgccttggttcgctcagatgcccaagtgtggagccgtcctgaaaccagtcataacgggggattggatcataagctgtatcggaccagacggcgttcagctccgggctgtacagacgttgtcctggcggtagccattcatgtgctaaaagcgttgcactttcatctggagagtgcagcgctttttgttcattcggggtgaacaatccgggccaatagtcgctgcgtgaacccgtatgtggcacactgttagcgaatgctgatacctggtccagcacctgctgatggccgaagagcatagcatagagacttttgccaaagccgatccgctcgtccaaatggccgaaacgctccatcactagtccagcaagtccaccgttcagcccaagtggaaatataacctgattaagctggagccagtcatgcaaataaaagcccggcttgtgtgtcacaaatttttgaaaatacggatcttttaccacacgtccttcaatatagttttgttcattaatgatgagcgccacagtcaacagagagctatcccgccaagcccagaagcgttcccaaaagggcttcatgaatggcgaaatgtgaaaataaggcaacaaatgaaagcaactccgacccaaatgacggctgtgcatgtaaagttgcaactgcggataagcgtcttgaaaaataagggcattacagcgctccagtagccgatacagccattccttttcctgttcgccaaacaggttgccaatcagtccccctttcagatcggtcatattatagccgccattacgagaaaccaggtgggccagtaatgcccagtgtaactccgggtagccacgatagcattcaaggtaagcggcagtgcgggtgacgttgctgcgattctcctgtgctgtatcatttttgatccgctccagtagctcgcagtctgtttcgcataagggcatattcagagaagagggacgcgtagcaggtccgttcaccagcattaacgcttcagcttcattcatagcggcctgtgctgtatgataatcccacgctagttcacgcaaggggtagcgtaatttgcgggattcggtccaagccgcccgtttgccctcccaagcttcctctgcaacacgaggaacggaacccagtagctttagccctccttgaagctgtcgagatgctgtatggagccattcggtaagagacatgactaaataacctcctttccaattgcaagcatccccgtatcctgccaagtatgttgggtatgctgttaggatgtcgtcgcttatgtggattcttaagtatatctttagtatgcctcaatgagagggcttccaatcggcatgtgagcagaatgggggagtgtgcaaaagcttcacttggcgttacaatagaaagtgcaatcttttcagcataaaaagaatttaaggaggaatcatccatgcaaaaaatcgtctctcatgaagactttaataaggcaatatctacttccggcgtaacggtggctgtatttaaggcggactggtgtggggattgtcatttcattgatccgttcatgcctgatgtggaacaacaatatgcagataagcttacattaattgagattgatgtagaacaggccgaaagcgtcagtcaagagcagaatgtattgggtattcctagctttatcgcttacagtgaaggcagagaactagtacgtctggtgaacagactgcgcaaatcccgcgaggagattgagcaatttttggatcgggctgttgaagtccatgcgagcttggcaaaatagtgaatgctgtgcatgcatgaaggttacaaagtgaattttaaacatcaagacattcagaaagccgcttccttctaagggggcggctttctcacggacacgttcacattttgtcaacaaagctcgtatgtcaaggaacgatatatcagttataattactataagtgatcatttcacaacatataaagtgaataaatattatatttggaaggatacgggtgaatttgaataacaaaattagaatattaaaatggctggcactcgtaacatgtattgtcatgtttttggctaccttcggtggaggtgtcgtgacacggacggattcgggtcttggctgtggccgggaattcccgctttgcaatggcaagctggttccggcacatacgatcgcatcccttattgagttctctcatcgttccgttagtgccatggccgggattctttctatcgcctcatttgttggctttttgctgtttatgaagcatcggaaggatttacagctattctcgctgctcacgctcttgtttgtcatcatacaaggtgccatgggggcgttggctgttattttctcccaatcggctgcagtcatgggactgcattttggctttgcgcttatcgcctttgccagtgcaactatgatgacgctgggggcctggcaggagcacgcggactcacgctacactccgcgtctgattcctgggcgtgtcagtcggggctatcgcaactttatatggctatcgacgatctatacctatattgctgtttattcaggggcgttgcttagtcactcggtcatccagaaggttgtaaatattgggggcttcatatctccactgctgcttcatcagatttcagccggtctgctgttcgtcattatcttggctgtgggtcactactcataccgttatcacccgaatcaccgagatatccgtatattgggtgtcgtatcggtcttgttaattttgcttcaagtggtgattggaattatcttgttgtacgtcaacagacctgaaatctatatgtttatcgtgctgggacatatgctggtgattgcatcgttgttctccattttggcttatctgagctatcgtgtatggcaattgtcaccagaccgcaagcttgttccgacccaagcacaacgtacctaagcatttcatagatcatagtgaagcggatttttgcccaagaggcgtttaaacacgtataatagcatataagaaacaaaccaggcccacgagtttctcgagggcttgatttgcttaggaggagtcgtccagttgatctaccagaatttgcgccaatttattgaagcgttgcgtaaagaaaatcatcttaaaattatagaggcacctgtcgatccttacttggagctggctgagattcatcgaagagtcattgaggaagaagggccggcactgctgttcacgaatgtaaaaggaaccccgtttcctgtagccagtaatctgtttggcacgaatcgccgtgtggatatggcttttggcccgcgaccagagcaactgatggatgcgattgtcggagccaccaaaacattgtttccacctacaccaaaagcattgtggaatgaacgtggcctgattaaggacatgctaaaagtagggctaaaaacagtatctcacagcgaggcccctgtattgggagttcgccgtacagaggctccgttagcgccactgcctaaagtgaccagttggcatgaggacggggggccgtttattacgcttccacttgtgtataccgagaagccaggtcagtctaaggatcataatctggggatgtaccgcattcagatttatgatgatcagacgacgggcattcactggcaaattcataaaggcggcggtttccattatcatgaagcggagctacgtaatgagccattgcctacgacgattatcattggtggcccgcctgccctgattgcgtctgccattgctccagcaccggaaaacttgcctgagctgctgctggcttcgcttattatgggaggcaagctgcccatgacagaagatccgcttgggggtcaccggattccagcagaagcagaatttgcaatcagcggttatgtgccgcctcatgaacgccgtccggaaggcccgtttggtgatcattttggatattattcattacagcatgatttccctgtatttcatgtcaaacatatgcatcaccgcaaggatgccatttatccggcaaccattgtaggtaagcctcggcaagaagactactatctcggtgagtttttgcaacgtctgctgtcgcctgcttatccgcttgtgatgccttccgtcaagtccctgtgggcgtatgcggaaacgggcgtacatgcgctggcagcggcagtcgtacgtgaaagctactcccgtgaagcgcttgtatccggttttactattttgggtcaaggtcaattatcgttgaccaagttcctgatgctgacggatcgagtaattgatttatctgactttaacctgctgctggaaaccattctggagcgatttaatccagcaacggatttatttattttcaatcacacgtcacacgatacactcgattacacaggccgcaagctgaatcatggtagtaaggcgatcctgatggggataggtgagcctgtacgtgaattgcctcgtgtttatgagggaggcgatctgccgggaattcgtgaaattgagccctattgcggaggatgcctcgtcgtatcgggtgcgtcctttgagcaggagcctgagctggcggcacgtattttggagcgattagctgcaggtgagcaagaatggccgctcgtcttcattgtggatgatgccaaagaagttgttcgctctcaagcctcgttcctgtggacggtgttcacacgctttaacccggctacggatatgtacgcggacagcgaagtgcgtttgcatcatctgaactataagctgccgattgtagtggatgcgcgtatgaagccggggtatccggatgaggtattaccgcgtgaggatattgttaagcttgtagatcaacgatggacgagttatttcgcttgacgccctaatgaaacctacagccggattttacatttataaggaggcgtaagcatgatacgcaagctactgggtgagccgccacgtgtgaacaagggcatcttgctggatgccatgaatagcatgtcagatatgttgaacctgctggagcggcaaattcaggctggtggagatccgacccacgattttcggaaggcggatattttgacacgcggtctaatgtcatctctggatgaactggagcagagccatcatgctgccgcctttttccgtatgaatgtgaaagccggatatgctgaagatatgagcgaggatgaaaaatccgactatgcattatatgttttcttttataaagatgggtttgtgagggtattctccattttagataagctgggcaactggctaaatgatctgtgtgatttaaaaacagggcagtataaggctcattattcgtattttaccgtgttgcggcagctcaagtatctcaaaatgcatcctgtattgaccgataatttaattgatatcaaggacacatacaacgatgccatcaatcggctgcgtaagcgtcggaatacggagatacactatatgaatacggaaatgcaggatgatctctggcaacgacaccgtgctttgtatggaaaaatccaactggaggacctcgatcaccatttggaagatttgcagcagggcttggaaatggtgtgtcggtcgctgtcaaacgcctttacttatactgcgaaacaatgggagaaccgggcagtacgcccaaaaatatgatagaaaatatcctttgacaaagctatgtaaactatctatactgaaacctagtttcagaaaaatgcttgaattatatttttttatataaacttaacggacagctaaagctggagtttaacatatttttcttatccagagaggtggagggactggcccgatgaagcccggcaacccgttctttcccggtgtaatacactgggagggaacatgatggtgctaattcctacaaaaccgctagagttatagcgattttggcagatgagaaaaggttcgcaaggtggggcccttttcattctgtgaaaggggctcttttttgtataaataaatagcgattttatacaatcctgagagatgacaactggttaaaagggtaaggaagaagtgaagggggtcgcagcacgttgatagagcttaagcagttaaccaagcattatggcaaaggcaaccgacgcgttaatgcgctgtctgggttgaatctttctataaagcgtggagaaatattcggagtgattggtcactccggggcggggaaaagtacattgatccgctgtattaatttattggaacgccctacttcaggtgaagtatgggtagacggggtaaacctcaccactgtgagtcaatcccaattacaaatgcagcgccgaaaaatcggaatgatttttcagcattttaatttgttgtcctcggcgacggtgtatgacaatattgcatttccattgcggctggtaaacacgcccaagcagaagctggacaagaaggttcgtgaactgctggaattggtgggtctcgaagaacacagtggaaaatatccgtcacagctctcaggtggacagaagcaacgggtaggaattgcacgggcgctggctagtgatcctcatgtattgctgtgtgacgaagcgacttcagcgcttgatccgcagacgacggggtctatcctgaaattgctgctggatattaatcagcgctttaatttaaccatcgtactgattacacatgaaatgcatgtcattcaaagcatctgtgataaagttggcgtcattcatcagggcgacatcgtggagcaaggtccggtggcggaagtgtttttgaagccgcagcaccaggtaaccaaggactttatccaacgggagtcagaacatcccgaagagttacaagcagcgattgcggcagcaggtggcggcgagtcagcgcaggtggtgcgtatctccttcttgggcagtaaaacatatgatgcgattctgtcgcgtacggctcgaagtactggtgttgattttgcgatcttgcagggaaccatatctacgattaaaaatgtaccctatggacagctaatcgttcgttttgaaggaaatcatgaggatatagagcatacgctgcgcgaagtgtctgggcaaggacttgatgtggaggtgattggacaatgagcgaacttgatttttcacaagtgagttgggaagagctagggaattctacgctggaaacccttcagatgcttggggcatcggcattgttcaccctcgttattggtttgccgctcggcatattattgtttctggcgagtcgctcctcgttaactttgatgaaggtgatatacattgtattatcattcatcgttaacattttacgttccgtaccctttatcattttgatcgttgcacttattccttttacccgatcgctggtaggtacctcgaccggggtgttgggaaccatcccacctttggttatcggggctgctccattcttcgcacgtcttgtcgaaacgtctctgcgtgaagtggacaagggcgtcatcgaagccgcacaagcgatgggtgcctcgacaggacaaattatccggcgggtgctgttacgtgaggcacttccgggtctgctcgctgcattaaccattaccgtcgttacactcgtatcctacacggcaatgtccgggatgatcgggggcggtggactaggtacactggctatcaactacggctattatcgttatgaaacggctgtaatgatcgttgcggtcgtgctgatggtcgtattggtacaattgctgcaaatggcgggagatcgcctcgtgcggcattatactcgaaaatagggaaaacatatagatatccttattgatcaggacgtctgctcctgaatattacaaattattggaggggtaataacatgaagaaatgggtattggctgtattaagcttgacattaattgcggtgctggcggcttgcggtacaaagagcacaacatcggatacaaacaatgcgaaccaaaatacaggcggatcaccacgtgaagtggagctgaaagttggagcttctcctgtgccgcatgcggaaattttggaagcgatcaaacctcagttggaaaaagaaggggtacgtctccaagtcgttcagtttaacgactatgtacaaccgaacgttcaattgtttgacaagcagctggatgctaacttctttcaacatgtaccttacttggatgtgatgaacaaagagcgcaaaatggatctggtctctgtgggcgcagttcatttggagccattcggtatctactcccaaaaatataaaaagcttgatgaactcccagatggcgcaactgttgccattccgaacgatgcgacaaacggaggccgtgctttgctgctgttatccaagcaaggtctgattaagttgaaagacgaaggaaacattgaatccacggtgaaagatattacagagaatccgaaaaatttggaattcaagactttggaagcggctatgctgccacgtcagttacctgaagtagacattgcgttgatcaacacgaactacgctctggaagcgaagctgaaccctacgaaggatgcactggcactggaagacaaggattctccttatgctaacgttctggtagcacgtcctgataataaagattccgaagcgattcagaagttgcttaaagctttgcaatctccagaaactaaaaaattcattgaagataaataccaaggcgcaattatcccggcattttaagtagggaacaagaacgcattgcacgcaacccccagattctcttgaacaagaggactgggggtttctttttgaatggagttgtaggggaagcttaaatattttatacttgggggtgaccgatctctgtgaacaggaggaaaattgttgagagataaagtcgcattcataacgggcagtgccaaaggtttaggtaaaacgaccgctctgcgtctggcggatgaaggctgtaatattgcgctgaattatgtgcatagccaagctgaagccgaagcgcttaagcaggtgattgagtccaagggagtacgctgcctgtctttacaaggggatatctctgttcaggaagatatcacgaggctgattggtgaagtacaggatcggctaggcggagtcgatattatggtgaataatgccggaccgttcatccgggaacgccgtctgtttgcggattacagtgtagctgagattcatgccatgatacaagggaatctggtcggtaccatgttgctggatcatttggtattgcctcacatgcggatccagcaatggggacgtattattcattttggctttggtcatgctggagaagcaagggcttggccgcatcgcgccgtctacgcagccgccaaggtggggctggtgtcttttacgaagtcactggctgtggaggaagctcctaatggcattacggtcaatatgatctgtccaggggatattcgaggagcaaataaggaaatgtcaattgccgatgtcatcggtatgcaggataaagagacaccgcgtggacgtccggggagcggagaggacattgcgcgagtgatcgcctatttgtgtgaggagcattcggattttataacaggtaatattatggatgtatcgggaggattggaccccattcggccaaccatataagcttgagtgatccctcagacgctgtaacacaaaaaagagtcttgagcttcgttaccgaagtcaagactctcatgatcattatgcatcaagcattagaatacttgtaccacttcttggacgccgtcgacttcttcgagaagagcacgttcaatccctgctttcagcgtgatcgtggaacttgggcaactgccgcaagcgcctaccagcttcagcttaacgatgccgtcttcaacgtcaaccagctcaacgtcgccaccatcgcgttgcaggaacggacggagcttatccagtacatcagctacttcatcatacatttgaacgctttgtgtttcgctcattagaattcaactcctttcctatacctttattattatattacaaagcgggccaaattaaaatgcccgtcatccaaagcaggtgaaaaaatgttaagacctattattgagttttgcaccagtaatatgcattggggtaccgatgaaatcatgtccaagctggaacagaatccagattatgatgtgattgaatacggctgcctaagcaattgcggtcagtgcaacgccgaaccctatgcgatggtcaacggcgagattgtatccgcagattcagcagagcttctgtacgaagtgattatgaacaaaattaaggaagctgaagcatgggataacctagatttggattgaaaggctctgttagccagctcctttttgtagagaatatacatgatgcaaacactcaagaaacaaagaagacctgctctgagagcgggtcttctttgtttcttgagcatacgtttatccaaaatggcgtttggacttccagagcacaccgcttttaagcaggcgtggtactcgtccgcgcaatgaggtactgcccataaagccatagccgaacccggccttcttgccaagtgcgcctaatgtaccacgcagctttaaaggatgcggatgaggcgtttgacctttccacaggtcgcgtacaatgtgtgcgatctgctccccttgcacttctgccgcttgagcgcttggagagtagggaaggctcgcacagtctccgaccacatacacctcaggatggtccggtatttgataatattcgttgagcacgatgcggccctgaggatctttagggacagctaaatcctgcacaatttttaccggctgaatcccggccgtccatacgactgcatccgttacaatttgctcgtcacggttataaatagcccccggctcaatacgggaaaccgcaacatgattcagggcattaacctgatgctccttgaaccaagcatgtacataggcagacaaacgttgcgggaatgccgacagcacccgctcgccccgatccataatggtaatattcaaatctgtacggctttcacgtaactccgcagcaatctcaacaccgctaagaccgccgcctacaatatggacatgtccatatggcttgatttcgttcaagcgcagataggtttggcgggtatggttaaacgactggatcgtacagctgtgttcttcagcccccggtgtattgtgaaagcggtcggtacaacccaacgcaatgacaagctggtcataggacaagggttcaccgtcttgaaaatggaccattttattctccagatccatcgaggtgacctctccatatttgcgaataagacgttgctcatctggaaaatgcacccgtaaatcaaaatcagaaaccgtaccagccgcgagggcataatactctgtttttaacccctgaaagggcattcgatccactaaaataacttgaacatcgtcgggaatgtgtttatccagcaattctttggcaatggtaaggccgccatagccgccccccagaataacgaaatttttcatcaaaatccgccttcctttcgctaccgtgtccccggcaaatggtctggtgtctcgttgatctaacacaagtttttgttgttataaaacccgagaatcgggcctgcctttggcaggcagaccagcgtattccgaggcagcatgatgctgcatggtgtgagtaatggggatgaaatgctcgcgggaaatctgaatccgatattacatttattcgaaaacttcgatttcgttatagaaggtgtcccgttcaacaggtatgcgtccggcacctttgaccagccagatcagctctttacgggtcaatccggcaggggtcaaagcacctgcggcgtggctgatctgctcgcgcacaatcgtgccatgcacgtctgatgcgccaaaggtgagagcgacctgcgtcaattgcgggccaatattaatgaagtaagctttgacatggtcgatattgtccagcatcaggcggctgatcgcaatggttttgagatcctcgtaagcggagttccggcgcatgatgttggcgtttttgcttttcggctgcatggacagtggaataaataccataaatccgttcgtttcgtcctgcaattcacgaatttgcagcatatgttcaatacgatcctgatacgattcgaccgaaccgtacagcatggtcgtatgagttttcatgccgagattgtgggccgtgcgatgtacttcgagatagcggtccacgttggctttcgtaacacgcatcttcttccgatattcgtcggacaagatttccgcgccaccaccagtcagggattgaagtccagccttttgcagctcctgaagcacttctttaatactcaagccgcttatacgtgtgaaaaagtcaatttccgctgctgtgtaagctttcaatgtaacgtggggatacttttcattcagcgccttcaaggagtctacatagtactggaaaggcacatgattattatgaccaccgacgatatggaattctcttactcccggatggatgtgttgctctacataatcaatcatttcctgcccggacaacgtataagagccgtcctccccctgatccttgcggaaattgcagaacgcgcagcgcgcttcgcatacattggtgaagtacaggctcatgttttcgataaaataaaccttttttccgttcttgcgtaaattagcttcgttagccaactgacccagtgtgaggatatcgtcagtttcatacaaatatataccgtcttcaaggttcaaacgaataccgttctgtaccttttctacaatttccgccattctgcggtctgtaaaaggtgtaactaatgtggacatgcctattcctccttcaagttgctctgtgcgaggctgtccgccaaatcagcggcacaagcgctaagtgcgcacaggatgtcccgttccgtcggtaagaatccggcagcgcggatatacgatatgtgaaaaatgttacaatgccaggctacaatgatgaatatctcaaaatatcgcctttgaaatgacaaatttccgacagtttcttttacacactcttcacctattataaacctcacaccaccggtgttcaatacaaacgaatagaaaaacaggtctttaagcctgtaagggaaggacattccatgacttgagcacgtgcaaatagtggagtatactgaaggagaacatgaagtaaaagaggaggatggagctatgattaacatcaccgattccgctgctgagcgtttgaaagatatgctggagcagcaggaaacgccgaatatgtttttgcgtctgggtgttacgccgggcggttgtaccggattttcgtatgcaatgggttttgatgacaacgagacggatcaggatatatatatgaacgtacaggatatgaagattgtagtggaaaaggaaagcatccgctacctggacggtctggaaatcgactttgaagagtctggaatgtcaggcggcttcacgattcataatccgaatgctgtagctacatgcggctgcggttcaagcttccgtacggctacagatgccggaaaaccgaacgaagagccttgttaagatagtttaaaagggtacaatgaaaatgaattgtctgcaaaccttcatgatggggcgttaagaattcgaaaatgtaaatcaagacctccagaacggtatagtcacgtactatattcgtcctggaggtctttttaatgtgtaaagattactttacttaagatcattatcactacgtatggattggaccaatttactcagggcattaaaaaacgcgaatacaactgtaaaaagtaagagaactacgggtttaatttcaatctccgaaaagacactatataaaactaaaaatgcaaaaaagagtactgagctatttacgttttgttttgtgtaaatagattttataaaatccatcgtatcactctccattttaattataagaattcaaaacatatactatgagtaccacattaatataatagaagttaactcggtatatataccatattgcggatgatttttgagagagaatatatgcggatgtatttaatgaacgacttcttatacataaattacagtattgcatacaaacatccaggacttatcaaataaaaagttcacattatttaaattagagttttacttcactaaaatttcaagtataggaatttacaattacaattctgagggggtgaaagtatatatgagcaatccagttggcttaaaaagagttgtcatggtatatggacctgatgatgatcctcatatgtatgaattatttgagggagttctgtatgatcgtagctatttcttttatcttgaacatgggatattgtgtctgcggcatgtacgaaagatagatcaaccggatcatctatatctttatgtggatggggaaagtgggggcctccaactagcgaagaatgtacagcgtgagattatggaagtcgttacagaactgatcgagcgtttgcgtagtaaggatggattggggtttttactggatgaactgctatggctacatggtcgaagtcatattgagcttaacctcgtgaaaaataaaggatgatatatttctgttgaaaaccaacagcctgtaactacattatgcttctattgagaaggaatctgttaatatggttgctgtattcagtgacgctatttatcaatcatttcatttttccatcaacatcatttgtaatttgtaacctttccccactgagctggcacttaagaataagaacacgaaagaaaagaggctagggacgtatgagggagtgggttgaaaaggcacggcaaggggatgaagaagcgttcgggcagctaatgctgcattttcgcgggatggcctatgcggtgtcctatgacatgctgaaggatgtccatctcgcggaagatgccgtgcaggatgcgttcatagaggcttatcagaatctggagaagctacagaacccggcagcttttccaggctggttcaagaccattgtcgtaagacagtgccagcggacgctgcggcgcaagcatcattcgatgcttcctctggatgaggctgtgcaggtatcgggaggagtaccgggtctggcagaaattgcggagcgtagagaagagagccaagttctgcaacaatcggtgaaggcactgtctgccaagctgcgcatgcctctgcggctgttttatttttacggctactctcttcaggaaatttccgattatctgggcactccggtcccgacgcttaagaagcggctgcacgatgcccgccgaaaattgaaaggtacactcccggtggccgacctcgtctccgtgttcaatcatttgtatgagggagggcaaaacatgctacatattgttaacggtgatgttgtaggtgacatgttgaagcagggtgttgtacaaggtgacgtgcttgtatggagagaggtatatccggcaggaccgatatttgcaaatccagcgggagctgaagaacgggcactgcgggccagggtgttggaagaaacgatgggtattccggccagcgaatatattacggcatgtgaggaacaagagcagaaacttcgtgaatttatcaagtatgatgaagtcgtattgtggtttgagcatgacctgtttgatcagagcatgctcgcctatctgctccactggttcaagagacagaaactgggccgcacgaagctgagcctactctgtattggggagtttccgggaattgaacggtttcatggtctgggacagctcactccggcacagcttcagacattatccgggacctggcgaactattgaacggcaagaaatggagctcggaagcgagctttggcaggcgtatgcttctcctgatcctgctcaaatggctaatctgctggaagacaagaaggcagaattggcagcctccggcctgccttttgcctatgaagccttcacagcgcatctcaagcggttgccctcggagcggaatggtctgggcattgtggaacagaccacgcttcagaccgttcataatggagtggatacaccattgaaattatttcgtcaggtaacagacgttctgcatgtgctcggcatgggtgatctcgaatactggaaatttattcgtgctttggcgcaaggcgaacatcctttgctgatcattgacggggatgaggtcggcttggatttcagacaaattccagattttctgaaccgaaaggtaattctgacagagttgggtaaagaagtactgaatggatcagcggaccgcattgcagttcaaggaatcgacgagtggtttggggggctgcatctccatggacatgaggtttcttggcgctgggatgatgtagccggagaattggtggtccgacattgaacaagctgtagcagtaaatagcttaacgtgcgaaggagttttccgtttatggaaaactcctttttattttttaagtacaccatattataacaagaaaaatcaccgggaataggttaggaacttagctatccggtccaatgaattgagtttcctgtatatgaatagaccccccttaggatgatgattcaagttaccaatgcttctactgcttcacatctgtaaacagctcctgcgcggtccgcacaaataactgtacagcaagtgaagcattgtgcagggacggtacagctataccgatttgacgtgtgatcagaggcgaagtttccttgacggtcagattatgagggaacgtggacaaggcaagcgaagaaacaatacccatacctagtccctgtcgaaccatgctgaccaaggtgctgatattatgagtaatgaactgtgcctgcaactgactttgctcgcgttcaaaaccttccataatggcgacttcatgtccacctttacaaaagatcatatcctgctgattcaagtctcgaatggcgattttattgtgcgattgcaaagggtgaccgtctggcaggagaataaccatgtcatcctgacataatgggattacatctacctgagggtctggcaacaggatgatacccgcctcgatttctctggtatgcacccactccttgacttcattcgtggagccttcatgtagatcgaaaacaaggttcggataatgctgacgaatatgatgaataatcgggggcagaaaataggctgaagcagaaggaaaggcaccgatcgtgattgtgcccacgtctagacctttttcagcagccacctgctgctgtaccttttccatgctttgcatcatcatacgaaattccagcagtactttgtgcccgatatcggtcagcagcactcctttttttcggtcgcgcagcaatagctggacatccagttcgttttcgatgctggcgatggcatggctgaccgcgggctgcgtcatatgcagctcatgggcagtttgggtgaagtttagcgtttcagctacgcgaacgaagatcataatttgagtaatggtcataagtgaaaagttatctcccttattgaaaacattcattttatttattagtgaccacagtataagctagtaaagcaaaactttgcaaacggctattcagattttagtcgtaagcaatgagcgatgaaaatctaagggagagaagacatctatgaaaaaattaacacctaaagctacgctgtggcttgtcttgatattagtaatggtatgggggatcaattggccgttgaccaagctggctctgccagatacgccgccgatatttttttcaggaatccgtaccctactgggtggtgtgattctgctgttgttcgctatgcgtaaccgggaaaccttacgccttagacagaatgggtggacttatctggtgctggccatatttaatattgcaggctactatggcttacagacggtagggctgcgttatttgcctgctgggttattttccactttagtattccttcagccgatcctgttgggattattctcctggatgtggctaggggagcgtatgtttcccctgaaggtggttggactggtgctgggttttggcggggtgattgtgattagctctggtggaatggcaggacatttgtctgtactgggcattgtgttggggctagcttcaggactatgctgggcgctcggaacaatttatatgaagaagaaaagcaagcaattagactccatttgggcggtgacgatgcaactcatttttggggggatcatactcaatggcattggatttacgaccgagaaatggagtgacattcactggacgacctcctttatcgcaattttattgtttatttcgatattcgtgattgcgatgggctggatgatttattttaaactaatcgacaacggagatgcgggaaccgtcggctcctatacgtttatgataccggtgttgtccacggtctttagtatggtaatgctcaaggaatcacttactttgacgtttgttgtggggctggtgctgattgcaggcagtgtgtatctggtaaatacagcatctcccggaaaacggaggaaccgaagctccaaggctgatgaaacgaattcctgtacaaatgcatagaaatacgggattaggaaaaatatactagattaacagagaggagaatagtaaaatatgactatataagtagagaggaagtttgatatgggagaattaagcattcatactcagtctgtggagccgcaaccacattctgttcgtaagctcgcagttgtagcaacagtcatttcaggagtagcggtactaggatgtatagccttgacggtatggaattataatctgaatacgaaggtaaatactttaactttagcgaacgcatcactaaataagacaacacaagcattggcgaagcaacaaaacgatacagaggcgctgctgcaacgggttagattagcagccaacctgtcatctatatcgcatcaattggaacagacatctgtcgttactgatgattttgtattggaaaaagtgacctttgatgtagcagagaacggtacgttgcagggtgtgcttttaaatgtgaataatcaaccaaatcttggttttggcggtgcctatcaaggttatggtaaatataatatggcttctgctactttgacgaagaaggcggaggaagtcataaatatagctatgaaagagtacggtacatctgacaagcttccgctatgggataagaatacgaaggtggaattgacggttcaaaattatccgcttggtaagcgggaaggcggcactttcaaactcaccggtcagcaataggaggaacctatgaaggattttgacgtaaccaaagccaagtatgacccaaaacaggaagaacaggtgaaaaagggatttttcaaaaaggtaaagtctacggctggaaaagtgccctttttgaaggatgctgtagccatgtattattgtgcaatagatcctgaaacgcctctttatgccaaaggggtagcattcggagccttggcgtattttatttcaccattggatgtgatttcggatgttattccgatgctagggttcacggatgatgcgggggttgtgctagcagctttgaaagtgttggatatgcatatcaagcctgcccatcgggagaaggcgagcgaatttttttcttaaggattgcaagatgatgcgggggagaaggaatggacagatatacacctacagcgagggaacgctggcagatgaagcagagtgagccgcagcagcaaggatggctgctcgctttctttggctggatttttgcaggtttggggttcatatttagtttttttgtctttggaggattgttgggtgtcttaggtttggttttcggaattttaacgaaacgaatggaacaaagaaacacgcagggtatcttcattatcgtaatcagctccgtagctattggtattggactattgatttttatgattttttttgcgcaaggttttgtagagggtctgagagaagggtataatgagcagtattaggtcagggaggtaacagcattgagcgtcattatttcacagcagatctcggcaacgggcgtgaaggaatatacgaaggtgatgaaaacatttgattcccagtttacacctttggttggacagaaaatcagggatacggcatttggcgatatgcaatattacgatgtcgaggacgtatttattgatctagcggagaatgaatattgggtaattctacctgccgttttgctgcattctgatgatattgaggatatacgagacgctgtgcgtgagtatcgttcacatggttgggaatgtacgaagcctctgtaaatgcataccacttgggcatctatacggaaacgtctttcttttgcgagataggcgtttttttgtgtatttgtgtataaactatttctaattattggcatgaaaagaaagaatttatgctgaaaatgcgcaaattgtatcattttttatcataaaacgacaagttgggaaatgaaaacggccttaatgtgttatacttagtatatcaaaggacaagagtctaaaacgaccggtaaggccctttctttgaagagcctctgaaaggttcaacgtttatccaaaataaatggtcaaaaggaaaaggggaaatgctaacgtgagagtgaatttgaaatttactaacaaagggcaagttgcagttgagaagttcaacaatgaggagcttatcgaaatctttacccgctacattaaaacgttaagcaagaagtatgatatctcggttaccgtaccggaggatctgaatgagcagatcttggcagagggcaccgtgaaggtcgtgttggataagattaattgtgacatggacgcttttttcaaggagctgagccgggatatcaaggtgccgctggtcaaaagattgggtaccaaattggataacgtatttaagaccgaggttgtggagcaggaacagaactaagaataaggatcaagcgagtccgaatgaggattcgccatatgaaatgataaaacctcccgaatggggcgcacggctaggccatgtgctcgttcgggaggttttatatgtttaaactactctattcagcagaaaaacatgcatggcatgtctgccccttttaacgtgttgttgtggaagtagggcgcagttgggctaaatcaaacgaaggtaccagcccttcctgcgcagcgcgaccaagcaaagcttcgatggcggcatatccgctgtcgcccaaattggcggtaaaatcgttaacatacaggtcgatatgcgattgggcgacatcgggtgaaagctcctgcgcatgagacaatacatattcacgcgaagcttctggatgcttccaagcgtattcgacagaggcgcgtatccagtttgtgatcgcatccaaatccagcgtacggcgggcaataatagctccgagcgggattgggagccctgtatcttcttcccaccagttccccagatcgacttgcttactaagtccataggacggatacgtgaaccgtgcttcatgaatgaccagcccggcatctatctccccgtcacggacagcaggcatgatttggtcgaacggcatcacgacgatctcgccgacacccccaggcacatgcttggctgcccacaggcggaacagcagataggcggtggaacgttcactcggaacggctacacgcttgccggacagggccttcgggccttcgacggtggaaccttccttggtcaggacgagcggaccacacccccggcccagtgcgcccccgcaaggcagcagggcatattcatccagcacccaagggagtgcagcatacgaaattttcatgatgtccagcccgtctggtgtgatcgccagattgttagtgatgtcgatatcggcaaatgtaatgtccagcgcgggtgcgcccggaatcaatccatgcgccagggcatggaagacaaaagtgtcgttgggacaaggtgaaaaagcaatttgcatctatataacctccgttaatgtagaaaatgcggcttccaacgcttgcaaagcctctttgatccgccaggctgcacggtcacgtggaccgacagcattggaaatcgtgcggatttccatcgtcggcagttccagtctatttgccgccacggctacgccgtagccttccatcgcttcggcagcagctccgggaacgcgcttggccagccgttccgctgttgccgccgtaccagtggctgtggaaacggtcaggatcggccccgcgacagccgtctgtccagcaccgcgcagcgcctgaacgaatcgctgcgcggtggcaacgttcacggcaattcggcttgagccgaaacccagctcgtccacgctgctgaagccctctgccgtctcggctcctaggtcggcggcaatgatcgcgtcagcaacaacgacgctctccagtgcagcgacctccacgaagccgccaccaattccggtgctgatgaccagacggtagtcaccggccgccgccagtgctagcgcggttgaagccgctgcggacgatgcgcccacgccagccagctcgaccacaaaacgggtatcgccttgcaggccccgcagtacagcttcccgttcggcttcaaccgcggtcataaccaggatgcgcccatctgatgttgtatgctccatcggttgattcccctttaaatttaggtaatatgctcccttatcatactgcttttcgaaacgatgttcaaaaaaagtcgacaaaaaaagcgctccgaggcgctttttggaaaaaatgcaagattcagcagatatgaataatcggtagttgtaaacattaaacaattctaatctggaagaacagcgcaggcatagcatataataattatatcggctgatccttcgtgatcaactgaaacatggtgatattgcggtcataatggcttggggttccatcttgattgcgcacccgaatcatctcgctactgaataattcgatatatccacagccaatctcacagtatacacctgtagggtcctcttgccagaccgaaacgaggtgttgagatagcgccgcggtgaaaaattcgatgtttttttgcagtacgcgtggcgttttcttgggttccataacgtaaatcctccctatatcatgccatttgaaaatcagcaattgaacgtggctactaagtgattactacacatcataatgaacataaaacaactgaaaaaggaacggttcgttaatctactctatgaaacagacgtaaacactgtaccgcttaatgctatttttgtaaagcgtccgattgaccttttcaaacatccagattgtgtttacacacattttacattgcgtttacactgctgtgatgctagtgcgtttcatctaatagtacaataaagggatactatactgcatgaattgatggaggccatatgttgatagagagtcagaataaggataaagccgggtcagaacgttactttaaccgagatttaagctggattgaatttaatcgccgtgtgcttcaggaagctcaggatgcagatacaccgttgctggagagagccaaatttctggcgattgtatctagcaatttggatgagtttatggctgttcgtgttgcagagacgcgcgagaagatcaaggcgggttttatgcaaaaggattttacgggatataccccctccggtttgtacaaacggctgatcaagcgtaccgtctcgatggtatcagaacaataccggacctatcgtgatatttctcgcctcttgacgaaaaaaggtcttttactgctcgaatatgaagacttaaatacaacacagcgcaagtcgctggatgcatattttcatgaaattatatttccggtacttacgccgatggcggtcgatcagagccgtccttttccactcgttcacaataaatacgtatatttagcggtcgtcttgagacgtcccggggatacggaggaggataaaccgctttttgccattgtgcaggtgccttcgaatattccacgtgttgttacggtgcctttgcggtcgaacagcaagaagaaatcatttattttaattgaggaactaatcaagcatcacatccaaacgctgttcaccggatatgttccggaggcggttcatgcctttcgtgttacgcgtaactctgatttatccattaatgaagaagagatcgaagatttgctcgaagagattgaaaaagagctgcgtcgaagacgccggggggcgccggtaagactggaagtagaaaaagggattcatccctatgccttgatggagcttcaacgcgaattcaagctgttcgatcatgtgtttgagatggacgggccgctcgatctgacatttttgtcgtcttttgccgatcatttggaggggtattcgcatttgaaatttccggcaatcaaaccactgtatccggaagaactgcccccacaagaggatattttcaacgtacttcgcaaacgggacgtgctcgtgtaccatccatatgaatcattcgatgcggtaactgattttattattgaggcatcagaagacccggatgtgatggcaatcaaaatgaccctgtaccgtgtcaacggggaatcgaagttgattccggcattggcacgtgcggccgaatcgggcaagcaggtaacggtggtggtggagctgaaagcccgttttgacgaggaacgtaatattgcctgggcgcgtaagcttgaaaaagcaggctgtcatgtagtgtatgggttggttggcttgaagacgcacgccaaaatcattcttgtcatacgccatgagcgtaacgcactcaaacgatatgtgcacgtaggcacaggcaattataatgaaagcacggcgcgcgtgtatacggatatcggattgtttacgtcagatccggtacttggcgaggatgcctccgaactgtttaatgaaattacgggattctctgcgctcaagactttgcaagcttttacggtggctccaacgggaatgaagaacaagctgtttgagctcatccgtagggaagcagagcaagcattggcaggtaagcccgcccggattattgccaagatcaactctttatccaatcaagagatgatcgatgaactatatgcggcttcccaggcaggtgtgaagattgatcttatcattagaggggtttgttgtttgcgtcccggtgtggaaggattcagcgagaacatacgtgtcatcagtattgtagaccgcttcctggagcattccagattgttttattttgaaaatggagggaactccgagttatttttgtccagtgcggattggatgacgcgcaatttgacccgccgaattgaactgatgtgcccgatttatgatgacgggatcaaagaaatgctggcagatattctgcatttatcgttaagggataatgtgaaggcacgccagcttttgcctaacggcagctatcaatttgtgtccagaaacgacaaagaggctcccattaggagccaatctgaagcgatgaaggttagaaattggaagaaggtagaatggaccacgacaatgtaaggttccacgccttttgaaaatccttggcaaccgattctagctcccgttgttctaatatgggttcactcttgctttccagacgaagatgcagtgcgtcatcccctgtagtgggattgatgctggtaatcattcccgactcactccgatccatgccaatcgcgagctggagcagcgagccgagccgatgtacacgttcctcgtcggaaggctccaaaatatcggcatgtgtgcgtagcaaacggggagtccggttcttgggatggtaatccgcgatcaacgcggctagtaccgtttccctatgggacagaccgccaatgcctgcatgtaaaatccagaacacggaattctggcggaaatgataataattcaaggcagcccccgttttgtaaagagttgctgcggtcagtaacaagcgtttgtccatagcagctgaggttccgctagccaatgtgtcatagagccggacggcgtactcgttaacccgcttgacatgcgcttcgctaactgggacagcaaacgaaaggatattgcgaatggatgtgataagcggattagctaccacgggctgttcagcgttgaccagctcatgaaataggccgtctcgcagacccgctccactgaccaaatacgcggagccttgagcagcttcaaatatcgttttcaatataataagacccggtacaatgatgtcggctctgtccttggacaggccggctgtttttttgcgtttttcatagggaagatggggcagactgccatagaagtaatcgacatcttctatcgtcatttcgtaatggtgcgttacaggaagtgagtaatcctgtcgcttctgattgattttagccaaagtacgcagggttccgcccagcccgatgaatggcagacccggattggagaagatccaatcatgattttgcagtgaagaacggacaaagctctccatttcctcaatctgctgaggagaccattcgccattcttaacctcacgtccaaagcgccaattcatattgacggcgccaaagggaaatgacaccgtatgcagtcgctctcgatcgcggaacagcgtaatttcggtactgccacccccgatgtcaataatgattccgtcactcacattcatagtgttcactacgcccagaaaaccggcatagccttcttgctccccgctcagtatttccagtgttaaatttgtctcctccgcgatccattggacgatttcgtccgaattcgtggcattgcggatggctgctgttgctgctgcacgcatacggacaaccccgtgcatatggcataccgccataaattggcgcagcaatggagcgatgcttcgaatcgcctcccgttccatacggccgttggccccaaccttttcgctcagtcgggcagcttctttgcattcctgcacaattcgataggcccctgtctctgtcatttcatagatcaccagacgaatggagtttgagccaatgtccatgatgccaattttgctattcatgagttgacctccttgttgaaaaaacgatttgccggtaatttccgttgctccgtgcaaatggtagtagattattgtcattgtaccagtgatgttcggtgcatgctaccgttcgccatgatcttgtcgaaataggcacatgccgcggacaatcatccaagaatagaacattcctattgagtatgtataagtataactgacggcgaaaggagagggttagatgagacaacttgcaagcaaatggctaaagacgaaggcgctgctccaccatccacataccgccgtttatataccggaaacctgtctatatagtgaagaacaattgcgcatgatgctgcggcggcatgcttttgtatttataaaacctgtgaaaggaggcggaggagtcggagtcatgcgtgtggcaaaggagcgtaggggatacacctgtacgcgtatggagcacacgcaccggttcagtcattttagagcgcttgtaatcggaatccataagctccgaatccaacgtccatatctcattcaacaaggcatccaactggcaagtattcaaggtagacctgtcgactatcgagtcaaagttgtgaaggaagggcagaggtgggattttcgtgcggtggttgcacgtcatgctcggcctgggctggtcattacgaatctgtgcaaggggggcactttgctgaagggaacagaggcacttcggatgatatatccccggcggcttgctattcaaaagcggcgagagatcattgaacttacacaacgctgtattcctgtactggaaaggagatttcccgggatcggacaactgggatttgattacgggcttgatcagaatggacgggtatggattttagaggttaatacaagacctcaataatttctgttttcttcaataaaattccaatttaatctattaacaagacgctaaatataatatatttgtataaataataaaaatattttttttgtgttcgagcgtcaaaattctgtgtataaatattgtccacattatcccctgtcacatatatgggttaacgacacttaccaacaatttatacacaggatttccacaattgactgtggataacagaacgcttgttccgattttggtattttgatagaatagattttgaaataaaaggaaaggttgtgtcgaggatggctatgctgacggatgaaatgcttttggattcctatcagatggcaatcgagcttaaacttgaatgtgacttcattgcactgttgctggctgagattcacaaaagaaatctagagatgaatacagccgtagtccttcattagaccggacaagctctcgtactgcgactgtaaagtcattcagggttcgaatgactttacagacaatcactgcaacgaataggcacaccgtaaaaaagggtatttcactccaaagattcaaatttggagtaaaatacccttttttgtcatagtctaaactagactacaatttcatgttactgctgtggccgggagacaacttggcatctggatctacatagaccttggcgttgttgactgccgtaggagcttcaccaaagccgaccgcaatcagcttgagcttgcctggataggtcgtaatgtcccctgcggcgaaaatgccgggaatatttgtttcctggcgagagtcgaccacgatagagttactttcgatttcaattccccattcagcaatcgggccaagtgtggatacaaatccaaagttaacgatcacatcgtccacttcgatttcctgtgtttctttggtttttacatgagcaagagtgactttggtaattgtgtcatctccatgcaattctgtaatttccgttggtgtaataacgtttactttggaagcgaggaggttttcgacactgtgttcatgcgcacggaatttgtcacggcggtgaatcaatgtaacctgttctgcaatcggttccagcataagtgcccagtctacagcagagtcaccaccaccactgataagcacttttcggcctgcaaatttgctcaggtcgctgacaaagtaatgcaggttcgttttttcaaaacgctcggcacctggaagctccagtctgcgcggctcgaaagcaccaacaccagcggtaataataaccgctttaccatgatactcgccacctttgtctgtttttacaatgaagtggcgttcttcctttttctctaacgatacgactttctcttctagctgcacctctggattaaagtggttcatttgttgaaccaaattgttaaccagttcttgtgcagtcactttaggaaagccagcaacgtcataaatatatttttcaggataaagggctgcaagctggccgcccagttggggcatactttcaattaaggtgacggatgcctgacgcattcctccgtaaaaagcggcgaaaataccggctggaccgcctccgataataatcagatcgcggatctccgcacctgtggattgagctgtcactctaaaaacacctccgaaagggatagtatgggatttgtagatattgaatcagccgcatagaggttcagatagccgccgaacgcatgattcactgtttatcattataaactgctgggttccgcttgcaaagttaaagcgattaatatttgatgaagacttttctgtgagtatcaattaaccgttttgagagaacagctgtgaataattaatgattatgattatgtatatcggaaggggtagaagcatgagcagtattcccaaaattgtcattgtgggcgccggatatggcggtatattgacggctcaacaattgcaaaaggagctcaagcacaatgaggcggatgtcacgctaatcaaccgtcatgattaccactatattacgacacatcttcatatgcctgcggcaggtacagatacgattgaacattcaaggattccgattgctcagctaatcgatgagttcaaggtggatttagtcaaaggaacggttaaggaaatcataccaaaggagaaaaaaatcgtgctggaggatggctcgctgtcctacgattatttggtcatcggactaggcggggagccagaaacattcggtattccggggatggataagttcgcgctgacgattcgcagtattaactcggttcgcctgattcgtgagcatattgaataccaactggccctgtataaaaatgacggtaagccaggtcgcctcaattttgtcgttgggggcgctggtttcagcgggattgagtttgtagcggagttggcggatcgtttgccacagctcgctagagcgtatgacatcgattttaaccggattcaaatcattaacgtcgaggcagctcctacggcactgccagggttcgatcctgaactggtggagtatgcgatggatgtccttaagcgtaaaggggtcaccttccgcattggaattccgattaaggaatgcttgcaggatggtgtaattgttggtgagggtgagaaaatcgaagcctgcacggtggtgtggacgggagggattcgtgggaacggattaattgagaaagccggattcgaagtgatgcgcggaagggtgaaaatcgacgattttctgcgtgcacccggccacgatgatatttttattatcggggacagctccctgatgtttaatcccgaaggacgtccttatccaccgactgcccaaattgcgatgcagcaaggggtcctttgtgctaagaatctggccgctactcttcgcaaaaaggagctgcacaagttcgtattttccaacaaagggacggttgcttcgcttggaaaaggcgaagccgtcgccgtggtgggcaaacgtaaaataaaaggctgggtggccgcacaattgaaaaaaattgtggatctccgctatctgttcatcattggcggaattccactggtactgaaaaagggacggtttttctaacctcagacgagtagtcaacatgcaaaaacaatacgagcagaaaaaggtttccacagctcttatacaggagctcggaggcctttttttcattgttcttgttatcattatagttttagatcttataaaaaaggattccgtcgtcccgaaagtgggagttcacgaaatcctcggttttattcagtaaagagttgatgtctgcatcttacagcttcaacatgtcttcaaatgtctcttcattcaacacgctgccgacatagaaggagccgaattcaccgtaacgggcactgacttcatcaaaacgcatttcgtagattagcttcttgaactgaagtgcgtcatcggagaacagtgttacgccccattcccaatcgtcaaagccgacggaaccggaaatgatttgctttactttgccagcatagctgcgtccaattaaaccgtggctgcgcatcaaggtgcgacgctcgtccatcgaaagcatataccagttgtcgtccaagtcacgttttttgttcattggatagaagcaaatataacgcgccttgtttaatacgggcttcaatcgtgcgacgatttgtggattttgcattggatcttcatctttgctcaaataattacttagttccaccacactcacataagaataggttttggttgtatatttggcgaaggttgttttgttaaagtcattttccagtttattgaggtcttccagcgtttcgcgcaggtgcatcatgacaaaatcagccttttgtccgactacagtatagacagctgagctgcccagacccgcttcctcggtaacgttccattccttcataaactcttgaagctcgtccagtgctccggcgcgctcttcatcgtctgcggtcttccatgctgtccagttgatggaccggaaatcgtgaagcgcataccagccttccagtgtggaggctacttcgttgggtgttgctggggtttgttgtggttgatgttgactcacgatctacactcctttacgatctgtaaatgataatcggcttaaccgaaatatgtgtacttccttatatctttcctgtatccaatacgtgatgcttaaccattatattgtagctcaaagtaaagcttttcaccaatgaaagaagtgtgaagaattttatttttaccatgatgcaggtcacaaagtcataaaatagttagtattctcgaaaaaagtagaactcagacgaatatggctgccaaaaaggagaacaattgcccttattttgttggtcccacgagaaggcaagtatgatagaatagaaaaacatcttggagaccgttatatcaggaaaggaagaatgttggaatgcggatgaaaaacctgctgcactatactgagaaccaccgctattgcgtttatcgggaatttggcttgagcgcactggatgaattgatgctgggaagcgtctatcagccgatggtaggcgcatttgcggtcagtctgtatcgactgttgttccagcatgtgccagttggacaaatcggttattcgccgttggaacagcagcgtcgcctttttctgacactgggactggagccgagtgagaagggacgcaagtatttgattgaacagacctccaagctggaggccgtcggtctgttacagacgtccaggctgtatgcacccgaaacggacgactatatgtacgaatatgagatgcagccaccgcttgcacctgctgaatttttcagaacacagcatctcacccttttgttgagagacaaaatcggtaagtttgcagtgctctctctgagagaatcgttgtggagcagggaatctagcgaatggtcgcaatcttcctataataaagagaatatttcgattcctttctacgagttatttgaactgaatacccatgttatagattatgaactggagcaggcgctgtccgaggtgtccactagtcgtcagactggagcactagcgtcagaatcggaggaagcattgaattatgcagatattattctccgttttccgcgtgaatctgccaatcgtaagcacgtggaacgtcttcggtttgagcacgagcagttaggcatggtcaattacgttgttcgcaaatttgacctttctgtacaggatatcagtcgcttgctggatgaggatggtatttttaccgaagcaggcgatttgttgctcgatgagcttcagcttcgagctagtcagcactccagacaggatcggaagcgtcaggaggaacagcaggttcaggccgccaaagtggtcgccttgcgccagagggaaacttccacatctgaagagccgcctgcagaacaggctgtggaaatggaattttatgtggaggttccaccacaattcacagccaaatgtgacattcaccagtataatatgatgttgcgcaacgagccttatcgtcgcttgctgcaaacctttttccctggcacggttcccggtaacctgctggatatattcgagaaaattgatatcagctataagctgcccggtgaagtcatcaacgtgctgatccattatttaatgtcactgctcgtatctgggagcgatcagcggattaaccgcaactttgtcgaggccgttgcttccaacatgctgcttaagcaggtaaacacttacgaaaaagccgttcaatatataagggatcaagccaaggtaaaaggaaaacagtcctctgcttctccttccggcggccgatcccgcgcatatgccaaaaataatgggcctgccaagccatccattccaatcgttcaggatcacccttccgaggagtctgtatctgaggaagaactggatgaactgctgcgtctggccgaacgaatgcaatccggtaaacagaaaaaggtgtaggtgtccataactctgcacattttagaaaggaggagcgttcttggaatcactgggcgatttgctacagcagatgcagaacccttcgtttcgccagcgcactcgcaatgtagccgatcaagttctaaatgatccgctcgtgcaggagttttgtgctgctcatcctgatgtggacgaaacacaattgcgactcaacatgagcatgctctttcagtatgcccgggatcgtcgaaattgcgacaattgtccggggctggaacgatgtcctaacgattttcagggccacttttgcaagctgggcgtggaatatccgaatggaatagccgaaatcgtggacattcggaccccatgtgcgaagttggttgcttcccaacatgaacaacgggtgcgtcagcgaattaaaagcttctatgtggatgaacgcgcccttctggagggatataacgctcttgaaattgcgcgcaaagattcacaacgtatgcctgccgtcacacagctattccgttacattgaagagacgaaaagtcagggtctatccaaaaaaggactgtatctggaaggtacatttggtacgggtaaaacttttttgatgggctatctattgcacgagctggccctgtcgggtctgaacggtgtgatcgtgtatatgcctgattttgtggaggacttaaagtccatgattcaggacgggcagaagctgaaggaaacgaccgaaatgctcaaaaattgtgatctgctcgtatttgacgatattggtgccgaaaatttaagcccgtgggtacgggaccatgtgatgggctccatactgaattaccgaatgaatcgcaaaccgaccttttatacttccaattactcattgcaagggctggagaagcatctcagctttacgagcaaggacggagaggaaatgtacaaaggacaacgcttgatggaccggattcgtccttttgtagatgtcattaccgtaaagggaaaaaatcagcgggggtaagcgtttttccgtctgctattttgatatcttacaattaaaagactattgtgatataattaaaaggtgtcgaaacagacattacaggttataataatcttgacttttctataaaggaggaacatacaatggcaattgttaacgtgtccgatcaatccttcaacgcagaagtcgaaggcacaggaaccgttttggttgatttttgggcgccatggtgcggtccttgcaaaatgatcgctcctattctggaggatctgtccacagaagttggcgatagcgtcaaaatcgcaaaggtgaacgtggatgaaaatccagagtctgcttcccgtttcggcgtgatgagtattcctaccctgatcgtcttcaaagacggacagcctgtcgataaagtggtaggtctgaactccaaagaagcactgaaaagcatgcttactaaacaccaataatcatcgcatgtgacccatgctcccgcgggggcttggtggagcggccatgaaaggtcaatgcctccggttgtaaataccgggggcgtttttgtgtattattcctatatattctaagtagttagttgagtaatcattaagaatggaaggaggaacagggcgaatgaaaccttatgcggaggacttgcaggatcaggaaaaggcgctggagaacatacggcacaaattagcgttactgccggatgcatcaggctgttacctgatgaagaatagcgaaggcaccattatttatgtcggcaaggccaaagtgttgaaaaaccgggtccgttcctattttacaggtagccataacggcaagacgcagcgactggtttccgatatccgtgattttgaatatatcgttacaggcagtaatatggaggcgctcatcttggagtgcaacctcattaaaaagtaccagccgcgttataacgtgctattgaaggatgataaaacctttccgtatttgaaaattacgaacgaggcacaccccaagctggaggtgacccgtcgcgttctgaaagataaagcaaaatattttggaccgtaccccaattcctacgcggcacatcagacgaagaagctgctggatcgtatgtatccgttacgcaagtgtggtgtaatgcccaaggaagtgtgtctgtattatcacatgcatcaatgtttggggccttgtgtgaaagaggtcgagaaggaaacgtatgaccagattggtcaggagattggttcctttttgagcgggggacatgaggaaattaaaaaggatcttcagcgtaaaatgcaggaggccgcagaggaattgtattttgagcgggccaaggagctgcgagatcagattatcagcatcgacgcgatgatggaaaagcagaaaatcaccacatcggatgcgaaggatcgagatgtatttggtttttcagtagataagggctggatgtgtgtacaaatcctatatgtccgcaaaggtaaaatgatcgagcgccatatgtcgacttttcctttctacggtgaggcttacagtgattttatgtcctatgtgacgcaatattatagtgacaacccggcagtgccgcaagaaatattgcttccagattctcctaagctgatgcaggccgaacaggtcaatgtcgatcaaccggttgcggcagaaactgtactccacagtgcagctacaaccgatgctaccggacagacagatgagaaagcgatacaaacggagacagagccttctgctgactcattgctggtggctgaagaacgggcaacttatgcagcagcaacaaatcaagaccaagttagtgaccaagataccggagtaaaggaaacagaaacccaactatccggtggactggaggacccgagtacggcggctctcgctctggctgaatggttggatgtaaaggtacttgtaccgcagcgtggactgaaaaagcaaatgacaggcatggcgacggaaaatgcacgtgttgctttggatgagaagtttaagctgatcgagcgggatgaggaacggacatccaaagctgcaagcaatctcggacgtgccattggactggatagcttgcaccgggtggaggcgtttgataactccaacatccagggttccgatccagtctcagccatgatcgtgtttattgatggcaagcctgccaagaaggagtatcgaaaatataaaatccgttctgtgcagggacccgatgattatgaaacaatgcgtgaggttatccgacgtagatatgaacgtgtgcttaaggaaaatttggaacgtcccgacttgatcgttgtcgatggtggacgtggacaaattaaggcggcgaccgatgtattgcaaaatgagctgggtttgttcattcctgtgtgtggtctggtgaaggatgccaaacatagaacttcccaactattagtgggagagtcctctgaggccgtgacacttgcacgcaatagcgaagaattttatctgctgcaacggattcaggacgaggttcaccgttttgccattacgttccaccgcgagcaacgcggcaaatctatggtaacttcccggctggactctattccaggcatcggcgagaaacggcgtaagttactgcttaagcattttggatcgctcaaaaaaataagagaggccagtgtcgaagacttccggcctctctctattggggataagcttgcgcgtcagattatagctgcccttcgggaggaggagtcgtagaatacggctcctctttttttataggttcaaacataattcgatttggctttttaggactaaaccaataaatgatgtaacccacgatggctggaagtaagatccagaatagaccagcgctcacattcacagtgtctcccagactcatcacactaagtcccattagaatgctgtcaaaaataacgtggctgaacatggcggcaataaagccgtaacgcaggaacacaaaactgaacagcaaaccaagaaaagtcagctcaataggtctggaaatcaccggatagatcggataaagcgtatgtcccagtgcccaaatcagcgtggtgatcagacaagcaacaaaagtgtttttcactatttttttgaccatcggaataccaaacagacggtagacagtctcttctccaatacctgccatccacgccataatcggcagtagccatggataagccatattgtaaggggattgtgtggcatctgtggtggagaatgtattaaatgtgcgctccagtataaagaataagatggattgtaccccgagtaaaataaaggcccacaagtagccaacatacatactgcgaagcacatacaacccgtagcccggctcttttgcacgcggccatgcattcagtccaacctgacgcataagcccgtcaccgccgaccaaggagaagtagagcgctacagccatgaaaaaggtaacaccaatctggaaaaccataagaaatataagcatgcccttaccgcctgcttctgcttgcaataaaggcagcatgttcatggtcccagctatactagcaataaagtatacaacggatagaacaatgccgcgtacaaatgaagtatgtcgtcgggtgagtgacgcatacacaatggcaagtacacccagtacaaagctaaatagggcataacccgcataggtcatcaaattcgcccaaaatgtttgcttttcgatataatcggtataggacgacggggccgaaaagctttgggtgaaggagcgaacatcaccgtcttcaaaagtaaaagccagtgtaagtaccgaggcgccgatttttttatcgtctacggtatactttaatccgccttcttgttcagtggtcgcaagcttcaaatccgacggcttaaagccaaagcgcttgacccatactgcggccgcctgctccttggcttcgagcgtcatgccgtcctcagccacacgtacaagcctgttacgtgcttgttcatccgtagaaatatcagcctgtgtgtaattggtgctggaggtgatccgtttaaagctaacgaccttgccagtggataaatccacatgaatttgcagtttactcttcgctgaggattcaggcagatcgacccgaaaggtttcgtaagggtaactttttttccatgtacggtcgtactgttgaagtagtttttctctagataaataaccgtacaaatctgtttcggcctgataggtcacgacaggctcctcaggctgtgattcagtatagcccagctcggagcgggcgaagtccaatgcgtgtatgaccgcttcttgtttgctgatgacctttgcgttcattactgattctggactcggattgctaagcgagggaataagcaattgaaagataaaaaagcaaatcaggccaatcccgcccagcaagcctaattttttgaagttggccgtgagcacgaccggtttcccgataggattcatgagtttcctccttaatctgtaaataagaacatccattaaagatatcatactgcacaggttcgcgccaacagacaagcgatattcatgaaaatagagtgaaagcactttaaagttccaataaaattagataagctgcgattaaacgatgcccattcgcaaaataaagccaatttcacgttttttcggcgaaatcggttttgtgatctggatatagaaggattataatcttgaggcaatgcctatgaaatacataggtaatgatatacagttgagccgaatttctatgggaaaacgggggaaccatgttactggggtgaattttacaaccgatcctgctggatcggaagtgtaaatagggcatactgtgctgcccgaatccgtcagctaacctcgtaggctatgagcaggaaccaagtcaggcactcggttttccggtgtctttttttgtgcgtataaaagtgtttggattggttagaccgctgcgggtgcagattattcttccgattgctgttatccccggatttttttattgtataccccctttaatggttaaaatccggagataaaggcaaacgcttcgcttcttcagaacaattctgcccccttcgctactgcccgccaatagcacagggggccgagtagtgcttgacatgcattcttcctgtattcagggaatgctaattatagttaactaaggtttggaaaaatcaaaaaattcaggggcaacgacgatcgaaagatcaaatggaacgcgtagcgagcttacaccgtattaaatcactgatttatagttttaaggattaggagagaagtgatgaatagatgaatcccaatgcaagctggcttcggctttctccaccgcagatattcgttgcgggctttgccattatcattctaataggtagcttattgttaatgctgccgatctccaatacaacaggaaagccacttgcgtttatagacgctttgtttactgccgcgtccgcgacgtgtgtaacagggcttgtcgttaaggatacagggacctttttcacaacctttggtcaagtcgtcatcgctgcactcattcagattggcggtctcggctttatgactatggctaccttgatcgcgctggtgttcaaacgtcggatttccttgcgggagcgcctcattttgcaggaagcgatgaatcagacttctgtagagggaattgtcgggttaatccgtaaggtattgctgtactcactggttattgaaggcgtatgcgctacgatattctcggttcgctggtcctttgatatgcccgtaggcagggcgatttattttggaatctggcatgccatctccatgtttaacaatgctggttttgatttattcggtgaatttcgcagcttgacaggttatgtatatgatccgattgttaattttaccgcaatgtttctaattatttctggcggcattggttttgtagtgatgtcagacctggcagaatatcgcaagcgcaagagactgtccttgcataccaaggtggtactcagcatgacgggcgctatgattgtagtcggcacgctcgtgatttttgtatttgagtttacgaatccaaagactcttggctcgcttgattggggtggtaagctactgggatctttattccagtccgttaccccccgtaccgcaggtgccaatacgctggacatcgcaggcttgcggcaggctacgcagttttttatcatcatactcatgtttattggggcttcccctggctccactggaggcgggattaagaccacaacattcgccctgctcattggagcagtgatttcgatgctgcgggggcgggaagatattgtgctgttcaagtaccgacttgcgcagggacgaatttacaaggctttgaccattacactgctggggttgctgttcgtgatcggggtgaccatgattttgtcggcaaccgaagatcatcattttctgatgatcttgtttgagacggtgtctgcgtttggtacggtggggctgtcgatggggcttacacctgatttaacagtcatagggaagctggtgattaccctgacgatgtttgcaggtagactggggccactcacgctagcttatgcactggggccgaaaaagggtaaagaattgtatcgtcatccggaaggcaaaatgattataggatgaatcatttcatatacatttcgttggtttaatcatttcaggattttgcaaaattcgataccagtcgcttcgaagtcaagatatagacgaactaaaccatttcgttctatatcttcttcattggaagtcgcttatgggatttgtgcaaaatcctcatttatgaaattgattcagataagggagttttcgagtagatatgaaaacgcagcagtttgtagttattggcttggggcggtttggctcaagcctggctttgcaattggtggatatggggtgcgaggtgctaggcattgaccggaatgaggatgttgtggacagtatgagtgagatgttgacacatactgtcgtggcggacgctaccgatgaagactcgttgcgatcactgggcatccgtaatttcgattgtggcattgttgctattggtgatgacattcaggtaagcatcctcaccgccattttgctgaaggagctgggtgtgaaaaaagttgtagccaaagccatatctgtgctgcacgggcgtgcgttagaaaagctcggtgtggaccggattatttatccagaacgggatatgggtatccgggtggctcaccagctagtcacgcctaatttgctcgattatttggagttgtctaaggaatacagtattgtggaactcaatgtacctgcatgtctgaatggcaaaacgctagcagagctaaatgcccgtacccgctttggttgtagcgttgtggcgcttcatacggcgaacggtatcctgatcgcaccgacggctatggatcggctaaaagcagatgatattatggtcatcatcggttcgaatgacaatatcggtcgctttgaggatgaggttgttaatgttaatgaagaggattaaacccactacaccatacggtagcctgcaaacgacgcccgtgtctcgctaatccagcgtcgtgctgtcggaccgagatcggtcgtctccgagtaaatgagggaggtcgttcggcgtgtctccttcaaatcgggcaagtacaatgcagtgagtccattatcccgtaatagttcgctgcgcaaataggatttgggtagcaaggcagaagccttacaggttggaagcaggcgtacaattgcctcgaaggagtcgatttccatgcggatatccggcatgacgccgctgcgctggaacaagtcatccgtcagactgcggtaccaggttcctttggagaaaataatcatcggcaatccttgcagatctttcatcgaggccgttcctgtcttgacggttaattcatgtccaatgggaacaacgagctccaaatgatcatcaaatagcggaatgcagcgcagtccggcttcatgaatggcagacccgacaataccggcgtctgcttttttgtcacgtacaaaggcgacgatttcatgggttttaccggtgagcagctttagctcggtttgaggatgcttactcatgaaagcttcgacgagggtaggtagcgtcgtttggagtgtcgtgagacttgcgccgagtgtaagcatactctgggcttcatttttgtgctgggacagcttttgtaagaagcgaagctgtcgttgccgttgctctagcgcgaaggtataaacaaatcggccagtggacgtaatttcgagccgtttgccccgacgatcaaagagattcacacccagctcttcctccagcttcgcaattttgcgagacagggcaggctgggacagattcagcagtttggaggctttattcaggctggactgctcgacaatcacggcaaaagcgttcaaatcctcaaacaaatcatccacttcctctctatatgcaaaaaagacataataattaatacgtatattgcaattccattataagccgaaaaggagtaacatgaaagcgacacaagatgttcacacttttgtttttccttataagggacaccttgttggacatttcctgtcggaaactgtcaatttatatgttatattactattgaaaacgctattattgggagaagggagcatgacctagatgagaggattttattccagaaagctgcattcgcttcttggcgtcattccgctggctctattttttgttgagcatttggtgacgaacttcacagcggtggagggcggcaaggaaggatttaatcgcagcgtggccttcctgaatggtttgccactggttattgtgctagaaacgttattcatctacttgccattactgttccacggaatttatggcttgtatattgcttatcaggctgacccgaatgtcaaaagattcggctattcacgtaactggcgctttctgttccagcgtatttctggcgtcattacgtttgtatttattatctggcacgtatacgacacgcgctttcaggtggctctgggtaatgtaacccatgaggagctaggcggagtcatgcatggcatcgtgacgaacccggtttatttcattttgtatttaatcagtgtcgtttcggcatcctttcactttgctaacggactgtgggcatttatggtcagttgggggattactgtgggaccacgtgcgcaaaaagtatcttcttatatctgcatgaccctgttcgtggtggtgtctatcggcttcgtcgcttccctgcttgcattccgcagcgcggaatttcaggaaacggcaactgccttggtgcaatgcagcgcttttaaacagctactataaacgactcatatcaattatacatcgtgtcgagattctattttcaaacgtaaaaggggatttggttaaaatcctgaaaaaaaggagtgagcagaaatggcagcatccaacattattgtcgtgggcggcggtctggcaggtctaatggctacgatcaaggcggcagaggcgggagttcacgttcatttattttctttggttccggtcaaaaggtcccactccgtttgtgctcaaggcggcatcaacggtgcggttaataccaagggtgagggagactcaccctggattcactttgatgattcagtttatggtggggactttctggccaaccagcctccggtaaaagcgatgtgcgaagcggccccggggatcattcatctcatggaccgcatgggcgtcatgtttaaccggacaccggaaggactgctggacttccgccgcttcggcggtacccagcatcatcggaccgcctttgccggtgcgacgacaggacagcagcttctgtacgctctcgatgagcaggtacggcgctgggaatctgcgggtttggtgaccaagtacgagaactgggagtttttacaggctgtactggatgatgaaggcatctgtcgagggatttgcgggcaggatttgcgtacgatggaagtgaagacttttgcggcggatgcagttattttggcgtctggtggccccgggattattttcggtaaaaccacgaattccgtcattaatacgggcacagctgctggtgcggtgtatcagcaaggcgtacgctatgcgaacggtgagtttatccagattcatccgacggctataccaggtgatgacaagctgcgtctcatgtccgagtcggcacggggagagggcggtcgtatttggacgtataaggacggtaagccatggtatttcctcgaagaaaagtatccggcttacggaaatctggtccctcgcgatattgcgacacgtgaaatattcagtgtatgcgttgatgatggactgggtattaatggcgagaacatggtctacctcgatctgtcccacaaggacccgaaagaactggatgtaaagctgggcggcattattgaaatttatgaaaaatttgtcggtgacgatccgcgcaaaatcccgatgaaaatattcccggctgttcattattcaatgggcggcatgtgggtcgattacaatcagatgacgaatataccgggcttgttcgcggctggtgagtgtgaattccaatatcacggtgcgaaccgtttgggtgcgaactcgttgctgtcagccatttacggcgggatggtggctggacctaaggctgtggaatacattaaaggcttgaaaaaatctgcacaagatatagctacctctgtatttgatgcggcagtcaatcagcagacggagaagtatgagcgtattttgcatatggacggaaaagaaaatgcctatgttcttcataaagagctgggtgagtggatgacgaacaacatgactgtggttcgttataatgacaagctggaagctacgatccacaagatcaaggagctgaaggagcgttactctaacattaacatcaatgacgcttcgcgctggaacaatgcgggtgcggcgtttacacgacaactgtggaatatgatggagctggctgaagcgatgaccaaaggtgcgctactgcgcaacgaaagccgcggggcccattacaaaccagacttcccggatcgcaacgatgaggatttcctgaaaacaacgattgcggactggacaccggaaggaccacaaatctcgtatgaagcggtggatgtttcgctgatcaagccgcgtatacgggattattccaagaacaaataacggaagggagtgtatttagatgtcggagcaagcagtgaagtcgaataaaacagtgaagttcgttgtgacccgtcaagctgatcctaaagccagtccctatacggaagaattcgaattggcttatcgtccggggatgaatgtgattagcgcgctgatggaaattcagcgtaacccggtggacagccacggtaaagagacggccccggtatgctgggagtcgaattgcctggaggaagtatgcggagcatgctccatggtgattaacggcaagccgcgtcaggcttgtgcagcgctcgtcgataagctggagcagccgattacgatcgcgccgatgagcacgttcccggtagttcgggatttggtcatcgaccgcagccggatgtttaatgcgctcaagaaggtcaaggcgtggattccgattgacggtacctacgatctgggccctggtcctagaatggcagagaaaaagcgtcagtgggcgtatgagctgtccaagtgcatgacctgcggtgtctgtctggaagcttgcccgaacgtcaacgagaagacgacgttcatcggacctgcggcgatatctcaggttcgcctgtttaacagccatccgacaggggaaatgaatcaggaagagcggctggaggcgttgatgacggacgatgggctggaagggtgcgggaactcgcaaaactgcgtacgctcttgcccgaaaggcattccgttgacaacttccattgccgaaatgaataaggaaacgaccaagcatatgttcaagcgctggctgactgtatagcaaataggttatgcccaaacaggctttttctcaaactggagaaagcctgtttttttgcgctcagaaaagatggagggtaacatggaggaaggagcgcggatagcagttatggtataattatggtattgtgtatcgtttttggagaaaaggaggctggacaggtgactgtgcaaccgataacgaatcgacctgtcactaggtcgggtgtcatgaagggattaaaggagctgggagttcggagcggcatgacattgcttgttcactcgtcgatgcgcagctttggacgctttattccaggcggggcctcggccattcttgccgcgctaaccgaagcggttggcccggaagggacgctggtgatgccgacacagtctcatgacttgactgatccttcgacctggatgaacccgcctctggacgagtcatggtgggaattggtacgcgaggaaatgcccgcttatgatccggcctggacgctgaccggggggatgggcatcattgtagaaacgttccgtggcctgccgggaaccaagcgcagcgggcatccgcatgtttctctggcggcacgtggacctgctgctttgggattactgacagatcatcagctcgactatggtctgggtgagcattcgcctttggcaaagctgtatgaggcagatgcctatgtgctgctgttgggctgcggacatgacagcaacacgtccttgcatttggcggaatatcgaacagcctataatggacgagaagtgatcacgcatcaagctcctatgatggtggatggagcaaaagcgtgggtatcttttcaggattttaatattacctcagatgactttgagaagctgggacttgattttgaacgggactgtccctcagcttttacgcgagtgaacattggagaggcttcatgttttttcgcgaggcaacgtgatttggtagactatgcggagcagtggttgtccacccatcgctaaagcttctggacagtaagaatttctaaaaagtgagatcaaggaatagatcgcaagggggaacgcatatggagaagacgccgcacacccgccgcgagagtcaggatggcccgcatcagggggccgctatccctcccggttcttcgcggcgttccatttcaaatgaacccgctaatccttcgcgccgtcattttttgaaaaaggcggctttagccacagccggaaccgcgcttctggctggaggatatgcttccttatgggagcctaatcatttggaaattacacgcttcaacttgactctccctcgtcttccgtctgcttttgacggaatcagggtcgtacatttcagtgatgtgcacttgggttttcatatggatgagcaggatctgcgcgagcttgcggaccgtatagcaggtctgaagccagatttgctctgttttacaggcgatattgtagatgactatgcagtatccatgaaggctgctgttccagttatggcttcgatgcacgccacacttggcaaatttgctattctgggcaatcatgattatagaggcttaccagccggagttcaggaattataccctaaaaccggatttacactgctgagaaacgagcatgcgattgtagagcttgcgggacagcgtgtagccatggtcggtttagaggataacatcatgggcaagcccaatccgcagcgtgccattcacgggctacctgatgagatgtgcaagctgctgctgatgcatgagccggactatgcagatatagcggcgcaaatgtcctttgatcttcaactgtcggggcatacgcatggaggacaggtacgcttgccggtcattggagcaccaatgccgcctccgggtggacgcaagtacatccagggattatttcatgtgggaacagagagaatgccgctgtatgtcagccgaggcattggcatgacacatttgccgattcgcgtgctgtgcagaccagagcttagtgtcattacgctaaaatccggccaataggccatgatctttttttcatctttatcatatatgttggaactacataaagatggcttgaatgtagtgtagagatgtagtcgtttcggacaaaggagtgaggttcagatggatcgtattgctgtcatttcagatattcatggcaattggcctgcctgtgaggcggtgctggaggatattgcttcccgaggcattagccgtgtgttttgtttgggggatctgatcggcaaagggcctagcccgtgcgaggttctggatgctgtccgtcaacgttgtgaagtggtcgtgcgggggaattgggatgagctggttagtattacggatgatctcaattttagctggcaagccgagcgcttgggggcagaacgagtgcagtatttggcacagttaccgtttcattatgatttcagaatgagcggacgccgtatccgtctggtgcatgcctcgccgcaaagtgtatatcaccgtgtgcagccatgggatgagccggaaaaacggcttgccatgttcgatccattagcagaagaaaatggaaaagttgcttttgctccagatgttgtgggatatggtgatgtgcacaatgcttttatccagcattttcagggaaaaaccctttttaacgtcggcagtgtcgggaatccgttggatgttacgcaggcttcctactgcattttagagggcgagatgggagaggagcagcctacgtccttctccattcattttgtacgtgtaccttatgatatagaactggcagtaaaacaagcggaggaagctgctgtgccttctttgccgtattatattcgagagctgcgcacaggaatttaccgcgggattcaggacctggattaagtatggaaacattcatttctaaaagccaatccatccgcaggggggaacattgtgctgaccagagaaatgcttcgtcttgggctaccggagctttacacccgccgagtccgattgcgccagctaagaacggaggattatcccgcgctggaacggattctatccgatccattggtgatccaatatgtgaatcgaattcgcaaaccagtcaatacacgaatgcggcgtctggttgcgcaaattaaaatatctgctgattcactagattccctgcattttgcggtggaatggcatcagagaaatacaggagaaagcaatctacttggtgaatccaatgagcttacctcctcaccgttgctcggtatcgtctcttttcagcaatggaatgaaagaacgggtgaggcacaactgggctatattctggatcgtcctttttggggacaggggctggctacagaagtggtgggagaaatgctgaattttggtttcggatctttgaagctcaagcggatcgaaagtcgttgccaagaggataatcaggcttccatgcgcgtacttattaaaaataagatgcgcctgctgcgtacaattggtgcttatgatccctcaggagaggtgccgagtgtattggtattttcgatgaaccaaggagattatgcatagaaatggcagtggaatattttgttacaaagatgaaatataactgcaaaacaactctaacacaggacgggtacaatacagacatgacccccttttgaataataaatgttgctgggacccgatgattcgggtcctctttttttgttattctatagttaggactgaacaggaaagaagggctgatattggctttgaatatatggagtgcagacatacatcatttatttgaccaattcacggagcttgtggatggtcgtattcatcataaaaaatgggagcaacaactcacgcttcccccgcatatgggcaagggaagcatgacacgcacacagattcgcccaggtatggaaatcgtggtcacggatctcacctttgaacagaatatgaagcttcatattcaggaggcttgtccgctctttgaactcagctattgcttaaacggtgaaatatactgtgaatggaacggcaaagaaagtcataccaatcgtttgaccgggaatgttttatatttagaggatgaactggtttatgaggaaaagaaggcaggagttcgccatcaaatgctggaaatacgatgttctccacaagagctttttcattatgccggagatatcgcagaaaagcatagcatggaaacatggttacagcgttacaaggggaatatcgactcttatgcggatacgccagccatgcataagtgtgtttttgacatgatacattgcaactacaatgggacgatgaaacggttatacatggaaagcaaggcaatggagtttattgcattatttggggagatggatggacatgaaataaggggtacaagccattttataagtcgtgaagatatatccaagctccaaaaggctcgtgaattcgtcattcttcattttgaacatcccctgtctattcaagcgctggcccgaaaggttgggcttaatgaattcaagctaaagaagggattcccccatttattcggaatgactatttttgaaatggtgcgtaagcaaagaatggaaaaagcactctggtacttggaagttgaacaattaaacattggagagactgccttttcaattgggtacagcaacgccagcaattttacgacaacctttcgaaagtattatggttgtaatcctagcgaatatatcaagaaaatacgtaacccagatacattttcgaataaatcttaatgaaaccaatccttcaagcatatccatcatgtttggaggattttgcatttgtgctccttctatagggatagaaaatacctccgtaggtagagcctccttcctttatagatgataatggttatcaagttgagatgagaaatgaaaagatcaaagataaccattatagagttggaggaactaccatgaaagatcgttttgccatatccatgactaatcctcaagcagtacagcaggtagactcgcgtcgctggtacgcattagctcttattttacttcccactttgttgatttcattgaatacctatatgatgcaggttgcccttccgatgatgcaggcggacctgcacgccagcttttcggaggcacagctcatatttacgggctattctctgggattggctgtggccttgatattgggtggcaaactaggagatatgtatggtagaagacgcatgttatgcatcggggtgttgggttttacattaatggctttgttaggagggatcgtatcgcaccctacattaatcattatgatccgtgtgcttcaagggatatcagctgccatgattcaacctcaggttctatctatcatgcaaagcagctttcttcccagagagaaagggctggtatttgcgatttatggagctatcattggggttgggtttacacttggtttaattctgggtggatttttggtagactggaacctttttggtctgggttggcgtattattttcttttttaatgttccctttgggctgttagtgttactcttttgtcctattatttcggaatcctatggcagatccgtgccaaacatggattgggcaggggcctttctgttgcttcttggtttattgttgtttgtctatccgttgacaaccggacaaaagcagggctgggctttagggacatggggttgtctgctgttgtccattctggttttggttgcttttatagttacgcaaatgggaaaagaaaagaagggaggctcgccttttattcgtctgtctatatttagaaagggttcattcggagcagggatattgacggtaattgtcatctatcttagtatgttttcgttcttctttattttgaattattatgtacaatctggtttgaaatacagtgttcgatccacaagtatggtctttttaccgctaggtgttggcttttttcttacctcattatggtcgtctaggctggttaagaggtgggggagcaaggtgctgaaatcaggtatgctaatcatggggatttgtagctttctgctcattggatcgttacatctagatgcgttccacctatttcatattcaaaatatcatgatactaggtgtatatggtttgggtctcgggatggccacaacgccactggctcatgtcgtcctgggtgctgtatcggctaaagaggcaggaacgggctcaggcttgttcacgacctttatgtacttggctaattcgttgggagtcgctttgatcgggttcttgttctcttcctcgcttcatcacacgctttcagaagctaaattgtcagattatattagggcattctctatctctgtggcggcgagtggccttcttgccttggctgggctcatttgtatttcagtttgttacaaaaatgaaacataactgcaaagttactttaacatagagtgggtacaacatagacatgaccccctttgaatcatatatattgctgggacccgaagcttcgggtcctctttttttttatgatttataagaacggttcaggctggttaccagttctggaagccattcatgtagggagagaaatgagtacccctctgactgggctttggacgtatccatgtaccatgattgtgtaataccaaatggagacatgtgctcgtctgctgttttttctttcatcacagcttgttttgtcgttacctgctcaatgatcgaaatgatctctccaatcctcacggtaccgtcggagcaagcatttacgggaccagttaaatgagtgtgaccaagccaaagtagaaaatctgcggcttcatcggaacgaataaatgagatttgtgctgcggaattagggactccaatttctatcccttcacgaatatgttcgatatgaaaatgaagccttttcgtataatcgtctgtccccaatacaatcggaaaacgaacagcaactacagggaatgtagcttgctgcataaaaactgcttctgtctgccgtttagcctcctgatatgtaaaatcgtccttcccgcccttgcgaaccgggtaagcctgagggtcaaagatgctctctgtcagcacttccgggctcgaatcatagacggataggctggaggtcacaatatacctcttggctgtagcatcaaaaatgcggcaggcttcgctggcttcatctggagaaaagcaaatattatcataaacaacgtcccacacttgctcacctaccgcctcagcgagcgcttgccggtcggtacggtctgcacagattcgctgaacgcggtcaccaaacgaatcgctcgtttggcctcgtgtgaggatggtaacggagttctcggaactctccagcagacgttccaccagtctcttgccaaaaaagcgcgttccacccaaaacaagtatctttttcatacttacatcactcctcctgaaatggttttcatttatattaagatagacgaaataatgattgtaaatgatacggagcgactgaaaaggggaggatcatatgccatacgtagagattcagaacttagaaatgtattatgaaaaaatgggggcaggagaacccgtcatatttttgcacagtcattattcaagaggaattctagctttttcatcgcaattacttgattttcagcaaaagtatacatgttattttcccgaccacaggggtcatggcagaacaaaatgtgatagcctggaatggagcacccctcaactcgcagaagatgtaattgattttatggaggcgctacatatttccaaagcccatcttattgggtacagctgcggaggcaatgtggctttatactgtgcggtgaagcaccctcaaatgtttgctaccgttacgaccataggctgtagtggagtcgcatgtcctgagggggcagatgaatttgaaccagagtggctcatcaaaaacgaacgttatgaaatgatccatcaaatgatggatcggcatgaggaggcacatcaggggaattggcaagaatttatgcgtcagagcgcacaggattggcgccaatatccgcaattgacacgtagtgagttaagcagcattacgtgccctgcattatttatcgcgggtgaacatgatgatttcgccacagaagagcaactcctggaattatgctcaagggtccaagactcacgttatctaattgctccgggttgtagtcatcgaccgcacatgcttagagagaagccgatcttaatcaatgattctattcttcaatttttgagcaaacacgcgattcgttgatcataaatttgtatcctgcaggcggagtggagaatttgaatctggagaagcgcaggcgttcgccttagcaatgggattctaccctttaaagggcttataccatccagtgaatcccgttgcaacagcgatcataagatcaaatcattcgatagcggtggagcaccgcctaatcttactctcctagaagcttcaagaaattggccggcaccgtaatttgctgattattaatcataatcttccgaagctcctctatggagtcctcttcacctctagcgtctttaatctccttaatttcacgatgcagtcgctccatttgaagatcgagagcattagcggaatctgctgcgttctttaattcacgtgtcaggttttcgggcacagactggttgtatttataaaagattttatgctccaggctggcccagaaatccatcgcaatggttcgaatttgcacttctacgcagactagctcctcacaatccgacatgaatacaggaacttgaaccagcaaatgcaggctctggtaaccgttcggcttgggattcttgatgtaatccttaatttccagtaccttcaagtcactttgtctctgaagcatgttactgacatcataaatgtcagaaataaaagagcaagtaatacgcaaacctgcgatatccttgatatgatctttgatagcatccagcgataactcgctatttttacgaatcattttattcatgatgctctcaggagatttaaggcgtgatttggtatgctcaatagggctgtaatcgtgcaatgcttgaaattcctgctttaatatttcaatcttggtttccatttcgtcgagcgcaaatttatagatgagcataaatcgcgtgatgtcatgctttagctttttaagcttgttcataggatcttccaagtgcatatgtaattctcctcacacatagatgtcataatcttgctaagcgttcgcctttgcaatggaattatcaccttataaattacaatccccaacaatcccattgcagcagcgtttgtaagatcaaatgatttgcggagcggcgatccccaacttaaacaaattttaaagcgccacaggaattttacgtttttctttaaaatagacccattcccggaagccgatatccttcagcattgcttttacttcttcccagtcatcgcctacccgcgaaggcttatgagcatccgaaccaaaagtaacctctacaccaaaatggtgcgctctttctaaaatagaagcagacgggtaccatccgccacttagcttggttttacccgaagtgttaatttcaatcgccacattggattccgcaattacctgcaaggtttcatcaatggcttcatcggcaggaatgtctgaaaaggcaggaaagtttcccttcattgcgtcaatatgacccaaaatttgaaacatgccgcttcgcgcagattcctgaatgagcgcatagtaggcttgtttgacctcgattttacgagcgtcgcttaatttgttccaacggttacggttaaaaatgctgttcccttcgacattgtgaatcgacccaatgaggtaatcaaatggataaggagccagagtggaacgatataattcagcaaaatcaggaaaataatccgtttccaatccgaggagcacgtcaatacggccttcgtattcctttttaagctgttgtacctcttctacgtattcagcaagctgtgacttagccatataaattttaggaaaagcctgatcctgttcgctgcccaggaaaggagaatggtccgaaataccaatcgcttgtaagcccgactgaatgcctgcttcaatgtaatctcgaatgtttccgtctgcatgaccgcagcggaaatgatgggtgtgcagatcaaatttcatagctgtcttcctttcgtaatcagggtttatatttcgtatagtgttcatagcgaattacgttattcagaactggtgaaattcgtctccggcatccccttcagatcacttaaaaattgctgcatggctgagtttagatatcggccggatttataaatcactcctaccggatgactaacttccagctcgggaatatggatcatttttaatgtgcctgcacgcagttcagaagtgaccgatagtctggaaataatggcagcaccgagattaatttcgaccatccgtttgacttcctcgctgctggacaactcgatcacgacatgaggtacgatttggtgctttttaaatacatcatccacgaattttcgtcccaccgtatcgggagagagcagaatcaacggaatttcccgaagggcttcaatggtagcatgtggttgtgaggccagtggatgagtaggagacacgacgagctcaaaggaatcgtagtacagaaccgaagtgcttaaattgggattacgttcaatcagataaccgatgccaacatcaataagtccgttctccacctgctgataaatcattgaggaagccatggattgaatggaggttttgatgagagggaactgatcctgaaagtaggaaagcacgcgcggtaaaatttgaatagcgatggatgttgtggtgcccagcgcaatgtgaccctgcggtgtttcgtttaaatcgtataatttttgtcttaattcctcaacaacctctaatatgcgctcggcgtgttccaaaaaaacagctccccggtcggtcagggtgacaggctggttgcggtcaatcagaatggttttgaactcatcctctagacttttaatttgggcggacaccgccggctgcgtcaaattgagaagttctccggctttgcggaagctcatcgttttggaaatcatgataagtgtttcaagttgactgatgttcatgaagttcctcctctcttttcttaatcttatcgcagctgtatagaatgaatatttttagccaatccataggttcatatgtaaaaccgttgttatgctttatttcattaaattataggttattcgagcaggaagggcaatgaatcgaagcagagcaccttaaagtgtggtatattgggaaataaagactaaagtcctgatatccttcaaaattaatcaatctaaaaccggtaagaagcaaagatataggacattattcacatttttttgtgatgtagctataaaaaattgccgggtagctgtcgataagtgatatagagagcattttattgaggaccgattcgtttcacagtaatatttaattaaaaaattctaatttaaatgggacttttgttgtatgtctaaaagcccatcgtaaaggggcgctttgatcgtgaaggcagaagtgataaatccttttttggagtcggcgcgacgggtcattgaacaattgatccaagtatctccttcacccggaaatcttggtgtgaaaaatgtcgagctggtggacgaccacatctggattatgatcgggatgaccggacagcttagcggaaatattgtgttcggcctgaatgaacaggtggcgctacgtatggtatcagcgatgatgggcggatttgtgttgactgaaattgatgagatgggaaaaagcgcaatttcagaattgggcaatatgattagtgggaatgccagtacgattttgtccagtcagggaattgttgtggatattacgcctccgcaggtcatgaaatcagaaaacttgaccacttttgtgcctcagcgtgccctttatattccgcttacggtggaaggaatcggtgagctggatattcaggtgatgatctcttaatattaaaggagcaagtttctttaatgtggagggatgaccgtgaatatactacaggacaagatagttgtgattacaggtgcatccagtggaattggcgccctttgcgctcagttgttaagcgaaaagggcgcgattcctattttaacagcacgctcgcaggagcgactgaagcaagtatctgcgggaatcagcggcagacatgagcttatccaactggacgtcacccgccaggagcaggtagaggctgttgctgcacgagtattggaagagtacggacgggtcgatatattgcttaacaatgcgggctacggaaagtttgagtattttaatgaaaccgatctgacggagtttgaacaaatgatggacgtgaactacatgggtgttgttcgctgcatcaaggcgtttctgccgcaaatgacagagcggggccatggacagattgtcaatgtagcatcaatggccgggaaaatcgggacagccaaatcgtcttcttacacggcgacgaagcatgcgttgctcggtttcagcaatgcgctccggcaagagttgcgcgggagtggagtgactgtaacgacgattaatccggggccgattgacacacccttttttgagctggcagatccttcaggaggatatgttcgaaatgtaagctggtttatgctacaaccagataaggtagcacggcatatcgtaagagcgatggagcttcgcaaggaggaggttaatctgccacggtgggtatctccttttctcaagctgtatcagttagctcccagactgaccgataggctgggtcatggtgtgatgaataagaaataaaagatgtcccgtaagccattagctatggtgagggacatcttttatttttgtgatttggtaacagggctattttcgcatataatggagagtaacgaatttacgtataggggttggaccttttcatgacattgaattttgaatcgctcggcgttgaacaagatctgttggacaaactgactgagcatgaaattacacagccttcgccagttcaggcagaggctataccggaaataatgaagggaaagcatgtattggcgcgctcacaaactggcacaggtaaaacactggcttatttgctgccgctgctgcaagcgattgacccacagaaaaaggctacgcaaaagctgatactggctccaagccaggaactggccatgcaaattgtacgtgagggtcagcgctacggagagcattgcggaatccgtgtactcggtctgattggtggagcggctatcaaacgtcaaatcgaaaagcttaaggatcatccacagcttgtcgtgggtacaccaggacgtgtacgggaactcatcgcttcgaaaaagctgaaaatgcacaatattactaccattgtcatcgatgaggtggatcagatgttccagctcggtggagcaggcgatgtaaccaacatattgggcaccgcccaacgtgatcgtcaattggtattcctgtccgcaacgctgaacgatgagattcagtcgctggcaaaacgggagatgcgtgaatacgtagaaattgggattgatcccgaccaaaagacggccagtggactggaacactattactttgtatctgaagaacgggataaggtggatatgctgcgccgtctggtgcgtcattttaatccgagaaaagcgctggtgttcgtgaatacgaccaatgccattggggagattgaagccaagctcaagcatatggggctgactacggcgtccttgtatggagatgcggataaagttacgcgtagcaacgtgttggccaaattccgcgaggacaagctcaaagtactggtcgcttcggatgtggcagctcgtggtctggatattgagggacttgaaatggtcattcattttgacccggctacggatagtcaagcttatgttcaccgtgcaggacggacaggacggatgggacgcaaaggattagtggcatcggttgtcaccgaccgtgaaacgttcatcatgcgtaagttctcccgtgaactgggcattgacatcgcagagcgtgcgttgcatggaggtcgagtagttgtgccgcgtccggcggatgccaagcgtgcacctgtaagaccatccgaggccagatcctcatctaacggagcactgacagaaaaccgtaaggcacctgttcgtgccgaaaacagacgtcctggcagaaattccgcgaacggttcagctccaggcaagagcaaaggagcagccttgtccaaagcaggaaaagcacagcgcgagcgtgatcgcaaaaacaagggtgcaccaagatggctgaaggaaaaaggatcaaaaccgaacgagtaagggagaagagggggagccatggaacaacagcctgtgttgcaaattaacggacttaccggcggatatagcgccaagcgcccggtgctgcatcaaatttcgctggatgtgaaaccgggtgaaatggtaggactgatcggtctgaacggggccgggaaaagtacgaccatgaagcatattttgggcctgatgacaccgcaggccggagaaatccgtgtgcaggggcataagcaggatgagaatcccgaggaatatcagggagccattgcttttgtacctgaatctccagagctgtatcctgaaatgacggtgatggagcatatggaattcacggccagagcgtacggagttagcgaagcagatttccgcacgcgcagtgatcaaatgctagacttgttccgtatgcgggataaaagtgggagtatgtcgatgcacctgtctaaagggatgcgccagaaagtgatgattatgtgcgcatttttagcgggaccgccgttgtatgtcatagatgaaccttttttgggtttggatccgctgggtattcgttccctgcttgactttatgttagagatgaagcgttcgggttcgtccattctgctcagttctcatattttgtccacgattgaaaattattgtgatcgtttcattgtacttcatcagggagccatcattgcacagggtacgctggacgaagtgacagcacaggcgggtaagccgggcatgccgctggaagatgcattttatgagctggtacagggcagggaatgagcatggatttgcaacgtttgcataaagaaagacgtgtagcgttctggggacaggtgctgccctatctgggctatgtcattcagagcggtctggcggtggtcttcggctttgcgctgattgcctttgccgcatggtacacgtcgctactgatgcatactccaccggatttgcccatccgctggatcatgcttattgtggctattccgattgctcatgcgagctttcgtacgtatttaaacgcagcggatattgttttcctccgtccacaggagcacgcgatgcaccattattttaaggccagccggattcggggtgtggtgtataaaatattcggtttgctattgctgtctattatcgtgtggccgctgtatattcgcagtgatgcggcgcctaagccgttgctactgaccctgctactgtttgtgctgttaaagctgctattcagctacggcggctggcaagagcttcgcatggtatcgattggcgggagtgtaggctatcgtctgcttcggtgggtgttggctgtgctgatggtagccgcatggctatggcagcctccactacacagcgtgccatttatcatattggtcggtgtggtgtacgtgcttgttctgcgttttccggtcaagctgctagtggcttgggaaaagctgattcgtacagagggtatgcaggctgctcgggtgatgcgcactttgggctggtttgtcgatgtgcccgcccttacgcagagagtgacgccacgtcgttggctgtcctggttgggaggtaacataccttggaacagaaggggagcgtatcgttacctgctgtttaagacattcctgcgtacagagccagcaggtattgtcattcggcttggaattctgggattgttaattatatatatcacccatgctagctggattgggattgcggtatatttatttttcatattcctcattggtgtacaggttacttcactaaagcagtatcacaaggattcgttgtggcttcagttatatccgattcctgcgcatagtcgtcgtgcgtcttttctcgactttgttgttcggttgacgttgccggctgctgtggttctgtggcttccttttctggcaaaaggaacggaagatctactgtctacactgctcacgctgcttgggggagttgcagtagtgttcttgttacgaggcgctcaagccaaaaaatggcgtttggacggtcaggatgaggaagaagtgtaatttgtatctatgtgaataaagtaaaggctaattcgcaagcagcaagagctgtctgccaattagccttttttgtacgctcgctgttatcgtagccgtgggtgcagatttccgcctgcttatataaagagcgttttgctgatgataactaataaaatgaacagtaccagaattgttcctgtgcttgtgaatgcgccgtaaccaccgtaaccgcctcttgtttcttctgctcccatgctcattctcctctcggtcattgtgataaaggatacatcgtatcttatgaattggattttcagattgcgtgggccaatgctcaggtatgttgccgaatcgccttatatttttcatcagatgtaggggaggatagaggaaaagacacgtattatcgagaatagaagaagtacgtagtcattatcacttggaaagtgggaaagacgagatgctggtagataagctgctcgtgaacatatttcttgtgtttgtaccgttattggtatatagcgctttgtcagatcatcggcataggaaacataccccgttgcttatgggaggggtgctgggtgtgtcttctgtgctttgcattatgttttcgtacatttggtatggattatattgggaccttcgatatgttcctctgatcctttctgttttatattttggtccaaaggcagggcttctgaatataacgctgatggtgatggctcgtatgtatatagatccagagtctatggtggtgagctttcccagcatgatgttgtgttatttggggcctctcttggtgagaagaaagtttatgcagctcaatagtatgttgcttcgggtgggcatgaatatgctaatgagtatatggaccaatattgccatgcttatatttttgttaatacattcctgggccaatggcaggctggataaggatgaggtcgagctgattcgggcaatactctggttcggtgtgattcaattcctaagcattggagcctcctctttctggatggagtttagtttggaacgggaagaaatgagaagaaagattaaatatgctgagcatctgaataccttaggtgaactggctgcctctatggctcatgaagtaaggaatccgttgaccgtggttaaagggttcctgcaaatggttcagtcagggctagaagggaaaaatcgcagatatattgctttggcactagcagaggtcgatcgggctgaaagaattattagcgactatctgaacttatccagaccgcagattgggaacacagagctgatggatttgtctggcatggttcaacagattgttttgcttttgaaaccgatggcgaccaagcaaggcgtaagactgtatactgagctaaggaatgaaatatacgtacatatggatcgtaatcagctgttacaggcgttaatacatgtgacgaaaaatgcgatcgaagctgcggatgatgggggcagggtatacataaagctggcgattcaggaagaaaaggcatgtctgcatattagggatacgggaaaaggcatgagtcaggagcatctggagcgagtgggtactttgtttttttcaaccaaagaggtaggaacgggactgggaacggtcgtctcctttcgaatcattgaagctatgaacggaagtatacactatgagagtgagccgggagtcggaaccgaggtagtcatcctgctgccactcgcacagaaatctttgctcgctgctgaaggatagtttgttgcgaagtgtgacttacaatggttcagctcattaaaaagcggtatgccacaacatccggcataccgctaatgatgctatatttaatctgttacatattaggcgttcaacaaatcttgtgcgccacggtaaacaatgtcatacaggtcttccagatactcttcctcgatacatgagaatgcgattcggagatcatattcacccagcgcaatcgtccctaccccatattgttccagcaaatgtgtgcgcagtcgttcagcggacaagccgttcagcttgaggcacataaaataacccgaattgaaaggatagtagctccatacatctccgtattttccactatcgagtaacgctttgactttattagcccgacccttcataatctggaacttttctttcttctgttgttcaaagtctgttgacttgagggcatccaggacgaaggtttgagatgggtgaggaccgctcgaaatcgttgcccgaataatccctaatgttttttgttctagtgcgctcagtacatcctgatgttccgaagcaaaggtaataaatccgacacggaagccccaaacaaattcttccttggtagctccgtcaattttgacgggtagaattctcggatgaagtccagctaactgaccgaatagtgattcgtgcagggagtcctcgaagaacagaccaaaataagcgtcatccgtcacaactacgacattgatgcctgcttccgcggcttcctggatggcagcaacaattgctttaccctcttcgactcccggtgtgtagcccgtcgggttattcgggaagttcagtacaacgatcgctttgccgtattctttctgtgccagtagagcgtcgcgtaatccttcactattaaaacgttgatcctctgtgaacaacgggaaattcaccaaacgtccatgacggcgaataccgaaagtcagctcatagttttcccagtttttgtctgggtaaatgacagcatccccttcatccgtgaacaggtcggcaacgatgctcaaaccgtgggtcagcgcgttcgtaactacgggaaggccgtaactttttccagccaacgaagggttttccttcagcattttgtcgcgccatacactacgtagttcaggtttgcccgcagggggagcgtaagggtataaatccttgggattgtaagcggacagcttttcctgaatgacctccaaatgcataggaccattgccttctgtagcaatgccaatcgtagcgttgtattttttagcaagcttccctgcttctgcggattgactcaaaatcccttcttttgggaaataaatttctttccctaaaagagaaagcatttgatatacatgctcgttgcctgtctgaatgttttggtttaactgcgctgccagtggattcattcccgtttcatccttccaagtcattttgattacatattatagcattacacacggtaagcgtcacgcaaaagcatctggaacataaaagcgcatttttttgcttaatgacggcgctgagcttatattataaattaacgggatagaggacaaccaaagattaacaaaaggaggtgcagattttgctggatacatctgcgtcatcgtttatcctgttgtcggccttcgccaaaattgtgtgcgagccgggctggaagtggcaggtacgcgagaagccgatgccaaactatgatttattttatgtatggagcggagaaggaacagtggtcttaaacgggacgtcgtatccggtgagcaaggggagctgcttcctgttcaagccgggggatgatacccgtgccacacataacccgcaaaagccgctcatacttacctatattcattttgatcttatcgaacaaccaaagctaattcctgcaagctaccgtatgctggaggaaacgttcgaggtagagcatatgcttgccagatacgttagactacgcctagagcgtgcttacggagctgacgaggaaggcaagctgatcctgaaacaactgatgattcatctgctgcgtgcggaccgtaaggagcctcaggagcaacaagccagtaaccagctcaccgaggtcattcgagaaacggccaactacgtgcgtcagcatccgggacttcctcatcgcgtcgaggatttggctgcacgagcggggctgtcaccacgttatttttcaattaaattcaaggagctgctgggtgtttccgcgcaatctcatattatcagcatgcggattgagcgtgcacagcatctattactacatgccggaatgaatgtgaccgaggtggcagaggctttggggtaccgtgacatcttttttttcagccgccaattcaagcagtacacggggaaaagtccgtctgagatccggtaatgctatggacggtggacaagctgtttcggatttaggcgtgaagaatatgaatataatggataaattccaaaaaaggacccgggcagttacgccgggtccttttttatatgagcaatttaacatcatccgatcccaatgctcatatgtgtagctataatcctgttacgataaattcacttttgctttgggatcatgtcgaaagcaacccagacgttgtcccatttttaccgcatcccccagcttcaatgcggggtctggctcaaacgtgccgttttcagttagcaaaacgacagttgatccaaattcgaaataggcgagatcgtctccttttgtccatgagacggccttatcatccgtatatttgatgctactcacattcattgcgccaaccttgacgaccgccacctcaccatattcgtgggcaatgtacgtaatctgtcgttcattgcggctaagaactgctcgcatatgttgcaagccgaagtcattcactgggtataccttgccgcgcagatgctctttttctaccagcgtaccggatactggtgcatgaatgcgatgataatccgtcgggctgagatagagcacaaaagcatagccgtgtgtgtatttttcaagacgcggagagcggttaagaagctcttccagcgtatagtcctgccctttgacatttaaaagagtgccggacgtaattgggccagtgaaagtaatccgtgcatccaccggactggtcatcacctcggcgttcgtatcaatcgggcgcatgcccgcttttaatttgcgtgtaaaataggcgtttagagaacggtattccttccattcctgttccgcctcatgcgtctggatctggtacgtacgtataaaggtggggataaaaagtcggcttgcaccgctttgcgcgaaggagcctacaatccggcacacccacttgcgcgatgatagctccgtcatgagccgcagccactgttttgccattacagatcccccttgttcatttccgagccgtcttggccggaacctgtccggccgctctgaactatattgacacagaatgtgacgtaaatcaatacagtggacggcttggtgaacgttcggtgtctgacgaaggcatccgttcgagaagccaacgagcgtaagccatcggctgagagtatgtttctttccagacattgtgcatgcccgcctggctgaagccatagcgctggtcacgaccgttgcattcaataaaaacaatcttgccttcatgggtaattcccagatccagaccgacgtcggcgagacggggaagggtttgtgccagtcggtgcacgatttgtaatgagagtcgctccagttcattcatcagccggactgcgttcgaagtctgaactgtctctgtttgtgataacacttctagtaaggaacgggccgtaccgccctgtgccacattggagacgaaggtgtgggaaggagcaattttagcatacatgcctgtcacaccccagataccgccatatccgcgctgaaccgacacacggacatcaaacggacgattgttgtacaaagcaagcggtatggtttcctgtacgatatgaggcacctgcagcagtcgcttgtgtagaaataatgggagttctccgacattcaaacgtagggtggaccaacgctcaggtatagccggatgagcgcattgcaaagtccagcctccgcgggaatgccgcagacgcataattcctctacccacgctaccgctactgggtttaatgacaacatctccggtttcttccatcaaggtatggatggaggaaaggttgccttgcaatgttgtgggaaggtggatgcgtagcaaagggtcttcctgcagaattgcatgtatatggtctttgtggaaacggttttgttcattaaaaatatagaaccccttttgtacaagcttgctgatatctctagcattttcattttgccgatagagagtccgattgtggatgaccggcggcaacggaagaatcatctgccgatactcgttgccgtgtttaacataagcccggcatgttccggtcgctatatgaatatcctccagacgaagaaagcaggggatgagctcgtagcttaacccggcgtcctcgtaattggcgatagattcatatcgcgtcctcatggcggggatgccccggtaggttgccgggttgagcatgacgccgacatgcaacatgagtatgtccgccctccttgtagtcactccaactgatcaaactgtgattctagtccatcatatgtatcaaagatcggccaggcatggacgcttgccttgcggtaagcccaaagttagaagcgaggcacatttcagcgaggcagacgatatgatacaagatgagtgttgaagagtgttggaataagctcagaaagtaggtgaggtgatgcagaggccgaaggtagcagtcgttacaccgggctcctttgttataccttcgccccgcagcagttctgtggagcgggtaattgcccgcatggtaccgctggctagtcatgagcttcaagcgcagatctatggcataaagggagcagaggcaccggatcatggcgatgtcgacggaattccctgcatgcgttatacgcggggaacaggctatatttctgaggtgattgccgatttaaagagatggttaccagcggtagtagatgtacacaaccgcccggcagttgcgaatgcaattcgcgaggctttacccgatagccgagttgtgctgactttgcattcgaccacgttcatccgggagccttacctcaaacggaaggatatgggcaggctgctgttgtcgatggatcgcattatcgtgaacagtgcatatttaggggcaatcgtagcttctgactgccccgaggccgtcagagagcgtatcgtcataaacaagctgggtatccatcccggcgatttcctgccacggtggactccagcagcagaagcagccagatcggcgcgattggacgatttcggctggtcaggccgccaaatcatgttattcgcgggcagactgatgccagggaagggcgttcaccggctgctgaaggccctgcggcatgtggtccgcgcctgcccggacgtactgctgctcattgcaggtagtgcctattacgggcatgaccgcctcacgccgtacacggcgtcgttgcatcggcagatgcgtaaactaaggttggggaagcatgtgcaattcctggactatgttccgcatccagcattggcctcgctatatcagctagccgatgtgaccgttgttccttcagtgaaggatgaggccttcgggctagtcaatctggaagccatggcggcaggagtgcctgtggttgcttcacgaatcggcggtattccagaggttgtacaacacggcgagacaggctggcttgtgtatccgtctcacggtgagcaggaaatggccgatgccatcatcaggctgctccagcaaccaagcttgcgacgacggatgggagaagccgggcttggcgaggtacggagaagatttttatggcaacactcagcacaacgctgggcacaaatcataacggactgtgtagcggagtgacgtagctgctgttacacgcataggctatcttataggcattagccatgattcccagccgggtgaatgaagcggagcgaccgctggttcactcctgtgccaaaggagaggtcaccatgaaccatcgtacgaaccatagccctaaggataaaagaacagcacggcgtaacctttcccatgcggttccctccccccgtgttaacaaggagaaagcgacttcgacttccggcagtcataaatcgaaccagcgtggaacggcaacggtccctgcccccgtagagaaggacacatcggttcaagctatagaggaagtggcatggaagaagcataagctccccaaaacgctagaggaagcgatgcagatgaatcgagcatctgtactgctgttgtcagtgcctgagtcagatacggaatacaggttggataacgacaaaccgtctattacgacggaagatcaggcagagcaagattcgttactggattgttccataaccagtattcacattgctgaaggaagaccacgcccaaagcaacgcgtggtcttgtctgagcaagatatcgatctagctttcgatacggagaaagaattaaacttgaatgtcattcacgacggatcagcgaccagtgacgaggcttctgacgatcatatagtttcacctcaatatgggagcattccttttcacctccccgcacaagcggataggggtgaagtgagcgttgtatttgagaagccttttatagatacacagtatgtaatcactgccaatgcgagtataccgggagtgatggtatccgtcacacaacgtcagaggtattcagcagtacttactgtggaacgcatacactcaggtccgctatgtgaagggttggtcctttggattgcgatggggcaataataagaagccggaaatataattaccaataatcaactttatactagaaaaaaggcgtcccatagtgggacgccgtatacataagagagaaggggggagacttgtaataccggggaaatttatattatttcacttatctcacacctacagcgtcaaaagacttcatagcagaggttacggctattgaattttcaccataactatctttggccgcttggatcacagcggcacgcgcggtggagaagttagacgtggaagtcagataattggtgaaggcattataataaatatatacggctgcatcacgtccaattccatctaccttgacaccatggaaagtgcttccttgtgccagagaggttgtcgaacgagaagattgattttacaaaataccccaaaatgaatctttagtccctgatttactgtttatttgtcttatctagtcgaaaatgatcgggagagactcaatgaacaagaaaagggcgcccctttgaggggacgccataaataagggggaaggggcgcagacttgtacactgcacccctattttttcgtccattatgagcagcctaagtgacagttgcacaacggcgaaggtctatggacgggatatgaggattatagcgtatatgatttagtttacgcctacagcgtcaaaagatttggcagctgcagttgcttgtgccgagtttgcaccgtacagatcatttgctgcttggatcacagcagcgcgtgcgttggagaaatcggaagaagaagtcaggtagttcgtaaaggcactatagtaaatttggaccgctgcatcgcggccaattccatttacagctacaccatggaaagtaccaccttgtgccaacagatagtaggctttattgataatgccgctgttcgtatgaacgccaccgttatcggagctgcctctatacaagtcggaatagtgatctggttgatcatacagcgtaggattggacatagagcgcagagcatcgcctgcaatgtttggcgtataaatatcatcgcctacaagccagtttttacgctgaatgtcattgccgatgacgtccgagaaagcctcattcaatgcaccggactctccgtaatattccaaattcgaagtgtactctgtgacaccatgagtaagttcatgacctaccacatcggggtccccactgaatgcgataaatgtgctaccgtccccatctccataagtcatttgggagccattccagaaggcattgttgtagcggctaccgtaatggactgtcgaacggagttgcagcccgcgtccgtcaatgctgttgcgtccaaatttggacttatagtaatcatatgttttggcagcatatgcatgggcatccacgccggctggatcattccatacattatcggcatcggtcagaagggtacctgggatgctttgacggttggaggccgtgtaggtcacaataccattaccgcgtgttgtatcttttaactggtagctactaccggaagccgtcgtggtgaatgatttgctatcaccaagcacacctttacctgtgcctgtcgcttcattaatgatgtcatactggaatacgatgctgccgtcattggcatcaataatgtagcgagtacgcagtggggcaggttctaaaacattgacttctgttacataaaccagctgcaggtcatcccctttaggatagaagtacagatcagctttaggatctacttctggctgcagattagcgattttggcaatggaacttttttctgtctccaccgcctcaattttgctatctttcatggcagatgctttatcaagactcagctcgtccttatcagtagatagcgtttttccgttgttagctgcttcggcgtaagtgtctttgcttacactgctttgttcctcaacatctttagaaatcgtatcgtcggaggtagggagggcttcaatccgtgcagctgcttctttatatgcagtgtagactgcttcagaagcgctgatttttggagtcgtaccttgcgtagcttcagcttgctgatcctcagtaaccaccgctcctaagtaagaggtgacctcaccagatttgcccacatgaatagtctgttcagctccatatacgggaatcccgtttacatactgtttcagccgataatggctcacaccggacttgtcgcttgagcgatcaacgattcggaattgttcacgtacactagagttgtccgcacccagtaacgatttcttttgccgattcaaatagctccatacaatgtcgtccccggataccgaggaaggggctttccattgctcggcgtgaaaggtcggtgtaagctgagttggccccgaaacggaactctccgctgatgcaccagacgcgaccgaccctaataacatagctcctccaagaagcgaaacccatacttttttcattaaaaattcactctcctcgattaatgtcaggatgaattatcctgtcttgaataaggcatcgcgccatttatgtaggtcgtgttgtcgtctggaatagaagaaaatggaacatgaagagaaataccgaagtgtttttcatgaagcgtacgtgaaaagagggtactgcaatatgaagcatgtagcttaaaaaggtgacaaactcctcctttcctgtcgtataaaaagaaaatagaataatggtggataatggaaaaatattgacttatgcaaaaaaagcaattgttgattttttgaactcccatcatctggctctgatattagcacagagaatgacggacgagaagatctatgtcacaaatttatccaaaatgattctttagaccctaataactcatttatttaataggattaatgagttatgtaaaaataaagtcgaaaattgctgtgtcgaaaagactccacgattgccgttacacacggcttttggaccgcataggttatgttgaactgtcctaatcatgctgtccatctatacagcaggaagggaggtgagacgggagcatgaagaagcagggaagagctggatacaagatcaaacggaggcggcattccggcgcttactatcattctaagatgtggctgccgttacgaatgccgaacatgcataagaatccggtagcccctgccatgagggaggtactagacacggagagaggggcacagatcggcgaagagcgaccatctgaaccgtcatcagtgggaaagtttttcgtatctgtcattattccggccatgaatgagcaaaaaacaatcggagctgtgattcgcgaagcgcgccgtgtccatccacatacagaggttatcgtcgttgagaacggatcacacgatagaacggcgaaggtggcagcagcggcgggagctcgtgtgctttcctttccggaaccgctcggacatgatgttggccgtcgtattggagcggaggcggcatccggacagatcctgcttttcctggatggggatatcgtcattccctgcgttagactccggccgtttatacacgccatatgtgcaggggcggatgtggtgctgaatgattaccatggacctgtgaatcgtacgcccgtacaccctgtagtggaggcaaagcatgtattgaatatcttgtcgaatcgtgctgatttagggggagcatctatgactggcattccacacgccataagtcaaaaggctctaaataaaataggtctaaagcccttggagaagcctcctttatttcaagctatgtccattgcctccgagttacgagtggtgactgtatatggaatagctgtcggaaaaataaatgcgacacgtaaaaaacagaacggcaaggacccgctggcagatgtaattgttcaggatcatctggatgccattgcctggcttacatcgcgtctgggaacgcgtgcgggatatacggatttggagcgcaaacggatcagagacgaggtgaaactgtgaatagacagtatcgcagagggaagcgtgaagaaccgagttggggcatgagacgtgttcagcgaaaacgaggaacgacgacttcaatgcatagccgtaggatgagaaagcccacacctcgggcgaaaggaatgaccgaagtgactccgcctgtggaacgcgaagttccgggggatattgtgttacagggaacggcagcggccgtagtcagcgcctgtaatgaagagtcaacgattgaccgggtactgggcgagctggaaaaacttccacttacggatatcattgtcgtattgaacggctgcacggacggcacgcgctccaccgtagccaaacatcatcccagtgtgactcttgtcaacgtgccggatcgactggggcatgatgttggccgggcggtaggcgcgcgtatgacgcaggctgatattgtgctgttcgtggacggagatttgccgattccagcatctgatttgctgccttttctccacgcggtggatcagggaacggatgttgcgcttaatgatctgggcagacatttgccgccctatgcccagcaggacagcgtgacacggtgcaaagcattcctgaatcgtgtactgcgcaggccggatttgggagcaagctcattgaccgccgtaccgcatgcattatctcggcgtttactggatcagcttggctcagccgtgcttgccgtaccgccaaaagcccacgccatggcaattctgcatggcatgatcgtggcggcagtacatgctgtcgacgtcattaaaacaaaccgtaagcggaccttcaatgttggcaaagggaacgctatggaacagttgatcgtcggtgatcatgcagaggcactgacggccgtgtttcaggtagccgggtattccccgctcgggcctgttccaacacgggtagacgttgccaaagggaggaatgcacaatgagtctgacgagcatcattattccgacttataacggcctccatctgttaaagccgtgtattgaggcgattcggacacatacgatagatgtaccgtatgaaatcattgttgtggacaacgcttcgaatgacggaacggatgatttttgcgcatccgagcggctgatcagcatacgtcttcctgaaaacaggggctttccagcagcatgtaatatggggctccggctggcttcgggtgatcagttcgttattttaaacaatgatgtgacggttacgcggggatggctatcgattatgttggctgcattgcagagcgaaagcatggtgggattggtgggaccggtgacgaattacgtcagcggtattcagcagatacacggattggaaggagatttggccagttgtctgagatatgctgagcagaataatgcaagtaatcccgccagatggcaagaggtcaagcggttggtcgggttttgtttgctgttccggcgcgatctgatggaacggatcggattgctggatgaacggttcagccccggacattatgaggatgacgattattgtctgcgcgcacgcgtgcatggctacaagctgctcatgtgcaacgactgttttgtctatcacgaggggaatgcgagcttctcacgctcggagacttcctggattgaagagctgatcgagcggaactatcgtttgtttatagagaaatggagcatagatcccagaatgttcatcgaaactgggaacactggggttgcatgcactgaacatgctgtcgaaggaggaaggaagatatgaaaggggttattctcgcaggaggaaccggatcgcgccttcatccgttgactacattactcaacaagcatctgcttccggtcggcaagtatcccatgatcgtatatggtatcgagaggctacgacaggctggaatcaccgatatgcttattattattggtaaacaatcggccgggctgtataccgattttttgggcagtggcagtaattatggtgtccaactgacataccggattcaagaaaaggcgggcggcattgcggaagcactcgaactggcaagaagctatatgcaatcagaagagaaattcactgttttgttaggtgataatttgttcaaggaagacttgggacctgtgatcgaacggttcaagcaacagccctcggggagcgccagagtgttgttgaaaaaggtggcagatgctcgtcgttacggggtacccgtatttgatcctgagcgcccggagagcattacgcggattgaagaaaagccgcagcacccccaatccaaatattgcgttacgggtatctatatgtacgatactgccgtgttcgataagatccggcaaattacaccttcggcacgcggtgagcttgagatcacggatgttaacaactgttatgctgctgaaggcaagctggaatatgatattttacggcgctattggagcgacgcaggaaccttcgattcccttcaggaagctggagtgaaaatgaaaggacttctaccctgatctcaacgaaacaccatccggccgggccaggcatatagtataggcataatgccacccggaggagtgaacggcatgaaacgcctgagtatgcaaaggaaacacagcaagcggctcggaaagaaaggctattggtcaggatataaaaggggccaggagcagggcaacaagttgggccaggcttcgttcggcaaggtttttgaaggtgtcagtattatcattccgtcctgcaatcagcttcagcagctccgcgcatgcattcaccgtattgaggagaatacgagccatcctcacgaaattattgtggtggactgcggatcgacggacgggacatccacctatttgctccgtaaaagcatcgctgtgcgttatgcgctgttaaaaaaggatgttcaaatgataggtagcctgaatcaggggctgatgatggcaaaaggcacaactattgtggtactggatcaaaactctatggtgacccccggctggttggatcggttgttagggtgtttatacagcgatccgcgtattggtgttgttgggcctgtaacgaatggtccattcaaagaacagcagattgaggttccttatatgaacgaaaatggagcccgtcaatttgccatgagcttcaatattcccaatccggatgcatggcgagaggccgaaagcttagccggattttgtttattgctgcgcagagagacattggaaaaaacgggctactgggacgaaggctgccacagtactgaggaagcccatgcagattggctattgcgtgtgcgtttgttggggatacgtatggcaattgccggagatgcttttatccattatgaagaaagagatcgggatacggtgtatggttttcctcaaacgaccgaaaaaagcggttcaatggaggaaagcagccggaaccgatccttttttgtacaaaagtggggagacgcggataagctgttccgcaatctggaattcagtacagcggagacggacggccagatatcaacaggtaaggaaacacacgtatcagcggcaagcttttatcccatcggagcggttgttcagggaccgtccggtgcagtatttcggttagaaccgggaagaaggcggtatctgcatggagtcagtgctgcgggaggtgaaaatgtgtgccctgttagagtgtctcagctggatttgttggtgcttcccttggtagggaagccggaggctacagtttccggcaacattgatgcacctacagctgagctgccagaggaacccattcctgtactggcggctcccgatctggagaacatgtccatgctgcccacactgaatataccggctcaacgcaagcgatggatcgaggtattgtatgctgagggcgggcaactgtatcaaatcggtaacggctggaaaaggccgttccttaccctgtacgctgcgatgagctggcgggcagaggactaccgaattcagtttttgtctcccggagatttgtcggctttggtggagaagcagcctattattgctccaccggtgctgcacgggcatctgtaatgatctgaataggcgcttttaggcggaaccgactactcgctgcggcatacgctgtagtagcggaaagcccgtaggtaattcgtgcgttccgcacggcggagcacataaaggaggggcttatgcataacgagttagatgatttgctgatccacatttcgcactcgcagcagcagatgtcaaggttgttggatgcggaacggcaggtggttgtgcgcatggcgcagatcatacatgaactgccagatgaggagccgcgttttgacggaattccgggcattctcgacagctcgggacaagtaaacaaaagcattgtggcctacttgaacggtattgccgatcttcaggaagcaatggctgaaatgctcgttcgtgtcgtgaaagagacggcatacccggaagaggagtaacgtaccaaccgagggcagggagtgaacacatgagtagggaacaagcaatgattcacatgctggacgcagcctccaaaatgcagcggaatgtgtctatgatcctggaggccaaggcggtcgaagcagaaaaagtgcgtaattgggcgttgaaccatctggccccccacgcatttgacaccgatgaagagcagttgggacggcctttggaaattcacgagcagatggtggaaatgctggagggattaacgcggcttcagactggactttgcagcaatctcaaagcattgctggatcaggatgagcagcagggtggcggcatggaagggatgatgggaggaatgggctcgggggatatgaactaatgagcatgaggcgtgaacgtgagatcaagctggatatgatggagtctattgctgccagccagcacgccgttgctcggatgctgaccagtcttgcggacttgacgccccatgcggatatgtcggctacccgtctggaagaaaccattcgtatactcagcaactaccagggcgaaatcacgcaaatgttggcgggtattccattaagacggcaggtatatggaaaaccgactaagccgtggctccatgtgcctgttcagaaaaatgaaaccaccacgagaaagcaaaggaggaatggaaatgagtacaaggtgggaacgcgccactcgggacaaagcccgcaaaagacgtaaagatgcccggcgttccagcattcgcagattaaaacggagaagaagacgtctgcttgctctaagacgccgtaaaaggggactttattctgcacgtagaagacatcctcatttgcggcggcggaaaaaacctcaagctaacccggtggcagccccttctgcggagaatccacagaccgggactgttgcattggagcatgatccgcaggcatttcagcagggatatgatgcagcttacaacgagggtttcaattcaggttttgccaaaggttatgaagatggacaccaggtcgcttacaaagctcagtaaactgtgcaaatcatctagtactgttcacccccgaagctaacagctttggggttatttgcggttcggcagttggacgggcaaacgccaattttgtccgggcagtggcagtcgtccatgatgcgtttgacccctccgcatatagtttaggagtgacagaagtttatcctacaacaggacagggtgaaggatgtgaacgatcaacaaagcggaaatgaacgcgaagcgtaccgatgcggctatcgggaaggacgcagaatgggcggttgcacggctgctctgtcacaggtcgtggcaatacagcctgctgttcgtcatttgaaagtgttgtatattccgcaaggtttcgcagctatagacacaggtgtgcaagaggcattaggccaaatatgcagctcttgcgtcatcggtacgcctgctacgatgctagctgacgccgaggctcaacgtccagacctcgtgctggtcatgaacgggctgcatgtttttccggcggatcatctggagcaggtgcagcaaatacgagccctaggcattcggacggccatatggtttgtagatgatccttactttacggaggatacggcgttgatctgtcaatcctacgatgtcgtatttacgcacgaaatttcttgcctgccgttttatcgcgatcagggagtaacgagggttcaccatttgccgctggctgcgtcagctcgtatcttttatccccgaagggtagagcgggagcatcagcatgatatttgcttcattggaaatgccttctggaaccgtgtgaagctgttcgaccaccttgctcccttcttggcggacaaaagagtgctgatcgtaggtggacactgggatcggctgacccggcgggatgtgctggaacgctttatccgtccgggttttatggagccggaagagaccgctcaatattataacggctccaaaattgtcatcaatatgcaccgcccgacagaccccggactggataatcggaatacacaccagctttcagcggagtccatcaatcctcggacatacgaaatttctgcttgcggcacgcttcaaatgacggatgttcggaaggatttgagccgttattaccgaccaggctatgacattgaaaccttctctggagcagaggaactgagagtgaagctggactattatctcaagcatgactgggaacgcgaacgcatggcctggcgcgcattgtacacgactatgcaaaagcatatgtactccaatcgcatggaagaactgctggacaaggcgatggcctaaagtaaacaccataaacagtgaggagtgaaagtgatgacgatatctacgacaggaccgtatgacccggctgttcaccagacggcggcagcctcctgggaaagggggagaattgcgggagtgcatgacggatacgacgaaggatatctgcgcggacgtgctaacgcaattgttgcgcggatgaaagcagttttcccttttcgacaagtccatgtactgtatgtcgtctcaggcaaaggccttccgtattctccgctggatgaggcggtcattaccacgttgcaaagcatgacggctcaggttaccgtaacagacccacgtcagccggtaggagatattgccgctcagctccgtccgaatctgatgctggcactggatggaatggatcttccgttggagcaagttactgcggtacgccagttgggcatccccaccgccatctggctaacggacgatccatattacaccgacacgacgaccaaaattgttacaaattatgattatgtgttcacgttagaaatgaactgcatggagttgtaccgtcagttgggttgcacgtctgtgcactatttgccttttggagcatttctgactcactatttcccactcagctcgcccgcttcggtacgacgtgagattgggtttacaggctcagcctactggaaccgcatctatttcttcaatccgattatgccgcagctcatggctcgtaacattaaaatcaacggaatctggtgggatcgtctcccggattatcagtcatatggtgacaaaattgagctgggtcgctggatgtctccggtcgaaactaatgattcgtataacggcagcaaaatcgtaattaatcttcatcgttcccatcaggatgattcggtgaacaacaactcactgaaaattccgggggcttcgcccaatccgcgcacgtttgaaatttctgccagtggcacgttgcaactgacagatacaagagatgatctggctcgtttttataagccgggggaagagatagagacctacagctctcagcaggaattgctggagaaggttgagttttatttgacgcatgaaaaagagcgccatgaaattgccctacgtgctctggaacgaaccctgcgggagcacacgtatggtcaccggattgaccaactattgtcggtcatatttccataaggtgattcacacgtccgatggttgctattttaaaggaggtgaactccgatcaagccgaaaatgatgctattcagccatgttagcaacgtccgaagtattacgggggcagagaagctgctattgcaattttgtctagacatgcgtacgtacttcgattgtattctcgtaacgcctggtgaagggcggctgacctcaatggcccgcaagcgcggaatcaccgttctgacacagaacctgttcatgctgcatggcatgtataccccatatgagggattggcgcaggatgcggagaatttgcggacccatgtggcgtatgcaccattgttccagatgcttcggcatgctcgacctgatgtggtgctggtcaatacctgtgtgaacgtcatgcctgcaatggctgcccaagagcttaatattccggtgatctggaaaataaccgaggtcattaaccagaatgcgtatacgccagtttctgtttctatcattgagcgctatagccaatgggtcatcggcatttcgcaagctgtaatgcgtcctttgcatggtgggggactgacacgtccgcatacggtgttgtctccctgccgggatatggatatgccatctcccaaagagcatgtgctggaacggaaaaggaaacgtgaaaaactggggctgcgggatttccatatttgcattggttatatttcttcctttatttacgaagccaaagggctgttgccttttgtccaaatggctctaaagctgtgcgaaaccaattcacggtgtcgtttctggatcatcggcagctcggtggactcggaatattacgtaaaatgtgtctctttaatccgccaatctcgttatagccgccgcttccagttcaattcattcgaggaatccgtatcaacggcctatagcgcaatggatattgttgtaatcccaagtatggtggaggaaggctttggcctgaccgccctggaagggctggtttacggtaagcccgtggtagcctttgcgcagggtggacttgtggagttgatggaggcgaccggaaatacagattttttggtagagccggggaacagcgacatgctggcgcaaaaagtgggctatctgctcgatcatcccgaagaagtggaacggattggtgtgcgtaacaacagtgcggctacacgtgtatacggacctgattcctaccgaggtagtttacacctcatggtcagtcaatgggtatgtcatcatccgcattggttcccgttgattcagcagccgggtggacctgtatggacgagggaaggcgaagggttgcgtcaggtcaccgctataccggagggatataccagcacgattcgagaatttcccgaatcggtagtgtgtcaactgcctgtgctgggtctgccgccaatcgaatatgcagctattcaaggcttgccacaaccagtatcccctttacctgactcaccacccgaattgccccgcggcaagcgtagtattcgggcgagatggccaaagggccgcaagcgtacccgactgcggaatcgcagatataagagaagcggcggcaagagtcgcctcaagaaaattcacgggtccccgttgtcgaagggactttatccgaaaaccaagtccagacagaaactcaagcggaaattcaagcaccggtcacggcgacacaacacgcacaagcagaagcgagtcacgctcaagggtggacagcatacaaaacaacggtccgggtgaacttacgccggaccgttgagatgaacgttaagctggagcacagccagtctgctggatggctatccttcattgaacgccacaattcaatgaaacaacgacagcaaaggtgggttccaaaaccatgaaaatattgaccgtgctcggcacaagaccggagattatacggctcagcctgatcattccgaagctggaccgccatgcagatgaacatgtgcttgtgcatacgggccaaaattacaccgaaagcctgagtgggcagttctttcgcgagctgggactgcgtgccccggattatgtacttcaggagaaagcggggacactgggcaaacagttgtccgccatgtactcgcagatggaggatattttaaacaaggaacgccccgatcatgtgctattgctcggtgatacgaacagcgctttatgtgccttacttgcggaacgtatgggttatccggtcgtgcatatggaggcggggaaccgctgttatgatctggatgtgccggaggagaaaaaccggcgtgtcattgatgcgatatctaccattaatatgccttatacggagcaaagcaagcagcacctactacgcgaaggcttcccaagccaacgaattatactgactggaaatccgatctacgaagtgatgcagcactataagaaagagatatcgagcagtggaattttgaaaaagttgggactgtcgccgggagaatatttcctggtcactgcccacagagctgaaaatgtggaccatccaccgcatttgctggctattttagatggtcttaaccgggtagcccagcagttcgggcagcgggtcatttgcagtattcatccccgcactgccgcccgaatcgcaagccacccgccgatccagcttgatccgctagtggaatttcacgaaccgttcggtttttttgacttcgttctgctggagcggcatgctcgctgcgctttgacggacagtggtaccgtacaggaagaatgctgtgtcatgggggtgccgacggttacgatgcgccggacgaccgaacggccggaaacggtagattgcggcagcaatatcgtgtctggtcttgatggcgaggttatagcaaacgcggtagccataatgaccgggatgacccataagtggcaatgtcccgcgggctatctggcggaagatgtgtcggataaggtagttaaatttctgcttggagggaaacggcatgtttgaaaaccaacgtatcttggttaccggcggtaccggctcctgggggcatgagctggttacccagttactgccgcgtaaccccaaagaggtcattatcttttcacgcggagaatccagtcaggttgcaatgaacaggcagtttgaggatgaacggctcagcttctgtattggagatattcgggataaggatgcgctgaccaccgcttgtcaaggagtagactatgtatttcatttggcagcgctcaaacacgttcccgtctgtgaagatcagccctacgaggcactcaaaaccaatgtcgtaggcacccaaaacgtgatcgaggccgctgttgccaatcaggtaaagaaagtcatttatatatcgactgacaaggccgcgaatccgtccaatttttacggtatgacgaaggcgattggagaaaaactgatggtttacgccaatctgctgaatagcgatacacgttttgtgacggtgcgcggcggtaatgttttaggcaccaacggaagcgtggtgcatctgttccaaagccagattcgccaaaaaggcaaggtttcgatcacagatatgaacatgacccgcttcttcctgaccttgcgtgatgcgatcagtctcctgttcaaagcctcggtggaaagtgtcggcggggaaatttttatcatgaccatgccaacctgccgtattgtggacttggctgaggtgctcattgaggattcaggtgtggaaaacgtagaaattgtagaaaaaggtgtgcgtcccggcgagaaaattcatgagattttgatgagtgactttgaaagcctgacgacggtagtctatgacgagcaatatttggtcattctcccaacgctgaatattcctcaattaaaggaccgctataatcagtgccctcccgtgtcattcagcagctttagttcggagtttaatttgatgtcgaaagaggagattcgcagcattctccaaagcggggggttcatcaaatgaagctgcttattttgggtggtaacggcatggcgggccatgttctggttaagtatttccaaaatcagagcgggtataacgtgttctacaccacccgtgatcccgaaaataaaggtggtctgctgctggatgtaaaggacagctttatggtggagcagctggtacggagtgtacggccggacgttattattaacgcggtaggcgtactgaatcagcatgccggggaggatcagattacagcataccaaatcaatggactgttgccgcatcttcttcggcggacgtcggacagcatcggtgcccgactcattcatatcagcacggattgtgtattcgaaggaaagcgagtacctggtttatataaggagacggatcagcctgacgggacaagcgcctatgctttgacgaaaatactcggagaagtaaaggccgcagggcatctgactatccgtacctccattatcgggccggaaattcggcccggtggcattggtctgctgcactggttcttgcagcagagcggagacgttaacgggtatcgccgagtcttttggaacggggttacgacgttggaattagcgaaggcgatacaggtgcagatgaatgaaccgctggacggactcattcatctggttcaccctgaaccgatcagcaagcatgatttgctgctgctgttcaaagacatctggaaaagggaggatattcggatcgtgccgaaagatgagccggtgcaggaccggacgcttcgttctacccgggccgatctgctctacgatgttcctcactacagcatcatgctgaaggagctgctggaatggacggaagcacagcggaacaacgtcggcctgtcatagtcattaccggagcggcgggctataccgggatgcatgcctgccgccattttgcaaagctcggttgggaggtagcggcgctgactcgcactgccgcttccgtcccagaactgatcttactggctcacgatgatgaaaataacagcccagaggcggagacccgtagctgtattacgccttatgtgtgtgacttgctcgacaaggatcgtctaggcgaagtcattagacagattgctccggattacgtgcttcacctaggtggtaaaaattccgtccctgaatcttggcaaagccccctgctatacatggaatccaatgtactgtccactctgtatcttctcgatgtactgcgacctttccccaaagccagaattgttgtggcgggttctcggctaaagacggctttgcaagcaccgtatcatccaacgcatccatacagccttagcaaaagccttcaagaggcagtcgcgctctcgtggggcgcgctgttcgaacaatccgtcatgctggcagagccttgcaacttgatcggtccgggtccatctaccggattttgtgcattactcgcgaggcatatcgttcagacggaacgtctggaggggcagtccataactgaaactgccccgttccgggtatcttcccgacatgcgcaacgtgatttcctcgacgttcgtgatgccgttcgcgcatacggtgtgctattggaacagggtgtgccaggccgagtttactcggtctgcacaggccgcattgtggaactgggcaatatcgtggaacgtatggttgcgctggccaaaacatctatccccatacaatggggggatgtggaagagtcagcatccaccgaggcataccgtgcgaaagagctggaggacatgggctggaagccgaccatacagctggtgcaatcgctggaggatatgattcaataccgccgagctggaaaggaaggaacgatatgagaccgaaagtaacgatcgtcattcccttttataactgtgcatatgtggatcaggctttgcaaagtgcactagagcaaacttatggacccctcgagattattgtcgtcgatgacgggtccacggaacatgttgatatgcttcagccctatcgtccatatatacattatttgggcaaatccaacggtggaacagccagcgccctgaatcatggtatccgacatgccagcggggaatatattgcgtggctcagctccgacgatacctatcatagggacaaaattaataatcaggtttcttttatggtggaaaacggtgcgtacatctcccataccaatttcaatttcatcaatcaatacagccaagtcacaagctaccaggcagccgccgtgtttccgtctatgacggagttttaccgtttttttcagcaaggaaatccggtcaatggatgcacggttatgtttaaaaaggagctgtttgcacatatcggtttgtttgatgaactgctgccgtacacacatgatctggatatgtggtaccgagtgatgctggcgggatatccatttccttttctgaacgagtcattggttaactaccgctggcatgatgaaatgggaaccaaaaaacattggcccgctgtggagcgggagtacaacataacccaagcacgttatcgagatcgcttcagtcaggtgttgagtggtttatcctcatgaagccgaaagtctgtcaggggggattgatatggtagatacggggattgttatgccactgtacaaacaggatatcggctatctgcaagccgcgatctcatccgtactagcccagagctacagggcatttcgcttcatcattgttattgacggagcgccggaaatggtgggaccagcgctccacgcagcaatgggagacccgcgcgttcagttggttacactccctcagaacaaaggagtatcccacgcccttaactggggattcgatgagttgtttaaagatccagcgatcaagtatgtgacctgggtatccagcgacaatgtttataattcttcctttattgaacgattgcggcaggagctggagcaggggccggactcactcggtcttgtgttctctaccttccgccaggttgacgcatatgggaacccgttgtatgacgagcagcatcaacaagctttgatccggtaccaaagccagccgcatcatgaattgctgaatgccagcattgtcggggtttcatttatgtacaaaagcaaatatgcccgccagattggcggctatcggctgcaaccagttgaggattatgattactggctgcggctaaccgagacgtgcagcatgaaattcatcccggagatcctgatggattaccgggtgaattccacattcagtgtatcggctggtttgcacagccagaaggagcaccgacgctggcggcgcgcattccaaatcgccaagcatgaggcgagagcacgtcggggcatcccacttgaaatgacggttttaatgcctgtcacggatatggctcaagctgaatcattgctggataatctgctggagcagcactacagcaattgcgtggtacggttgctggatttaacgccagaacagggagccagcgctttcctgtcgatgatgctcgatcctcggttaatcgtaacgccacgtcagcattattcggtccaagaagcactggttcaggctattggtgaaaccacgacccgctttgttgtatgcttcggtgtcaaaccatatattgccgtgacggatctactgtatctcacggatttgttgcgcccattacaggatacacatgccttttcctactacacagatgaccactcaaccatcggcagcggccgaggggttcagtctgtaccaccggaatggaattacgtgtattacacccacagattgcatcaagcactggaacagggtagcttttaaataacaggagacagcgccgggattgtggtcagctctgactgaagaacacggtgttcctgtacaacattaccaaactgatccagtccaaagttggagagcacaacattcgctggagcagcggaggccacgttgtattgtacctcataggcaagaaccccttgtataaagaaggtacggcgggcaatggagtttgcaggtaagttaaccgatgtcacatacagtggtgtcttggtatccggtacaagcgagaaaaaaatttggatggtcacggttgccgcattcactgtatcctcgttgaccaaatttacaacgacattggagcaggcagtaccaaagtctctagtgttggtcatatatccggttgtaaaagccaatcgaatcatcctctcaaaaaacagaatattggaaaacccctgaagggatgcttctatactatgaatctattgaaaagaaagcttgtatggttgtctgtaggctatgctgaaaaaagtacattttaatagaaatagcatgtccatttatataatgaagggaatgctcgcgatgcctttgaattttcaggtgacacccagcgggttgcccaaatttgagcccagtgtcgccgttaatttgttgaatccgaatattgttgtggctgtcgctgttgactttagcagcgggcccccgctgattggactgtatcgttccttggacgccggggcgaactggactgatactttactgccaattccaccgggatatacaggagccgaggcaggaatggtagcctatctattcccgaatattttcatcatatccgcacatgtgtttccgggaaatgagaacggggctgtcgtgatctatcgctctacggacgatggagccacctttgatcctccagtggtcattaacccgggctatggagactacattaataatgactggaccaatattacgacggataacgccggggcaagtccctatcttgggcatgtctatgtcacgtataaccgtcaatataatgtggattttaatgctcgttctgcggcgttctaccagcgttccatcgatggaggactaacttgggatcgaccgttattgctttcgaatatccaatcttctacagaacgacctgaacctgcggtcgacaaatttggcagtgtctatgtcagttggattcgtacggggccacaaacaccggctttttttattcggagatcctttgatggaggggcaactttcagcggggatattctcgtatccaatataacgctggtgcccaatcctttgcccgtccccggttatgactttcggatattgaatttccccagcttggccgcagactgctcgggtgtgccatccacaacaaatacgctatatgccgtttggcaggactttggtcagggatacagcaatattttgttgtccaaatcaagcgatttcggcggtacctggggtgctccgatcatcgtgacggacagcccgccaggctcgcaaaatttctttcctgcgatttcggtgtcgcctaagacgggtctggtcgttgtcgtgtactataccaatcgcttggacggctttaatctggatgtgttcgccgcccaatcgttagatggaggcaacacctttacgaacagtcgtctcacgacgacctcctttaatccgaatgtcggtggaggcgaatcagagctgatcggcgactatattgatgtcgccatcgtaccgccgaatagttacatttccgtctggacggatacgcgtacaggcagcctgacgatttttgccggtgtaccgggaggtgaagcctgatgccgaacgtacagctcacgccgaacggaaggctggcgcaggaaccgagtgtagctttcaacctgctcgacggtaccattgtgtctgcggcgactgattttacgacagggacgccgttgacggcggtataccgttcaggtaacggcggtgtctctttcacccagcagattttaccgctaccagccggctatgtaggggcggaatcccatagcgtcagctacggttttcccaacttgtttgtcatagcctgtcatgtatttacctcggatgggttgagcggtaccatcgctacctatgtatccagagataacggtaatacatttgatccacccgtgattgcccagcgagggtatgggacatttgtcaacaatgttgaggtcagcgtgaaatttgatacttctcaggtcagctcctataccggaaacatctatttatgttatacgcatcaatacaatcctaactttttcggcgggtccgtcatgtttttccagcgctcacaggatggagggatcacgtgggatacacccgtggtgctcaccgctggttctaatcagatcacgcggggggaaatcaccgtgagtattactggggtgatttatgtcgggtacattgtaacgaatccggttaaccaatatcaggtcattgtgtccttcaatggggggacagcattcagttcttcgctgcctgtgtcttctgttgtcccggttccgagtccgttgcccgtggtcggctttggcttcaatgtgctgccgatggccagcattgcggtggatcgctctactagcccgaatcagggaacactttatgcggtctggcaggataatcgggcaggatatgcggatgtactgctcgcccggtcggtggatggtggattaagctggactgcaccgcaatcggtgacaggagccagtgccggggcacagcattttttcccggccattgatgtttcgcctgtgaccggcgtgattaagatcgtatattataccaatcaaataacgacctctttattagacgtatttgtggccgaatcaacgaacggagggaatacatttacgaacctcagaataacagacagctcctttaatcctaacgggattagtccggttccagtcgttacgatcggtaattttattgatgtaacgatcgtgccgaataatggattttttgcggtctggacagatgcgttatcgggtttccagcaaatttacggaagtaacggaatgtagctcagcgtacgagacagaggaggtgaggctgttttgaaaattttgttggctacgtactggccgattcctcatttgggtggcgtatggccctttatgctgcaaattaaacggagactggagctactgggtcacacggtagatttgatggggaacggaccggatacacctaaataccatattgtttttgaagatagggagctgctgaaggatcaactgctgcccctgctgcatacgaagctgaatgaatcggctgtccctgtattacatctggattcatgggtgcagacggtggaaaaggatcgatactgtatggagctggcagcggcgtatttcggggttgagcagtatgatgttattcacacgcaagatgttattgcgacgcgtgctctaagtcgggtcaaacgtaaggacagtgcgttggtagcgaatattcatggctcgctggctcgtgaagtcatgatggctctggagcgggatcatgaggagggttaccgtgagacgctgatgtggaagtattattgggcgctggagcactatggtgctctatccgcggatattaccattacgtctacagaatggatgaaacagacgctcgtgcgtgagttcgaagtgcctgagcagcagattgctactttccaatacggattggataccgagcacttctgggaagtccacgcccggggaacggacgtcgtacgacctgaggggaaaaaagttataatttgtccttcacggctggtctatatcaaagggctgcattatttaataagcgctcttggcctactgaaagcaagtcgtacggattgggtttgctggattgtcggggagggagataaaagggaagagcttcaaacacaggcgaaggagctagggctggaggaagatgtggtttttttggggcatcgtgaagatgtacctgctcttttacaactggcggacctttttgttcatccgagcatacaggacaatcagccgttttcggtcatggaggcgcagattttggggcttccggcagtggtatcggatgcgggcggactgccggaaatggtgaagcatgaacacaccggactggtctccccggttggcgatgtggaggcactggcagctcatttgcagcatttgctggctcaggatgaagtgcggatagctatggggaaacgtgccaaagcatgggggaccgcgcattggtctctggatgttatgattgagcggctcgtgaatatttatgggcaagcgctgaatcaagtacgttgaatacgttgattcttatagttaggagggagagcatgacttttcctgtcgttggagacttgtacaaccgtatttttgaaatccagcagtcgcacccagatctgaaggtcgattacgcaatatggaaccgaattaacacctcgttgccggaagattataagctgccagacgctgacattttggaacgtctgagacaatccgcaccatgagggtacagaccatataaaaaggcaggtcgggcttaaaactcccacctgcctttagtttatttcagctcattgtcatccagttttcgtcaatcttcataaacggagcctcgaattatgagcggtcccgtaacaacagcacggcggtcagctgattgtacggtcaagcagtatacataaggctctgcctgttttcccgtttcctcatagcttaactcagcaaatccctcctgataacaggaatcctgcaaccaatccagcataggtccccgctcatcattgcgacgcaatcgaatgtccagctccccgatatcccagttgagcagcggattttcccatgccaaagagacttcaatgacaatacgtccttcagattcacttgcaggaatgattaatgtagagagcacgctctcctgctcggtgacctgaaaaggcagtgcatatgtgcctggctcagctttattttgaactgaatatttcaacataccttcttcctcctctgcccgttcattagggcgtcacggtaaaatgactggctgtacgcttagcgacaatgttcccgttttccaaaaattcagccaggataaacagcgtttccgggttgtaaatactcgtcaccactcgcaggtaaaaaggattttgggcggtctccatatccttgagttctagcacggagccagcttcaggagaagggctcaatcgaaggagctgccgtcggaaaacaccactgtcatttcccatttccagcaacacatcgacggctctcttttcacgattgaaaaaggtcacatggcagctttctatatgggcgctgtggtaagcgagatgatgatcgacggttaaaagaaacacggacatatgatgatgcctccttgaattccgataggttatcagccttaatatgatatgaaaaataaccgagattggactggatagttgtacgcctctttgacaaaaagcgcattggtgtccaacccttttcaccgtgctgtgcatgtaatgtagagtggaacatgctacggcctaaagtcccttttcgactacagaagaagggtcgctgagggaaggggcgtattaaaaaggaggcacggctatgagactcgcacagctggcaggggaatatgaagcggtcttcagtctgggacaaaactgtacacctgccattcaattggaaaagaaccgtttgcggccgtttgccggggtactggattggatgatgtctgacacgctgtccgatgtgaaccgcttgctagaaaatcggtttgccggatttatggatttgcccaatttaagtgtcgttggtacgagccaactgaattatatggtcagagatatcgcttataatgtgatctcggtgcatgattttccgcaggaacgcaatacgtcctcagatctggtgacctatcccgagttcagggaaaagatagaccgtcgtatcgaacgtttttttgcaaaaacacagatggcgaagcgcagcttgttcgtccgtatgctgggaacctatgaagaagtcgaggaactggaacgtatcttgtcaggtatggtagcgaatgaatttcgtttgttggtggtgaattgttccggtgtaactgaattgacggaggtggattggcagctttcacatgtatgcgcggtggaaatgccttttgccgatgtatggaattacaaaagtgatccgcactggcgtaccctttttaaagggatgaccttgtcctcggaaaggggagggcgtcgtgcttgagcggttgcaggggaattatgatgctgtattcagtctgggtggacattgcttgccttccattcagctggataaaaacggactgcgtccttatgcgggtccgctggactggatgatttccggtaacttgtcacaggtcagtcgcttgctggacgcccgttttgccggttttatggatgttgatagtctgcgtgtcacggggcacgattacggcgagcataacttcatggtcgaggatgcaaactatgagattacagcggcacaccattttccggttagcgagaatacatcggagcagctgacttcctatcctgcattcaaaacgacgcttgatcgtcgcatcgcacgtctactggatcaattcacgcttgcgtcccgtctgctactggttcgtgtcgggggcagtcgggagcaagcggtgggactacatgatgtgttattgcagaggattacacatgattttcgcttgttatacgtggattatacagggaatgatggtgtgacggagctggattggggattggagcggctggtttcagtggagctgccgcctgaggatatatggaagggtcaagatgagatgtggagttatatgctggaaaatgtcaggctgcatgtctgaggtgctgagattctagagacacactatagattgtcttcggactgtgcttgtgcctgcgccaagctatagggagtcgcataacatgatgcgaagggaagtcatatgcttcggttcaaaaggagggtgagctagtgaaggctttggtcaccgggggagccggatttattggttctcagctggtacgtgcgcttgctgattcgggcatcagagtgcatgtgctggataatctgacgaccgggaatatcgcaaatgtggacccgcgcgcagtcatgcatattgcggatattcgcagctctgaagctaggacgctgctgattcgggaaagcccggatattgtgtttcacttggccgcacaggcggatgtacagcaatccatccatcaacccgatgaggacgcggatgtgaacgtgctggggacgatccatttgttgcaggcttgtcatgaagccggtgtgtcaaaatttatatttgcgtccacgtccggtgtatatggagagctacaaaagcaatgtatacaggaagacgatcccgtggagccgatttcaggctacggactgtccaagctgaccgcagaatcgtatattcgacttttttatcggctgtacggaatgaactacacgattttgcgttatggaaatgtgtatggtcccggtcaggctgcgaagggagagggtggtgtagtcgctctctttatggagcggctgaaaaaaggaagccccttgctcattcacggtgatgggacacaaacccgcgactttgtgtacgtcaaggatgtcgttcgagcgaatatggcggctattcatgcagcggatcaacgcacagtacatgtaagtacgggacggacgacgtccatcaatcgactggcctacgatttactaaagctgcacggttcgtctgtccgccctgtatattcaccggcgcgagcgggagacattcaccatagctgtcttagtaacgtagtcgccagacattggcttcgttgggaaccgctatacggcatttctgccggtttacaggaaacgtatgtgagcagtatgggctcaggcaaagaaggtatgtcttgatataaatcgcgcggatatcaagaaagagactgaggaaatactcagcctctttttcatttgaatagcaattagatgttctcgccagccagcttcaaggcttgatccaggactgctgcaccgtttcctctaccataagccaacgtgtcaatgacatctacaggaatgctatagggagcagcaatttcggttactgcctttttacgcatccgtacttgaggtccgagcaaaatagcaatcacagaatctgtaatgccttccagctcttccttaatggtgctttcggggatggcttcgatgttcagctctatggatcttgctgctgcttcttttttcattttagaaaccaaaatggatgtggacatacccgcagcacatgccagaataatttttttcatcgttgagcgcctccagaaattcatttttaactacttatgctctttactcagatcagcaacaaacgagcgttccttgatagcagcttgataccagtagccggatttcttcaaatgccgacttcgatcattgtctaggttaatttccaccagtccgtagcgatttttaaaagcattcatgggagaaacgttgtctgtaaaggcccacagcatataacctgtacagttggagcctgcttctacagcttgtaacgtgtagtataaatgctcagttataaagtcaatacgatagtcgtcctgaatgatgtgttcctcatttttgaaggcaacctcattctcaatgcccataccattttctgcgacaaaccactcgatattgtgatattcgttcttgatacgcattcccatatcgtaaatgattttcggataaatctcccagcctcgtgacttgttcattcttttacccggaagatcaaaatgctcatagtagtaagaggggtggaagggggtgttttcgttccacgctttactctgcgctttgacccggtggggataatagagattgattccgacgtagtcaacggtatttttcttaatcacggccagctcttccgttgtagcttcaaatgcaatatcatgcttgcccatgagatcaaacaattcttgtgggtattcgcctttaataagcgggtccagaaatactcgattgtaaaataaatcatacacatgcgccgcgtgttggtcatgaggggcgcttgatcgggcatacgtgacttcgggattcagaataacgcctattttagccccgtgctgactatagttttttgctttgaaaagctgtacacacttcgcggtagccagcgttttattatagttccattgcatccacttccgcgtattttgttcatagggatagcggagggcatctagatagacacgcgtttgtacaacaatgggctcattaaatgtaaaccagtgcttgacccgatccccgtaccgttcaaacactttttccgcatattttacaaacagttccactacatgcttggaggaccagccctcatatttatccatcaaataagcgggtacctcatagtgctccagacaaagcatcggctcgactccgcttgcaatcagctcatcaatgactcggcccatataatccgcatacgcttcatccaccactacattctcataatccgttaagaagcgggaccaattaatagaagtacgataatgggttaagccaatctgcttcatcagcgcaatatcttcggtatagcgattataaaagtcggttgcaaccgcgggtccatatccattgtgccagacatagcggtcatttttgtaccattggtctaggtatgagtcctgaccttcttttttaccgctccatccctctgtctgccaagcggaagccgctgcacccatgatgaaattcgacgggatttgtatcgtatgtttagccatgacatgtttctccttttcattgtataaagaatgcgttttcaattaattgatgtatttctatagtaacgcattattcagccattcgcttgttggcaattttgacgaacgggaaataaatgataatggctaccacaatacaaatgatctgagttacgacggcgccaatgcttccacctgtagacaggtaggcattaataataggcggagtagtccatggaaccatgacgacggctttacctgcaaatccaagcaacgtcgagaagtaaccaatcgttcctgtgatgagcggagtaataatgaaagggatagccatcaatggattcaacataatcggaagtccaaaaatgacaggctcattaatattaaacagacccggacccaacgaaagctttgttatttccttcatatcttcacgcttggaagcgatcataatacaaatcaagagagccagcgtaattcctgaaccaccgatactcatgtatacgtcccagaaaggcatcgtaataatgttcggaatgggcagtccttgctcataagcagtcatgttgacggtaatcgcgccaagcagcaggggttcacgaatgggctttaccatttggttcccgtgaataccgatcacccagaagatttgcgcaaccagcatcagcaccagtatacctggcagtccctgtactacggtctccagaggtttttgcaccacattatagacggcatcgtacaggtagagacctgtaaacttatgaaagaaaaatccgagcattgagaagactgtcaccgttatgatggttggtatcaatgcagaaaaagaaacggccacattgctgggaacactttcaggcattttgatttttagcttatcggacttgcccaacttactgtacagctcaacggataggatgcttatgaaaatacctaaaaacaagctcttggtatccgtaaattgacgggctaagacgtctgttactttttgcatgtcaccgttaaccatcaactctatcgtggttggtgtcacagagataaaacagattaaagcaagcaaaccggggaagagatttttctcaccgttaatttttcctagctccagaccaatcatgaaaatagccagaatggtaaggatattcaagctggcatagttaatgcccgagaaaatcggtttgtactcagccaggaatgagaacggcttaaaatgcgcaaggccattgaccgggtccatgaccatattagaaatcaatacagcaaaggcaccgacaataataacaggcatcaatgtgataaaagctgatttgatcgctataatatatttaaaattattgattgcatttgctaccgatgtgaggccctcgaccagtttgtctttgaatgccatgggatagcgtccctccctctacaatttcggtacgaattgatcaatgcgttcatacaggtctacaaactctgaggccatatcgcgaatggtgatggcattcatcagatgatcttgagcatgtaccatcatgacggacatctctgttttttcacccgctgcttccttgcggataattctggtttgaattttgtgggaggacaccagttcattttttgctgtggctaattcatctttggcttcccgaaatttccccgcctttgcaagctcaatcgcctccatggccgagctgcgtgcattccctgcgtataatataatttggaatacaatctctgtatcatccatgtcctccatgttcacggcgtgctctgtagattcatcattattcacgtgatcctctctcctttcaatcatcctcgtcgtatggctattataatttggaatcgctttcaacataacgcacattatttcctcttcttaacggaaataaattgttcttcatactcctcatgttcaacaatttttatgcaacacttctatgaattctgtatatgttttgcagcgaataagctgctggacgagctgttcattatttaaaatttcaagcaaaatatgatacatagtctgtaaatcttctgatttggtgcgctgtatacagagcatacaaataaactgtaccggcttgccatcccaatcgattgctttttgtaatgtacagatggcccaaaacgtagaatctgcgaaaggttccatcggatgcgggatcgcgaccaagttgccaaatgaagtgggggaaacggcttcacgctctattacagattgcagcagggggccttttacaagatctgcttcgtgtattttttcagctataaattcaagcacttggagtttgttctcaaacttctgttgaagaaagaccaatttttttcgtacatactgcacagcaggaagtctggcctcagaaatggcttgctcaattttagtaatatcggaaccgcctaaaaatgtatttacatggatcatggggatagaaagcggttctgaaatggggatcgtgctaatgacaaagtccagtgtatccaacggcatttgtttcagcttataaaattcagtggttcctacgatatccaacctggaaccgaagaccgattgaagcttataatacagcagcttagcgctgccgagtccagaagcacatacgatcatacatcttttgggcgcgtcctccattttctttctttccatcgcgactccgatatgaatagctaaatacccaatttcattttcctcgatgtgtatatgaagccgctgcttgatgacttccgcagcaatgatacctgcttcaaaggcaagcgggtaattggctttgatttcatccagcataggattacgcaaattcattccgtattgataacggttgatcaccggtttgaggtgaaggcaaaatgcaatcagcaattcttgatcgttatgaatgttcatcttcaactgctgatcaatttggtctagtatttcgatagtcagttcgtagatatctttatcaatgatctttttaatctccacctcatccatacgggcactaacgacggtccttacacccaacaggtgaacagcaatgtacgcaacttcaacaagtggaaaggagtgcttcatgatttgttccaaggcggatacgatctcagtcgccaccctaaactctttctgcgcttcaatttttttcatctcttgcggataatacgacacatacctttcttcgcgaatacgcttacatgctatagcgatatgaatgaccagattgttcagggcaatgtccgacaactgaatatcatggatctcaatacgatccagaatcacttctcttatgaattccatctcttcgttagagatcagaagagggggtgacacctgctgctcgcctatttcatctaacctgttaaatatatagtcggaaatgcaataacgcagcttggcctcattacctttgactcgaataccatgatagggtctattctccagagatagtccgtaagttgccagtaacttgcgcagttctttgaggtcattctgtaaagtagatcgactaacatacaggatctcggctaaatcatcaagtttgacatatgcattggtaagcaatagctttttcattaaaaaacggtttctagcttcagaagaactcgctaatggatagggcacatgatgatcataatcctttaattgcttcagtagatgatgaaatgcttgttcgtcccgaacctctaacttgtatcctgttcctttaaggggcttaactgctgctccatgctttgacaacagagcacccaattcctttaaatccgttcgtatcgttcgagaagataccttcaatgcatttgccaagtgttctcctttgaccatctgttctgcaaccaatatacgaagaatatcaaaaatacgcacaacgagccccctttcttagctgttctgatgaacagtatacaacggttagagcgtaaccaaaagaaggattaacagcagcgtgaatgctagatgaccttgacacactagcagattcggggatatagtggatacaataagtctttgattgaggtgtagttatgaaatttacaaaagcaacgaattatgctctgcacactatgctcatgcttgttactgattcgtcggtgaagccggtaggtgttcagcaactagccgaatcccaaaatgtttcgccaacttatctttcgaaaattttgacaaggcttgtgaaggctgggatgatcgaatcggtttctggagccaatggaggctatcgcctatcccgtcataaagatgacattacctttttggatattatccatgccattgaaggaacgaattctttgtttgaatgtgattttgtccacggctccgagtgcctgattcaagctgtaatgagggaagcagaggagaaaatggaacgacatcttaaaaatacgaaattggtcgatttggcgcaaaagcaaacgcaagtttcaaagtaagcgactttatatagaaagagggtggttgccagttatgtaaagcttttttttgttttattgaagatataaagagtctctaatatcttttaaaaggagttggatgttatgctgtacgattgcgctattattggcggagggcccgccggattgaatgcagccctcgtgcttggcagggccagaagaagtgtggctttgattgataataatcggcccagaaatgcggttacgcatgcgtcgcacggttttattacgagagacggcgtaacgccggccgagttccgccgtgtagcttatgaggaagtgttgcgttatccgtctgtccatcatctgcaaaccgaggttgtttcgattacaaaaaacgaatctggatttgaggtacttgattcgtcaggccatcgcgttcaagcgcggaaattgatattggcgacgggcgtaaaggagatattccccgagattgaaggtttttatccgttatacgggaaaagtttatttaattgcccttattgcgacggctgggagttgcgggatcaaccgcttgtcctcgtctctgaatcggcagctatatttcatacagccaaactactccttaactggagtaaggatttgatcgtctgtacgaatggtcaggcatccctgtcggacgagcaaaaagaacggctctattctaaaggaatcatcgtaatggagcaacctgttgcggagttcatcggtcacaatggaaagcttgagcatgtgcgctttacggatggcactcaagtcccgaggatcggcggctttgtgtctccccagtttgtacaaagtgcaccgtttggagaacgtttgggctgtgaaagaaacggagtcgggtgggatcaagacggatgaagcggggagaacctccatacctggtgtatatgctgccggggattcatcgtacttcatgccttcccagttgatttttgccgcggccgacggcagtcgaaccgctgcgagcgtaaatatggatttgacagaggaagatttcaacgaataaccataaatttgaatatcccatatggagttcgtaatagaaaaggccgccaacacggcggctttattctaaaatcatagagacagcaagcaataataaaccaatgatcataggttattctgaggctaaacaagatcttctttcaataacctccgtattcacaagaacctgagtatgatgcccctgatgatggttaagcctctccataagcaagttgacagcagttcgagccaaaatatcctttttcacatgaatggttgtgagttccgggctaatcaccttggcttcatgtatattatcaaatcccatgacggaaatttgctcaggcactcgaatattcatttcttgaaacgttttaatggcactgatcgccatataatcattttcacaaaatagggccgaaggtagctcattcagttcatgaatagctgttttaaatgcgtcctgtgacatcacaagcatgggatgcatatcaaatgtaagcccattttctatggaaagattgtgctcctctaaagccgccataaacccttcctttcgttttgtaaagttaagaatcctcgtactggattgtacgtatcctatctttctgtgtcctgactgcattaaatattggcctgcctgatacccaccaagatagttgttaatagatacgaaactggcatcgacgtgttcaaagcaggtatccaacaccacgatattggaatgaatggattgtatggaatgaatagtctcagaagttaaattggtaccaagcagaagtatgcctgaagaaggctgatctttttccaaagcagataattcttcttccaggctatggctatcaaaagacgaaaaaatcaaggtgtttccatgttctctcacctgattggtaatatgatgaattaactcattgaaaaatggaagtgaatcataatgttctgttacgatgtctgtatttttacaggccacaaagcgtatcacatgatgatttttaataacttccttgcttgtcttcatggtgcgtggtttatatccatgctcttgggctatttttagaatttgctccttggtttcttcactgactccgggcttgttattaaaagcaagagaaacagcagatttcgaaacacctgcaagccttgcaatatcatcaattttcaatgtggaaccccctattgaactaaactacataaattatatcattactctgcaagaaagtttagcttataaactaaactaaactaaatgactaaaaataaaaatttgttgaccgtttatgatttatagtgttaatattcaagtgtaaagcgctttaatttagttattttgcgaaataatcatataaatttagttgtttatttagttttgtttagagaattttgtgaatacagcaagagaggaagggtgattcatttgagtttaaacatggctgaaaaccaaagatgttttacaaaagaggaaaaaccttttttttatttggcagatacggtttggagtgtatttaccaacgcgacgatagaggagtggagcgattatcttgactatcggaagatgcaaggtttcaatgtgttgcaaatcaacatgctccgacaatgggatgcaagtgaatcggatctgaatctacagccgtttgcattactggaaaatggggatttcgactaccatacattaaacgaagcttattttgaccgggcagaaatcatgttgaaaatggctgtagagcgtggatttgttccggccctggttctattgtggtgtaactatgtgccggatacatgggctgaaatgttccaaaagggtaataaaatgccgtttgaatgcgttgaaccctatgtaacgtacgtcgtaaaccgtttttctccatttgatcctatttttctgatcagcggggatagtgattttccgaccgaacgtgccaattcctattatttaaaagcactggaaattgtacaacaattaagtcctgcaagcttaactacgctgcatattcaaggaagattgagagaaattcctccagcctttgagaaacaccagggtcttggattttatatgtatcaatcaggacataattccgagtttcagcatgtgggccatgagattgctcaacatttctaccataagccggatatacggcctgtcattaatggagagccatgttatgaacaaattagttatagccgtaatgtgtatggcagatacacagcactggatgccagaaaagtagcatggcaaagcctccttgcaggcgggggtgcgggcattacctacggagcgcatggcatttggagctggcacaaaaaaggaaagaaattcggcattgtagaaggggaaggattcgatagtccctatgattggagaacagcattgcgatttgagggcgcatgggattattcctttattaaatatttgtttgaaatgtataacctgattggcgtaaagccgttggatattgttttaaacaagacagaggaaatcagagctgcggggaacgagaatatcattgtcttgtatgtcccggttaacacgaaggtacggctaagtatcaacgtgcaggattacaagtttacaacgattgatttagccgggaagcggtttgcccaaaccgacgtgtctgtccaaaaggatcaatcggtactagatatgcacagctttgaaagtgatgttgtcattatcggaacgaaataaaaacagagaaaaatgtggatggagtgaagcaacatgtggaaaatcggcgtcattggaacgggatattggtcggaaaaacatataaaagcatggcagtttatctcggatgtagaaatccaaggattttgtgatcgaaatcaagatttactttttgaaaaagcagctcaattccatatccctactgaatattgctataccagtctggaggaaatgctaagcgaagcggatattgatgtcgtggacatcattacacctcctgagacacatctggaactggttcgactggcggccgcagccggaaaacatatgatgtgtcaaaaaccttttgcacgttctgtggaggaagctgagcaaattgtaagtattgctgaagcagcaggagtcagacttatggtgaccgaaaattggcgttggcttcagccttttcaaattataaaaaaattgctggcagagaatatcgttgggaatatgaatgttatacgttatacgcataccgatttttattcgccgaggtttgctccggaaaaagagctgccgcagccatttttcagagatatgcccaagctcttgttttatgaaatgggagttcattggctggatacttggcgtttcttattcggtgaacctcagcgtttgtatgcggaaaccaagcgagtcagcccatacacacagggagaagacacgggcattattatgttaggttatgaacattattttggtctaatggatatgagctgggcgactcgtagggaactcaatgggcagcttccagagcaggtccttcccgatcataaagaacagctggtgattgaaggcgatgaggctaccctaaaactgtataacacaggtaaattatgtctcattaataatcagggagtcgaaaaagtattggttgaaaagactgaattaaactatgaggaaagccataaaaggctacaggctcattttatagattgtctcaacacgggaaaagaatttcaaacgagtggtcatgacaatatcaagactcttcagcttgtattcgacacctatgacagcgcagaaaatcataaagttcatgtgtattaagaggcaacaggatgttcattaacgatattgtgatgtatgttatcgctctttttttagtgctgggtgcattggatcaatgtttgggaaatcgctgggggttgggacaagccttcaacaatgggcttatgaccatgggttctcttgccctggtcatgataggaattgtttccttggctcctgtactcgcctcatggttgattcctattgtttcaccattatatgtggcaatgggtgccgatccggcatcctttgccaatacgatattggcggtagatatgggaggatacgcgcttgcggcagaaatggcgcacagccagcaagcgggtttattttcctgggtttttctagggaccatgtttggcccaacgctcgtatttacgattccggttgccctcggcattttggaaaaagaggatcatccatattttgcaaaaggtatcttgatcggtattagtacaattcccgttggttgtttcatagggggaataaccgctggttttgatgtgataatgattttaaaaaatctgattattcccatgccttctttcaataatcattatgctgggtttacgtctatttacggagcttacaatccgattgttcaagtggtttggtaacggcattaggcttctatcccttgtcggtttggtagcgattggggtcgaaaccttaactggatttgtgattattcccaatatggctccgttgtctgtcggtgtgcaaacggttggaacgattgctattgtattggcgggtgggtttccgttggttgcttggattacaaaaatatttaaaaatccgcttcaacgggcaggacgtttactaagcatagatccatcgactactgcgggtctggtagctagtcttgctcataacattcctacgttcactttagtcaaagagatggagcccagaggcaaagtgattagtattgcttttgctgtcagtggatctttcgttctggggggacatcttggttttgtagcaggaatggacaagaatatggtgattgccatgatcgtgggtaaacttgcaggcggaatcagtgccgtaattgtcgcagttattgcacatccgactactacgaatagaaaaatagaaagcgcatccaagaaggagtgaacatgatggatcataaaaaaacagccaaagaagtatggagtgccgtgggcggaaatgaaaatgtgaacagtgtcattcactgtgtcactcgattgagatttaaactgaaggataatcaatttccagataaagaaaagatcaagcagattgacggtgtcattaccgtcgtggaaagtggtggccaatttcaggtggtcatcgggaatgaggttcccaaagtttatgaagctcttttggatataatgggagtaaagcatggagatcagatggttgaagaggatcaaaagaatgaaaaagcgagcctattcagccgatttgtcgatgtaatttcaggtgtgtttatgcccgttgtaggtgtgctcgctgctgtggggattctaaaaggactattggccttatgcacatccctaggctggatgactgatcagatgggcacgtataaaattttatatgcgacagcggacgctatgttttatttctttccggttattctagggttttcagcaggtaaaaaatttggaggaaacccgtatctgtctgccgttttgggagcagcgatggtgtacccgaccattacttccgcctttacggataaaacggcgttgtcctttttgaccatacctgtcgttctgattaattatacttcttctgttatacctatcattattggagcgttcttggcagcaaaggtcgaaaaaatgataagtaagtttgcacctgcctccattaaaatgttcatggtgccttttctgaccttggtcatcatatcaccgcttgtttttctggttgtcggaccgatagcaactataatcagcgatgggttagccaaaggctccatgtggatttaccagttaagtccggctgtagctggcctcgttctggccggattctggcagggcattattatcttcggtctgcattgggcattcattccaattctactgaataatgtaatcacgaacgggtttgatccgattaacggtatgctattctgtacgacatttgcgcaaacaggtgcggcatttgccatcgctttgaaatcacgggaccctaaattaaaacccatcgccacttctgccacaattgcgggtttgatgggggttactgaaccagctatttacggagttacgctacccgccaaaaaaccgtttattttagcttcgatcgctggaggtataggaggagctgctgcaggcttactcggctcaacggcatatggatttgcctcaggtggcatttttggtatacctctattcattaatccaaaaggcatggatgcaggctttatcggctttatcatatctttggttgtagcttttgtagtcgcatttattttgacctatcttttcggttataaaaatgcaaaacctgcgtctgagattaaaattgcagatgaaaacaaaaaagaagaaaaagcggtattcagtcctctacatggtgaattgattcctttaaccgcagtaaaagatgaagctttttccagcggttcgatgggccggggggccgcaattattccgaaagaaggagtagcctatgcgccatttaacggaactgttgttaccgttttcaaaaccaagcatgccatcgggcttatttctgaggatggggttgaactgctcattcacattggaattaatacggtcagcttgaaaggaaaacatttcacttcctttgtgtctgaaggggatacgattcaaaaaggggacaagctggttgaattcgatcccaaagctatagaggatgaaggatatgatattaccacatccgtcattgtaaccaatacagccgtgtacacggatatcttagttgaaggctccaaggatattcatgcaggagaccgcttactaaagattagatagattccaatattccataataaaaaggcaagttaaagctgacggtgacccgtatataaaaagggttgtcgtcagctgttttttagttacctcacacccagcgtgttcatcatctgccggaaggagcgcacatatttatccggtgccaacagactaacgattcgctccagccctttcctgcggatagattcgcgttgaggtacgttgttcatcaggtctagtccttgcagtatcgcctgcaagatgtccccctgctgataaaatttaccggtttcgttgtggtcaatgaatgctcgtactccgtctgaatcagagcttaataccgggcaacgacaggccatcgcctcagcaaccgcatagccgaagccctctaccagcgaggtcgatagcaggtagccgcctgagtcgccaatcatggagtagtacaggggcatttgggcatgaggtacgcttttaaaacgctcgataatggaggacatgccaagctgagcaagcatgttctcgaattgtattttatcctccggctgagacaaagtgtcatcataaaacatccagattcgaagatccgcacggttttgcagcatccagtaagaaatgtcgacaaaatgcctccagttcttgttgggctccaaccgcccaacccaggcaataatcggattgatcggaggagtgttaggtacataattaaatacgctggtatccagtacgtttggaaatacataacgattaagccatggacacatgtcggtaaatagctgcaccagatgagttgtattgggcaagagcaccgcgttggcatgtttctgaagatacggaactgcatccgcgaccacccaagcagcctcttcgtgagaaccaaagccctgcgattcatagattaatatcccctgataacccaacattcgcagtctggggagcataggataatccgatgatacgataattgcatcatagcggttagtaattaccagcattcgaatttcttcttcagaggaagtcatgaatacaggaatatcgccgttcaggttttgcatccctgtaccttgctgataatagagaagatgacattcaatcccgtcctgcatgagcactttacagcgttggcggttcaaggtttctacgccgccactgggtatataaaaagtaaatagaactttgatctcaataacctcctttgccagtcacaagctcctataccaagttattcaacctacaggacggggtgtgggtttctatggaagcctagattgaattagcgcataattatggctaaggcgagaatcgtccggggagcgctctgttgcttctctcgcaaattcacaagctttgtgtaaaaggcctaactcgtagcaagcgagggcaccaagatcatacagtgtggcgtcccagcaaaaatcttcttgcatgtacgtatcgggtcgtgttgaaatacgcaacgcttcttcaaccatatgatagacggcggaccagttccgtgtatgataagccagctgagccatttccgtgtaaggttcacgtaaatacggcgcttccgcaatagcccggtataaccaacgtgttgcctcctgccattgttcacttgctttataggctctagaaataaagcgcatcgaagcgctgcgttcatctgcccagcgtgcctgcggcatggtaagatgtcgttgcaatgtagtaatgcactcatcccagcggccatgatacatatattctcgccccaagtaatgcatgttgcggtcatcctcgggaaactcgcgcacagactgctccagcagcggaaggtattggctgcgggatttgtgtggatcgggatcatgatacaagcggagctgatcggatcgaatgctacgttcttcactttccccgatatattcaagcacctcgtgaaccgggcgtacccagcggtaaccgtgacgagtgtgtattttttctttccagaaccatgtatagacggtatcttgcccaggctgtccatgcgtaaaggcatatagcatccgggtagttccttccttccagttacgttccagccgcgaccgccaaccttcctcccagacttcgtccagatccgtacagacacaaatatctatatcgtcagggaccagtcgtagggactcattgcgagccttgtcaaaacgccaaggatttacctcgatacgatgcacctctgcacccgcttcgcgtagcagggaaacagtatcgtctgtagagccggtgtccgctacaatgacaacatcggcttcacgcatggtgtgcatccagcgtttggcgaatcgggcttcatttttgctaatggcatagacagctatcttgtaccgattcgattgttgcattccgcttgctcctcctttgacttacttaaagattgaggggtgagtatgggagacatctctattggggaggattcaggattgagctgaaaaattgccgattatgcaggacatgcgggtcgttgggaacgtacattgcagcttgttcgttgtgccaatccgcacgtgtgtaatccttcatccgaaaatggcaaatgcatagctggatatgaggaaaccacgtttggtacgcgtcctgtaccgggcccatcgtgtcgggaggattcagagtggtagccatgtcgtaccaataaatagccttggagatctcatttttatgcaaaaaataatgacctatccgacagcatagatctgccctgggcgtatcgaaggtcaaactatggagagccgcggtaatactttgctccagcttgccaagttgttgcagacagtcggccattttgctacatgcactaatcgcgtcctctacccagcactgtccggtatccagaaaattctggtaagcctgcacggcctgctcatatctttcattatctcttaactcgttagcgtaatagtagaggtcacgaggagagaaggtatgaccttgggcgagcaacttctcataaattcgcagatttcttcctggagagactgtatgtgttctggtatgagttatggcgatatcggcatgttgaatattcccgtctacggcgaggtactcatgcacagctccgtgccaacggaatccggctgaccttctgatcaagcggtttcggcgaaaatgtagggtgacattgccatgatcatcaaagccataatgataattcatagacacggaatcgacggttggtacggctgaggaatcaagggtttgcttcagctcaagcagcttgacggcatcctgctccttcaaaatatcatcggcatcaagccagagaatgtactcctgcgtagcttgctcaaacgaatagttacgtgcaagggcaaaatgatctacccattcaaatggaaaaattcgatctgtaaagttgcgacatatgtcaatggtccgatcctgtgaacctgtgtccacgatgttgatttcatccacaataggatggaccgattccagacaacggccaattgtattttgatcatttttgacgatcatgcacaggctgatactgatcaattgagcatcactcctttgggaaccatctaagagttcaggtcaaacataaagttggatttaaaagaggcctgatttatagaagccctgccacaatcgcggcagggcaaggatgacaaagcttttaacatgctgtgcggctttgtccataaggtatggtacatcgcttaaacatgatgtggtagaaaaggagcttagagtccggtaggccccgtaggtccagtcggccccgtaggtccaatcggtccttgtggaccagtgtctcctgtaggtccaatcgggccagtaaatccaaacggtccggtaggtccagtcggccctgtaggtcccgtgtcgcccgtaggtccgacaggtccagtagcgcctgtgtcgccgataggcccgataggcccgataggtccagcagatcctgtatcacccgtagcgcctgtaggtccgacaggtccggtagcacctgtatcacccgtggcacccgtaggtccgacaggtccagtaaatccaaggccaaatggtccagtaggtccagtcggccccgtaggcccggtatcgccagtaggcccgataggtccggtaacaccagtgtcgcccgtggcacccgtaggcccgacaggtccagtaacaccagtgtcgcccgtagcacccgtaggcccgataggtccggtagcaccagtgtcgcccgtagcacccgtaggcccgataggtccagtaacaccagtgtcgcccgtagcacccgtaggcccgacaggtccagtaacaccagtgtcgcccgtggcgcccgtaggcccgacaggtccggtaacgccagtgtcgcccgtagcgcctgtggcacccgcaggccccgtagcacctgtagcgccactagcgcctgtagcaccagttgggccggcaggtccggctggacccacagctccagctgcacttgctttaacaagagcaacggcatcaatagctacatcagcggtgttagccaaggcgtttttactaataaccaaaaaggcataggctgcgttggctggtacaggagctgttacttcgtataggctttgccatgtcccattcacagcgtctggtaatgtacctgcactcaaataggtagttagccccgtgccaaggaagctaaaggttgcgtcatagtaatacagaaaaatgttaacttgaggactggacagatttcctatttttgcagctgaaaggcttaacgtataactttcgcctggtgcagcaaaaacgacctgggaaagagatgcatctactgcgcctcctgtcaggatcgcactataaaagtttgtcttttttacagataagttagtgacagtcacattgacagagctccaaaaaagggttgatccgatctcgaagtcgccgttagaaactagattggtaaacaatacactcatcgcttttatacactcccttcacacgttgtaatgatagtagatgcgaatccataccttagcgaaccgtacaagtttctgagggtagatgtgtaattttgtgttcacatttcagacacattattttaagcttctatttaagtgacgttaagctggagttatatgtgggggattattattagaatttaaaagtgtagcataaggtgcgaggagaccgctccgcgaaggctttgggcctccgatcgctgttgccgtgggatttttctgtgattaagtaagacatgtaaaggtaagaatcccaaggcaaaggcgaacgctggcgcttctccagctccaaatcctccgctccgctgctacccgctactgatgcacattttaggtggagggaagtaggaggaggccgcttcgcgaaggctttggtcttccgatcgctgttgccgtgggatttttctgtgattaaataagacatgtaaaggtaaaaatcccacggcaaaggcgaacgctggcgcttctccagctccaaatcctccgctccgctgctacccgctactgatgcaacattttaggtgggggggaagtaggagagaccgctccgcgaaggctttgggcttccgatcgctgttgccgtgggattttttgtgattaagtaagacatgtaaaggtaaaatcccaaggcaaaggcgaacgctggcgcttctccagctccaaatcctccgctccgctgctacccactactgatgcaacattttaggtgggagggaagtaggaggaggctgcttcgcgaaggctttgctcttccgaacttattgctatggaattcttttgatatgtgtgtgtagttcgaaatgatttgtcaatacgataaaggaaagggtggaacatgtgctcaaagtgcagcaggtgagcaagtggtatgagggcaaccggggtgtacataagctggattttgaaatgaagcgcggtgaaattgttggtttcctggggccgaatggtgcgggtaaaacgacgacgatgcgcatgattacaggatatcttcaacccaacgagggagtgattacgattgatggtatcccgattcaggataagggtagacaggcccgttccaaaatcggttatctgccggagactccccctttgtatgaggatatgtccgtaagatcctatttgaagtttgtagctagtattcgggacgtgcctgcgagagagcagaagctgcgtatttcggagatgatttccaggctaggactgaatgggcgggaaaaacaattagtccgcagtttgtccaaagggtataaacagcgcttgggactggcaggtgcgattattcataacccggatttactggtactggatgaaccgacttcgggtttggaccccaatcagattttggagattcgtcagctcattcaggagattggcgaaaatcatacggtattgctaagtacgcatatattgcctgaggtggatgcgttatgcaatcgtgttctcatcatccatgaagggaaactggtcatggatgggcgccctgacgcgctcggcggttcgatggaagatggattcaaggtgaaggtggaggtcagagggaagtgtgagcaggtgctggatgtcctgcgtacttggggaaaagtagaggttgaatctatggcggccacgcagcctccagcgaacacgaagctgactgccgcagagccagatatgaccggattgctactcacaggagcctctggtgaggattttcgcgaagaactattttatgtgctgtctgatgcgaagcttccgattttggagatgaaaaaagaaagccttagcttggaaaatatcttccagcagttaacgacccgcgagacggaagaaggtcaggtcagcgatccagcagtacaagatctacattcctcggagaatgcagcccctacggctatcacggtggagcatggagatgctgcgtccggcgacgataaggctgaagaagataaggatacaggaggtaatcggtcatgaggcgtttgttcgcggtctgtcaaaaagagctgcaagcctatttgtggacaccaacgacctattttgcgcttgcagtgtacatgctgctgacgggtttacttttttatacaaattttgttatgtatcagcctagcattctggactatcggctggtacttggtgacaccttgtccatgctggtgttcgtcgtcccattactcacgatgaggctggttgcggaggaattcaggcaaggtacggatgaactgctacttacctcacctgtgagtgtgacggaaatgatcgtgggtaaatttttggcgtcgctgggcatgttgctcatattagtgctgtgcagtctagcgtatccggtcgtgatgtccttttatgggtcgctggattggacactggtatttacatctgtgatcggtctgtttatgcttggcgcagccatgatggcgatcggcttattcgcttcgacgctttcacagcatcagatgatgtcagcggtcgtcggttttattattttacttgtgttctggatgctggattcgtttggtggacagacgggtgcatctgcggcggggcagcaatggctggaacctttttcactaaccgcacggtttgatagtttcaccaaagggttgctgaatggagccgatgtgatgtactacgtgacagtggcggtgctctttttgctattcagcatccaggtggttgaacggaaacggtggaggtaatgaatatgaaaaaatggctgggtcataccaatagtgtggtactatcaattgctgctgtagggatttttattttattgacgttatttctgcggtcgttagggggctttcaactggatctgacggcaggcaagcagtatacgctgtctgaccaaacgttgacgaccatccagggggtaaaggaagacgtacggctcattgcttttaccgtatctacttcacaaaatcagaagctgaaccgggatgttacggacatgctgaatgaatatgccaagcgtaacaacaagctcaaggtcgagcaatacgatctgaatcaggaaccgatactggccaagcaatatggtgttacttcagcatctattgtgttggtgcagggggagaagaagcgggttatagatattgggagtctatttacgcaagctcaggggagtggtgaaggggcataccaatttaccggggaagaaaagctgactagtggactgctgggattatcatctacccgtcaagggaaagtggtctttctgactggacatgaggaaatcccattgtcccaaatgactgaattaagcagctcactgtcacaagataatgtgaaaacagaggaagttcagcttaatcaggcgggtagcgtgcctaaagatgcgtctgtattggctattgtcggaccagaacgtgatatcagtgcaacggaactgaagagtattcgtacgtatctgaatgatggcggaaagctttttatggcactaggctttcacccgaacatggggtccgattggaaaaaccttgatgcattagcagctgattatggagtgaaggacactcatgccatcgtggtggatcaggaacagacgaatacacttggacctctatggacggtccctaccttcggcagtcatgcgatcaccgataagttggcagcttccaatctgtacccggttctttcactgtctattgctttgcaggcaggagagcagaaggattggaagacgacgcttttgatgaaatcttctgcagccagctatggtgaaacgaatatccaaggactgctgaacaacgaaacgcaaaaggatgacaaagacccgcagggaccgctgaatctcggttatgcggtagaagggaaagacggcaagcccaaagccgttattctcggaacgtcggccctcttaagcgacactgagatcagcacaggaggcaatcgagactttgtgctaaacagtctgaattatgtgcaggaacactctgatgggctcaccattcgtcctcgtcaggagcaggattataaggtagcttacttgactcctgcacaagcgaaaacgatattgaccatatctgtcatcggattgccgttgctgttcgcggtcatcggaatcttattatggtggaggcgaagaagagcatgagaaaatggatacccacagtgctattgttagttgtattgggagcgggtataatctatgcaaagagccaaaacttctttcgtgaacaagcgccggcggctcgccagctggttcagcttacgcaagagaatattacgtctttcgcgatcactggaaaggacggcaagtcggtggaacttgaacaacatgatggccaatggagtatgagcaagccacggacttacccattaaaccaatatacaatagacaattggctagcggcgattcaaaatgtaaagttgggtgaagtggtggaatcttctcctacagacgtagccaaatatgggatcagcgctaccaatgatcagattgagattaagaccaagaagggtgacgttcgtacctttgccttcggtgaaacgttgccttccggagaggctgtttatgtattatcagacaaaaaagagatagcttctgtacctatcgatacactttcagggttgttgctgggtgctaatgattttatagatacaacaccgttcgattgggacgataccaagctgagcggaatagagtgggaaggccaaaatgcttcatggatgctcaaatcctccggtaacagcggaaccggagacagtgcttccacatcttggacgctgaacggaaagtcagtagccagtgacacggcgacttccctctcgcagcaaatcaaaaacctagccagcagtcaggccttgcgcaaagcctctgagctgaacaagcctgttcaccgctttacgctgagcgtatcgctgggtaaggatgattcccagttggtctatcagggctggacgcttaacgatgatccagataccgtatggattgtaccgccacaaagtaactgggcttatggtctgtcagtatctgacgtgaaccgtgctgaacagaatggacacgaccaagctcagactggaaaataatcattagaattaaattagcgcacaaagaggctccaacggcggatgatcgtcgtctggagcttctttgtgttcgttactcgtcaggtttgctgcttttggaagaagaattgttagtgtcgtttaattcttggataacctgaatcagctcataaagtgagagatccagcttgtccagcttttcctccatcgtgtgcaggatgtgccgcaataaaataaaacaaagtccagccggaaagcctacgttggtaaccagagaaagagcatcatccatttgcaatgtattccctcctttttagccatatataaaggaaggtaaattaaaagaaccatatacaactgattgtaaaaatagtataataaataagaacaagtgttctaattttggttgtaaaataggtttggaaattaccctatagtatgaggattagaaaaagtcaaatccaaagagaaagggtgatttacaatggatcagtctcagctaacattggtggaacaatatcgaaagaagctgtaccgcattgcctggagaatccagtatcgtgctcgggtacaaaccaatcatgaatttgtaatggaaaagaacgaagccgtcagcgccccatcttttacagaatcttcaaactctaatatgtacacattacagcttatcaactctctatcttctgagatcggaaaaatgatcatctttgacctttacatactagacaaaaccgaagcacagattgcaaaagagttaaagctatcccaacaggcggtgaataaatggaaaaagaaaatgctcaaagagttatttcggatgctgagttcgtccaattgctaaaattagtacgaagtggagatcaggaggccatgtataggatacttcaattgttcgaggaagacattcaaaagaccagtcggtatattcgtatgtcccgtgaagatgctgtccaaagcattgtgactgattttatagaagaactgcgacaagagttaaagacagtaaaaagtggacaatggatatagccttggctatccttatccgtaggtttacttatttaacggagggcttataagtttatgagtgataacagggcttcttttgagaaaagtatgaagatgtacccagtcaacagtattcgttccaatgtcatcattcttgttttattactgttagatctgtttctggttatccccttagtgggaaatccatacattgcagtttacgtttatgtactgttgccaccgattgttatgataaacatttgggctctagtactggtcatcatgccacgcaaattgcagttgaattacattttattccgtggtgtatttggtttgatttgttctatgggcttcatgatcatgacacaaaagtttgcttatggcatgttgggtctggatacttcatggtattttataggttcctttgccctttatggagtcgccttgtattcctttataaaatataatttggcgaaattcaaagatccttcaaaacataagaagaaaccaaaagttaaggggaaaagcaagagagcgcccgtagtgacgatcaccacatttactggggctggttatctgatagctaatgtttccctcggatttgctacacaacaattagttgccacagtattgatcagtgtatactccatgctggcatttgtccttttccattttattatggatttacaccgctactatgggcttcataagctgaggaatcagaatcaaacaaccgattgaacacaagaatgggatttcaaagtattaccactatcaagaagttttgtaatgaataaaagcctgcaaacgccccatatatgtaggggttcgcaggctttttaggttgtagatttatttagtcaacatacttattgccgtcagcatcaatatagatggattgaacagctgtgcggcggtacggataacctgcctctgtggtgccgctaatttcataggttacagaatagatgccgggcttgtccgctttggatagctctatttgtccggtagggttaacggttttttgctgtaccgtcaaacctttggaggcagaagtgactccttgctgcgggtcaccataatattgaacttggtaggtaacttgtgtaacgctgtccggggcatcctgtggtttcaggtttagcttcgggcccactgcattcagattgtatttcagctctggaacttgaacagcctggtaacgtgcaatcaggagatatgctccttgatcaggaactatgacgttcagtttataggtgcccggttttggattttgaatgacggcattatgatgccaggcaccagcaaaaatatcgtcatcatagcctgctttcagattaataatttcactggtaccgtcaggcttggttagttccagcttactcacacgtttatcgctgatccagtccagatcaatggatttgacaccattttcaacagtgagggtttctgaggcttttccattataatcgccgcctcggataaagtatgaattatcgatctcgttataggtggattgtacagcagaagcagtcagggaagatgctgaaagtgcttcagtttcctgattcaatgctggagtgttcgcttggaggtagggttggatcagggagaagacgtaagaaccggtacgaaccttggcatgatcccaagatccgattttaactacacgtccgccggggagcttagcgttgtcgactgtgaccaccccatcatttttaccaaaggttgagaggtaaagtccgccgagtatgtaggaagcagtgccgtcagaccagttatcaccagcaaacgtgaagaatggaattgtagttgcgttgctgagtgcatcggtcttggatcggaaatacttcatataagatgtttgtaaagtagaggtaccgggattttgtgagccgacgatgtctgccagccatccggcccagctgctataggcgagatctgcaagttgtgagccatgatggggactgctgagggtgatgacacgttgaacataaggagcagctccgttatatacgagagcggtttgagtatccactccacctttgctgtgggcgatgacaatgagcttttttccaaagtgattactgatgaccttgattttgtcggctaaaagcttaccattgtcccacatatcctgggatgtaccatttgtatcgtacagattaatggtggccgtctggtatccggcgtcacgtgcgcgatgaagcatgtcgttattatttttggtccagacttcagcgctactgttcaaaccatgtacgaataataatgcaggtttggcaggatcaacgcgattaggtggtgggccttctgcccagcttccggcgggatctttcgggggttggggtgtagtggagcctgcaaaagcaccgacgggtacaagggtaactgataacaaaaaaatgagcatcaaaacagtgatctttttcaaatcgaaaatcctcctttgtaaaataaagtatttttcaagcttattatacatgccatcttgtggtaaatcatcaattgtatttcatatttacattaaaattttatttttttagtcattttttagtcaggatatccctatgattcatagcgcatgataatctcgtcacacattttataatgtatggaggatgagttcatgccaggaactaagaaggtcatcagttttacgatttctgctgctttactcgccagtatggctgctttgaccgggtgcggaaatgccgatcataacgttcgtacgaacagtacacgctataacgcgcaaagcacacatcatatggatggtgtgaaccgtaatggtatggatggtgtgaatcgttatggggttaagtccaatggtatggacgggatgtcattgaatgaaaatggcaaccgaaccggacatccagtccgtaatctgcaagtcgatcgcagtttgtccaaacgtatatctgagatgccggatgtaaagtctgcgacagtgctggtcggtgaacgacatgcctatgtagccgtttccttgaaagaccaagccaacggaacaggtgtcggtgctccaagtattgacggtactccaagcattgacggtactccaggtgctaatagtattggacgtaacggtaatgtaccgagtgtgaatggcgttaatggcactagaggaaaccgtactacggatactacgacgcctggaatgacagacaatggagttgccggaaatggagttaccgggaatggaacacctgcgcgtcgtgatgacggtttattcggtacgatgggtacaggctcgtacggtatgttgcctggcttgacggacaacaatcgcggagataacggaaacaccacaatcgagggagcaagaactgcatatgaaccaagtgatgcagtcaagagccgtatcgcgaataaagttaagcaatttgcaccttcgattgaacaggtacatgtatccgctaacccggactttgtcaaacaagccactgactttacacacagtgtgcaaaatggtcatccgattagaggcttgagcaatgaaatggtggatgtgattgaacgtgtattcccgacctcggcggctgatacaaaccgtccaatggaaaatacagcacccacacgcccacaaaatcatacgcccgcgccgatgaatcatcgctaattcaaaccctataagtgtgtgcaatgccaaagaaagagctatccatctcagcgaatacgctggtggatagctctttagttttgggggaagataactataactgaattatttgcgcaatcctttaatccatacaccttgcagctttaagtctccatccagtaacaggatatctgcttgtttacctgcttcaagggaacctgtacgatcagcaatgtgcaaggatcgagccggattcaggctggccatttgtgatgccgcgggaatactcatacccacatgttgaaccaaatagcggaagccttcaatcatcgttagtgtgcttcctgccaaagtgaccccatcctccagtcgtgctacaccgccctgcacgatcaccggcaaatcgccgagcgtatatttcccgtcttccagacccgtagcagacatggcatctgtgatgagaatgagattatgatcctgctttaacctagcgagcagggaaatggcggcgggatgcacatgaatgccgtccgcgatgatctctgcttcaatgcgcggatcagcaagtacggctccggcggctcccggcttgcgatgatgcagcggagtcatagcattaaacgcatgcactgcatggttcagccccgccgtcgctgcctgttcaacctcttcatacgtagcatctgtatgaccgagagccgcggtaatgccatggctgcaaagccatgcaatcagttccagcgctccttcccgttcgggcgcaagcgtgagctggcgaacaaggcctggatagcgctgctcccattctgccatccatgacagattcggtggcacgatatgttctgggttttgcgctcccggccagttcggactgatgaacggcccttctaaatgtacgccctccaactgagcataaggcataggtagtgccatataagcgtgaacttcactcaatactcggtcaatctgttccttgggcgcggtcatggtggtagccagcatggccgtcgttccttgtgaaccgtgaaaggaggtgatcgtatccagcacctttggactggagtccataaagtcctcaccgttaccgccgtgaacatgaatatcaataaagcctggtagcagatagcctccttccagacgcacaatttttaccgctctcgctgcactttcttcctgattttccaagactaccgatgtccaatcggcgggcaaatttccctcggaaccagcataaacaatggactgcccctcaatgacgacaacccctttttcaatgatgtcatttccaacgacaacttgcccatacagtagctggggtacgttaccactcatttcatgtgacttcaattgaaccatcctcccgctttctgatccagtaaaataagtacgttggggtgacattgcagcaaagaagccggacactcagtcgtgacaggtccagttaaagcctgctttataatgtcggccttatccgcaccaaaagccaccagtataatttgcttcgccttaagaatcgtgcctactcccatcgtaactgcttgcctgggtacagcatctatttcgccaaaaaatcgagcatttgccgagcgcgtactttctttcaaatctacaacatgtgtggctccagccaagctgggaccgggttcgttaaagccgatatgcccattatgaccaatgccaagcaactgcagatccacggggccatgatcctgaatagcctgctcgtgcgctgcacattctgctgccagatctactgcattcccgtcaggaacacgtgtatgggacatgggaatgtcgatatgctggaacaagtgctcattcataaagcttcgatagctctgcggatgttctgggggaagaccaacatattcatcaagattcacggaataggcgcgtgcaaaactgacctgttccttgcggtacatatctgcaagatgttggtaaatgccaatcggcgtactaccggtggccaggccaagcatagcctgtggtttggatagcagcaagctagcgatcacagcggcggcagtagcgttcaggtcttcacggctgttcaaaatgcgtatgttcatcttagtgaccccctggttgttttttgagcttgctcacttgttgatatgaaccttccaatcttggaatatatttgtcaaaatccgcgctcaccatacctgtaaacagaatatctataatatgaagctgggcgatgcgagaggccatatccccacgtcgcattccttcctccaatgaagaggaaaatagcgcaatatccgcaaggcctgccagcgtattgtttccgaaggaggttagggatagtgtcttggccccctgttcctttgcacagcgtagagccgcaatggtctcctgggtttcccctgaataagagacggcaaaggcgacatcttccgctcctagcgaggaggcagaggtgatctgcatatgggaatctgcaaaggcagtgctgttcttgccaatacggatgagcttctggtaaaaatcctgggccacaatcgacgatgtcgccatgccataaagatcaatgcggctcgtggctgacagccatgcaatggcctgctccagcttgtcgaaatccagcagtcgggtcgtgtctgcaatggatgcggtatggttcgcctgaatagcctgcacgattcgggaaagtgaatttccggcgacaatatcctgataggattcttcaccattacggttggaatgagacaactcggcggccagcttcattttgaaatcgggatagcctttaaaatgtagtgatttgcaaaaccgcgtaacggtcgccgcacttacaccacaacgctctgacagcttccgaatacccagatgcaacacatcttctggggattgcaggatggattccgccagcttgcgctcctgtacgggaagctggtccagtctatgggttaatgtatgaagaatgggggacatgagctgtgctcctttggctgtagagtgtttgtgtgaaaataagtatcgtatataaggaggatataaagaaaaacattttcacgtgtattgtaaaataattctgctgctcatgcaagagatgtgagaagaatttttattagattttgcgaaaaaatagccagcgaaaattgtagaagttatcatacattaatttacatattacgagttttacttacaaaacaacctattgacttgtctcttcattggaggagtataattgaataaagttccagtgaaggaatttttctaggagctttctttgcagagggcatcgttgggtggaacgaacagaatctcattcacaaggaggagtttgctatgcaaagccaagtgattgaaatgatcagcgcggttaaggaagatcctgaactggtcgctaagctggatggacattcggacattattcatgatgcgggactggattcgttgcagttggttcatttcatgctgcaagtggaggatgcgtttgatgtggagattgattttgattcctttgagctagagcatttgagctcggtagatgcgttttgcagctacattcaggggatcagcgatgcggaacaagcgccgtatctggaaggaatggagacggtctgacgtacagctaggtacatgtgcctgaaaatccattaaacgaggtgttagcatgcagcccaaaagcaatgtgctgattgatgagaaagcgttcaagctcatcaagcgtaacctgaaaaacgcttctgtatcttaccgtaacgccacacaggaccctactttcaaaacggacatgccccagacgatcggcattaagctgactaaccgctgcaacctgagatgtacacactgctttgaatggaacgaggaaggctaccatcaccaaatggataaagaagaacaaaacatggatcttgctccggacatgctccggcaaattttgagcgaaaccaaggaagccaagtccagactgtacatgtggggcggcgaaccgatgtttcatcgacgttttgatgaaattttggacgtgctggcggaagatcggcgcgaaatgaccttttgtacaaatgggttacttattgataaatatttggaccggattttggatttgtccgaaaatctggagttattaatagcgattgaaggttttgaaagagaacacgatttaatccgcggtaaaggcacttttcaaaaaacaatgcggcagatggataagctgattgaactgcgcgaccagggattgtacaagggacgggtaactgtccatgcggtcattaacgataacatgatcggacggatgtacgaatttctgcaaatgctggaggacaaaaggctggatctggtgctgctgacgttcccctggtacatttccaaagaaacctccctcaaaatggatgaatattttacacgtaatttctcctggctccgacaacttgaagaaaaaaatattagtagctggcatgctttcaaatataaaatcaacccggataacatcgatcctctgatgcaggaactacagcggatcaatgagcgagtatggaacattcgcgtgcgctatcagcctggtttggattatgaggaaattgataaatttatccatggcgaggaaatggtcagccgttgttccaatcattgtttggcgctcacctccagaacagatattttaccagacgggaaggtcatgccttgcaaatttttcagtgaattcacgattggaagcatgcgtgagcatagtctgaaggaaatatggaactcggatgcgtatgagaaaactcgtcaaaagattaatcatgaaggattgactccggtgtgctccaaatgcagcgtattgtatctgcatggggcaggctctctgaagtacatttagttttctatggatgttgtttgttactggatggaagagagagggatgatgacaagacgtgacgactaaaactattaaccttgtggaagcgcttgcgcatgaacgagaccatggagtcctgatttggctgtttaatatcggcgcagagcaagtgtggcatccatcccctcgcaaggggggcatggtagaccgggatgaacagcaagtcgtaaaccggatggaggaaatgaatctcctgctatgtcgaagtcaggatgtcattgtacttcgggaacagccggatgaggcgtttctggacatgcttcaacggttgggctttagcctgccgcgtattgaggtgccggatccttctgatccgctaacgccgatttcagagctggtgctggcggatgaggcgcttttggcacgactgcgtacggttgcagatgcaggccacagcagcagcggagccaaagcgtggctcgtcccctatgcggtcacaccgcaggaggaagcgatcgcggagctttgcgggctggagctgatcggcgctccatccgcggtcagtgctcaggtgaatgataaaatattcagccgcctgaccgcgcaaaagcttggttttgctgtcagcgaaggcgctgtatgtgcagacgaatcggcgatccgcagggagtgtgccagactggctgacttatcggatggacctgtgaagctgattatcaagcagccgcacggtgcctcgggacaaggcatgtatatgctggacgagctgtccaagctggacacgctgctgagtgtgatgaggcgctttggcggctcgtcgccatcttccggcggctggctggtggagcgctggcacaataagcagatggatctgaactaccagctctgcattgacgagggcggtggtgtgacgatgttttcgctaaaaagacaaaacgtggatggcaccgtatatatcggatctcaagtgccggctgagattggtgatgcgctggaggaagaagtgagacgttgcgcctatcagctgggtacgtatctctattccattgggtacacaggaatggcctctattgacggttttgttgacgaagaaggtttgctggttccagttattgagattaacggtaggtttacgttatctacctatatttcattcctgtcatccgttctgggagaacagcataaaacattatcccgttattaccgcaacgttaccgctacacctctcacttacagccgcttgtgcgggttgctcgcggaggagggcttgctctatacgcccgaacgtccagaaggggtgtttgtgtatacggcgggtacattgtctggtatccctgtgaagcggggctatgtgaaccggattttcacacttattttggcagacagctggcaggaagctgatgcgtatgcgcacaaattggaaggtatcattgctggattaggatgctcataaatgggagggaatcaaaaatgaaaacagatgtataccatgtagtacccttgctggaaaagattttgaagctggctccgggagaactggaacagttgactccggatcaggatctgcgaaccttggggctgaattccttatcggctgtggaattaattgtagagttggaaaatgagcttgatattacgatggaggacgacgatctagtgctggagcatctatctacactgcaaggcattgagcgtctgctgggcaaatatgcataagggcgccgaaaagacaaggttgatgcagggatccgatatggagactcgtcatgattccgttgtggactatggtgcagaagaagtggcaaacgctcttccagggaaacattgtgtatattcttccctgcgtacctcattgcggaggtacggggtgaacatggccgaatccgagctattcatgctgtgtgggagtatgtgcgcagagtatggtggagatttgaagcgcttcggacctgagaaatatccagagcagcttcaagaaatggcagccagtggcggacctgttattcgggtggaaccgtgggtcgcaggtgtcagcgatgaaaccgacctgttgcgggtactcacatcgggctacggtaccatgctgcatacgtcgagcactgctttaacctatcacgatgtatatgtgaaaaattacccaaggggccacgtgattgagttgtgcgggttggacttgcaagaacggacagcacaggtgaatgatagctttctgctcgattcctcgggacatgccatgacttatgtgggctcagcccggctcgacgatctgatgcagggtattattgagtatgcatggctggtggagcagcctgccccgctttcgccaagtgagatgcatgctgcgtgtgctcatcatattcgacagtatttgactggacacgaagccatctggagaggcgtacctacgtctaatgagtcggaaagtcaaacggggaaagctgtaacaggcaagcaggtcaagcggggagatgaggggtaccgggcatttgtcggtgacttccgtctgttggcagacatggaggatcaggattttcggacgtactgtcatgaaatctattacaatctgcgattgggcagtgcccttcatttgacggattatacagctgattattgcctgctgcatcaagctacgctggggccacaaacacagcatgtaattgaattggcacaggggctgtacgcggattggcacaagcttaatctgcatatttacaaaacagggcttcaactgcgcaagcatcggatgcctgagattatggaacgagctttgcatttaattgaaagacagcggcatatgctggaggaactgatgattttagcagagcaagcagccgagtagtccagagcactcggccttatcaggcacgttcatccaggggttacgcgcagaggaaagaggaggggaattgattgccgtccattacattaaaccaattgtcgaaaacatttacgtactacaaaaaggagccgggcgtgcgcaaatcgttacaaaacttgttcaagcgtgagcagctgaccaaagaggctgtacaaaatgtcagctttagcattgaggaaggcgaaattgtcggatttctcggtccaaatggagcgggcaaaacaacgacgctcaaaatgctgtctggcattctccatcccacggacggggaggcatcagtactcggctttaccccgtggaaacgacaaaaagagtttaaacgtcagttttccattgtaatgggacagaaaaaccagctctggtgggatttgcctgcaagcgagtcattcgagctgaacaagcttatctatgaaattgatgaaaaccgttacaaagaggcgctggatgaactggtcaccctgcttggggtggaggaacagcttcatgtgcaggttcggcggctgtctctcggcgagcgtatgaaaatggaactaatcgccgcgctgctgcatcgtccacgggtcattttgctggatgagccgactatcggactggaccttgtttctcagcggcggattcgagagtttttcaaagcctataaccgcacgcaccggacgaccatcctgctgacaagccactatatgaaggatattgaggatttgtgcggtagatccatcattatcagcgggggcagattggtctatgacggagacttacacaaggtgaatgaggtcatcggtgctcgtaaattacttaaggttcgactggagtctcctgtatccaacctaacgttggcgagcctcggcaaacttcgctccaactcggagctggaggcggtatttgagctggatgcagaagataccttggcttggtccaaaaagattttggacgcactgcctgtcgttgattttacgattgaggacgtcccgctggaagaggggatagccaatttgtacgatgggggcaggctggccgatgcgaaataacaaatatgtgaaggtactccagcttggcatgcaaaacgaaatggagtatcgggctaattattggctccaaatggcgggatttatgctgccgatcatgacgcaaatttttctctggctagctgtattcggttcttcgggacaagcaagagtgttgggctattctctgccagaaatgctggtgtatgtggtcatggcgggagtaactggaaaactgattgctacgggctttgaatacgaaattgctacagatatcaaggaaggtggactggcaaaattcatggtacagcctgtgcattatttcgcttaccgtttttgccggtttatcggaggcaaagtcatacagtccgcggtcgtgctgctggcggctgctattttgctgttatgtcttagcttggaaggacaaatcagcttcgggctatcgtacatcttgctttacatattggcgttgccgggagcgcttgtgcttaattttgtggtctattatgcgctgagcggcatagccttttgggtgacggaatcggcggggctattttatacactgtcgcttgtcatttacgtagctagcggtaccgtgtttccgctgacgatttttggagatgttttggcccgtctgttcagtctgctgccgttcagctacaccgtattttttccggtgaatgcgttaacgggcaagctgactttgctggaagccgctaaaggcattggcgtgcaatggctctggattgtagtactggcggccgtatcacgctgggtgtggcaagccggggtcaaacgctttgtctcggtgggaggttaacatgaaaaatgttttccgaaacgttagacgctacatcagactgtactggaagtttgtccagttttccgtcatgtcgcagatggaataccgcattaattttataacggcatttctggttgaaacggcttatttgcttatcaagctgctgtacgcatcggttccataccgcgccgggacggacattaacggctggtctcctgacgccatgttgttatatatcggcgtgtttacgatgatgagcggattttatagtggattgttctacagtaattttacaagcctgcctgacaaaattcgtaccggctcactggatgtgctcatgaccaaacccgtatcgctgcaatttatggtgacactgcgtcaatttgagctgggctataccgtgccgaatgtaattggcggcggaattatgacaggcatcggctggtatcggctcggattgccatttaattttgaaaccgcaggagggttctctgtgctgctcggatgcggagtgcttacggcatactccgtatttttgctcccccaactgctagccttctggattatccgcacgaacggcgttacggagctgtccaacagcattttcgagacaaactatgtgccgatggccgtgtacagtaatctgattcagcgtatcggtttgttcgtgcttccagtgtttgtcatttgtaattttccgcccatgttcattctcggcaaaatggataccgggttggtggtatgggcatttctcgcacctctctggctgctggcgatcatccgcctgatatggcagtttgctctacgtgattatacgagcgcgagccagtagcgctaccgtgtagtgggccaataatgaagcaggaaaggaagcgaatcatatgaatgcgataccgaatcagcgtcatttgtatatgggaacgttcgaagcggaggcttactggcgggatgcccagttagcttccctgccagccctgccagaccgggcttcttctgcgattgtagcagccatggatgaactgttgttcagcttttgccagccgggagatgcgttattgacccgttatgctatttcgcctgtacatcgtcagtatatcgcgcagttggggtttcatccggctgtcaacgaacgggatttgaccgacggcatggagcgtgcaggcaacgtatcggccgcttcagtattcgaactgctgggcagtcgcaaggccgatgctggagaggggtttcctcaactggaaggctgtgtgcttagcccgtttgcgggtttaccgcatgtggaggaggctgcacgtgcttggggtataacactgcatcagccaccgctggaaacgattcgcaaggtaaatgccaaaacgtattcctctgatctgaaacgcagtctcggtttgcgcaacccgggctatatcgtgacttcgtttgcagatgtcgctgaggcggggcgtaagctactgcgggatggaagctttttaatcaaggatgattttggcgtatcgggcaaaggaaacctgcacattacctcgacacaaatgctggaccggatcgtatcgtatttgcgtggacaggagcgcaaaggcaaacgggtgcttttccttttggagccttttcaggagaaagagcaggatttttcatgccaatttacgattggtgatgatggaagtgtcgatatcctatctgtacaatggctggctaatactcaattctcttatcgggaatccttgtcgccggacggggcttttttagagcggctggagcgcgagggctattttagcttaatgcaggatgtgggacggcaattgtatcaggatggttattacggcgatgtatgcattgattccatgacacttcgtggtgggaagctggagcctattatcgaaattaatgccagaaagtcgatgagtttgatcaagcatcagctcgatacctttctggccgggaaaaatatgcgtggcacgctgacgaattattcactgtcccatgatggcagtctatcctatgaagaactgctggaagggctgaaaggtgaaggattgttgttcacaggtgaacgtgaagaaggtgtcatgcctctgggtgccaatacgttatatgtgaacacaggtggacgagatggcgagaacaagattgtgggccatacaagcacgccaagcagaaatgcaaccgggcgcggaggcagatcgcctgccaagcaggttcgtgtgagcgggattggggccagcgatggcggatcagaagggaacggcatagctaagccggacttgaatggtaaaaaagaaactgctggaagcgaacgggcacgaggcaaggggcgtctttatttggaactggttgctgcgagcgatgaggaaaaaatgcgattgactacaaagctggagcgttttttggcagagcatcattttacagtgctgaattaaacgggaggcgtatgagcatgcgtaagagtacggataagcttatgaaggtaacgattttgtgttccggtttcggattgggcttttatacccctggcttgttgttgcaagcgggtcttcgcaggctgggcgtggatacggcgattcatgtatttgaaaatgtgctgccagaatcggctcgtctcaaggtcgacaaaagccgcaaagcttaccatgacaattttgcggtggccttaatgtcacaaaaggttccgcaggatatgcgtaattcactggatctcgctgcgatggaagtgctgctgaaccaatggatggaggaggatcggcggtattttatatgcttatccggtcattggatgtatgtactggaggagtatcgtaagcgcagagaaccggagtcggtgcatgtggacatcgtgtacatggattcgacaccttctccttcctggaaaaatctagccaagcataacccgcgttttgcggagggctgtggagaaatgaccttttttgaaaatgataacaatagagtcagccactatattgatgtgccagctgtggagtatgtaccgtttgaagcacggcaatcccgcttattcgtacatggcggcggttgggggatgggcacatatcgtgacaaggttggacggttggaagaagcgggctgggagctggatctgctgttgtatgatcaggatcaaccggatgaacagcgggaaagtatacgctattttcagatggacccgcagtggaggacatggcagcgtaatgaagccggagagcatacatttccacctttcggagaggtaaaaagaggcgagaagacagtgtatcaggttggaccggattaccatagcatgctggaccaagcatgtcgtgtccaggccattgtcagcaagccaggtggtggcagcctaaccgactcgttcgctacggccactccactcattatgctggagccatttggtgtgcatgaaaagcataatgcagatctatgggaacggctgggacttggtatgcgatacgatacgtggatacaaacctatgacggcagtgctcagatcctggaggatatgcatcgcaggatcgtagagctgcgtagtcggacgccgcgttatatagagtcctatgtgaatagtatccaattgccagtaagctccccaggaatggagcaggggttatgaacgctgcggtggctgcgcaagagcctgcgatgcgagatattcgctttgggatcattggctgttctgccattgctccccgtgcgttgctggaaccgatccgacatgttgcaggggcacgcgtgaccgcgcttgcgaaccgcacggttgccaaggcaggagaaatggcagatcgttttggcgtcagtgtcgtttatcagcatgctgaggatatgttaaaggacccggagatcgatgctgtatatattgcgctcagcaacgatttacatgccgagtggattgacaaagcactacgggctcataagcatgtgctggtggaaaaaccgttatgcctgaatacggctgatctggctcccttggcagcgacagtcgaacagagtagcgcttacctgctggagggagtcatggtgcagcaccatccttggcagcatgaactgcggaggatggtagaatcggggcgttatggtcgcttacgctccatagagacgagtctatgcattccggcaaaagaaggacatgcggacaattacagatctcgtctggagcagggtgggggatgcttttgggatctgggcgtgtactggctccagctgcttcaagccgtcgttggattagagcaggcggaattccacagtcaatcggatttcgatggtcctcatggctgtgactggacatttcgtgcgcaagcccggtatccgagcggattaaaggcatctgccctcttttcatttgagctcccttatcgctgtgctcatgtactgacctttgattcggcagtagtcaccttgaaggactgctttcgggcaaatttaggtttttataaaataacactcaggacggaaataaagaaggatatcatgccgaatataacagatgtggacgcactgcctgggttatcacggacatcttcgcataccaaaacggttttcgagcctatgaactattatgtcaatcagttgaataccttttgtagcatcatccggggagaagcggagcccattccatttcgcgaggctgctgaacgcgtcagactgctggcagccattcatgaagcagcacgctcgggcgagacgacttatgcagtatgagtatgattgtgtattcgagcggagggaagcgaatgatgcaaaatactgagtatcaaggcatagagaggaggagaactcaggtgatggataaaaaggacgaagccttactggagcgtttcggcgagcatccgacgccattttactattatgacggagacgcgctacatgcccacgtcagctcgttgctatcccgattgcacccggccgtgcgtgtacattatgcactcaaggctaatggtaacgtagccttggctggattgctgcgttcgttaggttgtggtgttgagattgcttctgctggagaaatgttcgtcgctatggaggccgggtatgttgcggaagacgtgctgtacgccggaccgggaaaaacagtagctgagctgaacgaggcgatagcctatggaatcggctgtattcatgtcgaatcggtgagggagctgcgtctgttggaggacattgctgcccaagcgggccagcttgtcagagcagcggttcgtatcaatcccgataacgatctgtctggagcaacgattaaaatgggtggtgttccgcgcccctttggagtggatgaagggcagctggatcacttttttaaggtgctggaagattgcccacacgtccattttcaaggtattcaggtatatacaggtacgcaaatgttgaaatcggatcagattttagcttcatttgcgaatacgctgcagctggcagaacgggtacaggctcagtatggtgtggcaatgcatacggtcaatttgggcggcgggtttggtgtaccttattttgctcatgaacaaccgcttgatatggatcacgtcattgccggactgaacgcactcgcggagcagacccgaacccgcatgcccggggttaagctaatcatcgaaagcggcaggtatctggttgctcaatcgggcatgtatgtctgccgagcattgtatacaaaggaatccaagggagagaagtttgtcgtggctgatggtggcatgaatcactacgccgcagctacttttcgaggacgccgcattagggacaactacccggtgcgaattatgcgcaggcaagcgggagaatcgaaagaacccaaagaacgagaagtggaagcaaccctacggatggggcagagagacgcttctgctcaaatggctgttactgtcgaacaatcattagaagaggttgcaagccgaataggggggcctccggaggaagcatccttggagcttgaaacggtaagtattgttggtccgctttgtacacccgaggattgtattgtgaaaaaagcgcagcttcctccgattcacgagggcgattatattgcctttccgaatgcaggtgcctatggattaagctatagtccactacaatttctgggacatgctaccccggcggagctgctcgattttcgtggggaggtgcatgtcattcgtgaacacggtgaccgcacagacctgctgcatcatcagcgcatgattccgttgcctgaggatgcgttgtaagtatgtaaaaaaacgccaaactcatgggaaccgatacaactcggacctgtgatttggcgttttttacatgatgagtagggtagtatcgactcaatgttgcttggagctgcgcatttcttgacgcacaagctgccataccataaagatcagtacagcgatttgtgggacaaaggtttcccaagttggatacattcccagccagctaatggacggaagcgaggaggcagtgtgccccggaagcttgccagccacctgaagcgaatgaatactttcgcccagaaatcggaatacgagatagtaaatcagtacagtcgcagtcaggaaaaaggcacgaatcggcaatcgtacactgaacttaatgatcgcaaacgccagaatgactagaacaaccgtcgccgagctaatgccgagcagcaattgcgaggtttcgatggctggagccataccgacataaaagatagctgtctcggctccttcacgcagaattgcgagcgcagaaaccgcaaatagtgaccacagacttccccgtgccagcgcgttgcccacgctgttttccacaaagcggttccacgcggcagcattggatttgctatgcagccagctaccaacggtcagcatcagcacgaccgccaccagtccggtgacaccctccagcaactcacgcatgctgcctgatgcggcagctgccaccagtgtggtgaacagtactgccagaattccgctcagcaccagccccgttccggctcctgcccatatccaccgtccagccacggcttcgccgctttttttggcatacgccagcagagctgcgagcacgagaatggcctccaggccctcacgcagcaaaatcagcgcagcatcccacgcagtgtaagaacgttcttccgtcaacggacggagtctgtccagcatctgatcaagagtctgaatggctttgtccgtattcggtggagaagacagcagatatcctgaagtctcggtcatttcattttcaattgcagtgtaagacgtcggatcggcaatttgtacatgtccttcgacagaaggccacagagcgataaactgtactaccttgtcagccgcttgctctgattgattagctacagcatcttggcgtgcggattcgagcaaggtgactgcatcgcctagggaagcagccgaaccattcgccgttccggcagccgtattgcctgcattcgttccttgacctgtgttcatagatttaccctgactataatcagacagcagagtcgttaattcctgcatttccttgagagcctgttcttggcgaataggctcagcttgcatggagatgcggatgagactgattttagtttcgagcgaactgtataccgggaaattgtccaaacgaatcggtgtttctacctgataccagtctttgacgattcgatcgtaatccacccgggcagcagcccaatcgcctttttgcatggcggccagactgcccttcgccatgggaagcagtttttccgctgctttggctccagccggggctggtttgtccccctcggcagcagtgacgtactcattgaccgagcgcgccagcacggataaggcagctttcgctggttccccgccaccactggcgagtgtttgttccgcatcggtgagtgcttgatctacagccgcgatgtgagctgaatctccgccatttgctttggcggtctcccacagcgtgcggaattctttcagatccttggaggcttccgtccattgggattgtcccgcctccaccagtgctccgcccactacaggcattagctgatcatgggtgacagctttcgcatctgtttgtgcaaaagcgaccgacccggagccggaaatgaacggagttacggtcagcagcagagctgccaccagcacaaacacccatcccaagcttttattgcgccgattcatattaatccccttcctagcctgctgctaaaataacgtatccccgatgtaaccgccttgcgatacacctgggaagcaggcgaacaccgcactgcctttgtgtacaatgtattcgttcagcttgtcattgcgtgcaagcttctcctgaatatgaacgaactgcttgaacagatcacgctggtagctgatgaacagcagcccagcatccagctgtcctgtttgcttgtccaatccgcttgaatacgaataagacctccgcaaaatattaatgcttccgtccccatgagccaaagccacatgagaggtgggaggtgtaaccggcttgccttccggatttttggccgccagatcaagcttgtcgaactccttgaccttaccgagtggggcaccgctgctgcgatgacgtccaaaagtatcctcctggtcgcccaatgttgaacgatcccacacctctacccgcatgcgtacacggcgaacagccatatagctgccgttgcccatccaagctggtccgtcactggtctgtgtccacaccagccgattcatctcgtctgccttggaggtgtcggggttccctgtaccgtccttgaagcccagcaaattgcgcggtgtgcttcccgcaggatcggcctgtgctgtccgctggaagccttcctgcgtccagcgaagcaccgccgttcctctggcgatacgtgccaaattgcgcagggcatggaaagcaacctgcaagtcattggcacatacctgcactccgatgtcgccaccgtaccattgctcctccagggcatccccttgaaaacggggcagctcacggaacccggcaggtttaagccctgccaggccgtatcgtccatcaaaaaaggatgggcccacaccaaaggtgatcgtcgtgcgggatggcgacaatcctgccgcctcgcccgtatcggaaggagggaggttgaggttttcattatcgttgccaagcagcacgccagaagtcattgtagcgcttgcttctgtccaggctttgaagaggctacgtacctgttccttgttgctggttgttagatcgaaagcggcgaagcagatgaaatcctgcgccggagtcacaataccagcctgatgcttaccgtaaaaagggattacatctttggtatccgcatccgtcatcatgctttcgaggcgttgaccggctgacagcacggctcccacgcccccgccgccaagcaggagccctagtccacctaccccggccagcttcaataggtctcggcgtgatacggatttgctttttcctgacggctcatcttccactagcttcgcatccttttttaccagatcgtcctgttcattatgggattccgcatactgcggcttttcttgccctttttgccgcttaaagcctctcatatcattacactcctaacaatttccccatttgggacaacggttctgccaaggcatcgaggttttgactcagctttttaacttcttccggtttcagttttgtatacgatacatagccttctccgtccttaaaaggagccaattcctgctgtaaggccgtaaagcgctcaccaatttgtttttccaacgccgcatctttttggttcagatctgttttcaaaatgtcatatatcttttgtgcgccctccacattggctgcaaagtcgtacaaatccgtatgagaatatcgctcctcttcacccgtcaccttcgaggtagatacttcattcaacaactcgactgcacctgtcaccatcaggctggcgtcaatattaactgtttctactttggcacgcagcagcttggcatcactcagcagtcggtcggaaaactcgtccattcctttggttgtgttttcttcccataatgttttttcaatccggtgaaagccgcgccaatccgctgcatccacatcaccgtcacgtgcatcaatattcgggtcaagatcacccagcgcttctgcaatcggttcaatccgttcatagtacatacgtgcaggggcgtacagtgccttggctttatccagctcgccagctttgactgcgttcgtgaattcttctgtcttcttcacaaacgtatcgcattgctcgatggcataggtgcggtaagctgttaccgcttgatcaaaattgggggcagaagcggcaggagtcgttgtctgtgttgttgctcctgcatctttggtcgttgcggcaggctgctgagtagcagttccggtttgtccgcaacctgcgaacagaatagaagagatcagcactccggccggtacggcataacgtagtttcataatcaatgaacaccctttctggccaaactggccttgaaccatagtctgttgcgcgatatctatatcgaatttttattttgataatgattatcagtcgcggtttttcttatcataaggctggcccatatgcctgtcaatacataaattagacgcagagtccaaccctccatcgaagggagttagtaaggtgcctatgcccatttttatccgcatattgaaccatacctgagcacatgacataaaatgtgttgactgtatcccttaaccttgttacaccacacaaaacccgagcaaggaggggtgaaattgacgaagggtaacgaccacaaaaacaagtttttgttaactcaccgtgaacgtgaagtatttgaactgctcgtgcaggacaaaacaacacgtgacatcgccggacagctattcattagcgaaaaaacggtccgaaaccatatttccaatgtaatgcagaaactgaacgtaaaaggtcgttcacaggcggtcgtggaattaatcaggcttggagaattaaaaatctgacctcttgttccttgcggggtacaaagtcttctcgatgatccttcgacagtgaagggtggtcgggaaggcttttgttttgtggtatgtaaaaaagtaaaacgattaagccactgaaatatgtgggaatttgcgtgtaaatgatgtactatgtatataaggaagaaactaccattagagatcatagtgcaactaacaggagtgatcaaaacacaagactgtaccacaaagttatactaagatagaaatgcatctggtgatagtctaagaatataaatccctacaaaagcagtattcagcatgacgacaggatggaagatggatcaggttttgagctatacttttatatataggtgttgaagaagaatcacaaggcagaaaaagctcattgcttcaggtagtaggaagtagctttgcctagagctacctgtggtatattcttgatcggaggtgaatgttaagacatatgacacccaaccaacacttgatgacttatacgctgaacagcggtataaagggaacggtcgacctaaccagtaagcaggtgcaggaatggatcaaagcatatcgaattggcagcaagtttgtaacggttgtggggaaacagtattttggtttaaaccctgagttggtagcagatttcaaggtacataatgaatactcggagcagagagaacacatatccataatacagcctgtaatagaacgcaaagctgtagaactggacccactggtagaggcgtacagccagtataaaacattaattcaggtagaatgtaaatgtggtgcttcctatatagaagagtcaccgcacaaaagaaccaagtggtcatgcaaggagtgtaataacattgtgttcctggatcgtaaaaagggcatggtggatacagataaaggcaaggcatggtacatgaccaacaaatactatgtggaaagacaaagcaactgactgattgtcagttgctttctaactatacactcacacctctggtgtgcctaccaaaatgatattaggtcttttgccaaataataaaattgatgttttttacgctttgtagtacattatcaagtgtattataaggaggcttctcatgtacggacatagacaagatgatactttatacatcatgacttacacattaaatagtggtatcaagggcacagtgcctttgtctaatcaacagatacaggaatggcttgagtgttacagaatcggcaagaaattcgtaaccgagattggcaaagagtactttggactgcatgcggaactggtggctgattttaaggtgcataatcagtattcaagctatcaggaggttattatcccgattcaacagccggatactggcctaaaagagttgtcccaggcttacaaatcaactgaaaccttaattaaagtagattgcaaatgtggtacatcgtatgtaacagaatctccctttaagcggaccaagtggtactgcaccaaatgccgggagattgtttttctcgacaacaaaaagggaatggtggatacttccagaggcaaggcccattatatgaccaataagtattttgtagaaagagaaacaactggcgtataagccggttgttttttttcgaaaggtttgtatacgtcctgacttttcaaagccgattgcgctatagtgaaaaagggggcttatggaaatgtggagtattttgctgaatcacgttttgttgataggatttgtggctgttttgattcaacggatctacaagcatcgctttcatcagcaaaatggtagcagttttctgctatgcttgtgggggatcttgcttaatcggtacaatagcttgtttgaactgaccacgttatatacggtgtataccgttttttttgctgtaggagcattgtggtttggaggttgctggcttgtgcagctattggaaaaggggaaagataaagcttgatataacgatagtcaggtggtgaacgtcatccgggaagatcatacgaatggtgcaagaaaccgcatgagcacgaacaatgtgtacatacacgaaacgctccatatggaacaaatcataagtgacctgcgggtgatgggctatgtggcttttcatcatcatccgcaaatcacaggtgagcttgaagagctggaggtgttaaaagagcaactattgtcgttttttcaacagcatcatgtattgtggattgagcttgaccagctaacgcaatatgtggtggtgaataacacggggaaggccacggtgctcaaactcatgggtcggaaaatgaacccgctccgggatctgagagcaaacgctgctttggctggacagccgctgcatgagttggatcgggagatagaacggctcaatcggctggctcacctgttgcgctacacccgtttttcttaagcgacggaactaacgtaaaaaagcattcacgaagtatggatggttccatgctgtgaatgctttttagtatctattttttaccgcataagatgagcaaatctactgtgacatacgataaatttatttcctccactcgctgccagtctgcttccgtagctccccacgataagggagtcatatggagcaaaggtttcaagaggtcggcatttaacataaaacgataggttacccgttcggcggatagaagtttaaaatgatctttaaatcggcttaatatattgtcattcgaataagcaggcttattctttttctgttcatacaagcatctcaattcccgaagataatatcgttcgggaataactttcaggacgcagccgtcctccgaaagaattcttgtaaattcagcataattagaaggggataaaatattgagtacaccgtcaaattgttgatttgaaaatggacaatgagccagatcggcaacacaccagagaggatgaggatattctttggctgcggccataataccttctttagacaaatccatacctacgcttgttagctcggtgattcccttccaagtcagcttatcctgaatgtggctcaaatgagtgccttccccgcaacctgcatcgagcaagtaaaggtgtgatttttgatcaaacagcggcttcataaatttcattatagtgctgcttatcgcttcatttaagggatcgaaaaatccgctattgcacatcattcttctggaggaaaatagttgtttatcatatttggtcttataggaccgggcggctaaatgtaaatacccgtattttgaaagatcatagcaatgctgactcgtacataggaggcttttaccttccaccatacgcatcggttgagagcatagaggacacctaaagagatgttcatgcttaccaatcaggccagccttcatctcgtgtttattccatttggacacagaaaagcaccccgttcattcgtatttggtgaatgaaaaaaggcacagccaaatagacccaacccattttcgaaaaaaatggttgagttttcatgaactgtacctcacattaccgtaaacgaataaactgaataatcatattatgtagcgctcctccaaaaaaaaatagaaagggctttcgccctctctattgtaacttagccataagaagttgtcatgtgcttacaccgatttcaaaaactctacaatcgtcagcagacccttatcaaaattatccaagttaaaatgctcattaggcgcatgcaggttctcatctggcaagccgaagcccatcagcacgactggggcagtcagcacacgggagaaggtttccacgattgggatggagcctccatccttggtaaagagggcacgcacaccgtataccttctcaaaagcatcggctgccgattgcagaaacgcgtgtgacgggtcgatgttaaaggcgtttgctttttcaccctgttgaatatccagagtagctcctgcctgaacatgagcgcgtaaatggcgctcgattttgtccagaatgtcttgcggattctggttagccaccaagcggcacgtgattttagcatgagcttctttcggaatgaccgttttcgtgccttccccttggaagccgccgtacacgccgttcagctctagtgtcggacgcgccccaacacgctcaacgaagctgaatccttcttcgccatagagggaatcaagtgcaagatcttgttgcagcttgctctcattgaagccttgcttcacgaattcttctctcatctctgccgataatggagcgacatcgtcgtagaatccttcgacgctaacgcggcctttgtcgtcatgcagggttgccagcaaggacaccagagcatgcagggcattcggcacgccgccaccgaaagagccggaatgtagatctgtgttcgccgtgtgaatggcgacttccagtgaacatagtccacgcaaacctgtgcaaatggcaggcttccctttttcgatcaaggaagtgtcggacaccagtacagcatcggcagccagacgttcagctccagtttgtaaaaactcaagcaagttcggactggacacttcttcctcgccttcaatgcagaatttgatgttcagcggcaatttgccttcctgcttcaaaatggcctcaactgccttaatgtgcaagaaaacctgtcctttatcatctgtcgctccgcgcgcatacaattttccatcacggatggatggctcaaacggcggcgtttcccacaggtgaagcgggtctacgggttgtacatcatagtgtccatacacgaggatcgttggtttaccaggtgcgtgcaaatgatcggcatataccagcgggtgccctttggttggaatgatttcaacgttttccagaccggcagcagtcagtttggcagccagccaatcagctgcttggttaatgttctttttgtgctccgataatgctgagatactcggaatggacaaccactcctgtaactcgcctagttgttgctctctggctttttcaaaatattcggaataactcataaactatgtatcctcctttttcaatgtaaatcgtgtgaatgttgcgctatcctccgaaccgaggttgtggacgatatgtctagtttactacgttttgtgctgaacgaaaaatagggagataaaaaaacgattctacccgggtctgttcagacctgagcagaatcgcccctaaccaagcatatggatgcacttatgcgcgaatgtccagttgacccccgagatgaggctgtacgcttttttccatcatctgcactaaagcctgtccttgttcaccggcctgatccttagccatacttaatactttcacacttacggcttgagctaagctggcctgactcatacctgttgataatgctgcgatatccatgttccaaccctccttcattgtgaagactctttctctgtatttatcggttggaacggttattttgtttcatctaattggaattgtgtcagtaaatcttgaagctgctctgccagacgggtcaagtctgcggcagacgaaccgatctcttccatggaggcgagctgttcctctgcggctgcggacacggtctccgtatgggatgccgcttcttcagcgatgcgtgtaatttcctccatgctactaacgactgtactcgttccatctgcgacgccagcggtagaagctgcgacgttatcgagctgcttcgctgatttggctaccgctctacggatgcgagagaaggagcgaccggataggtctatggaattgataccatcatttacgcgttccttcgctgattccatagcaaccagagcttcagacacaccgttctgtatcccttgaatttgttcacgaatttgttgtgcggaatgagctgagttttcagccagcttgcggacctctgtcgccacgacagcaaaacctttgccatgctctcctgcacgtgctgcctcaatggaagcattcaatgcgagcagattagtctggctggcaatttccgtaatgacagtgacgatcgttccgattcgtccagatcggtcactcaaagcaccgataatcgtatccagttcttccacggtagtacgaatgccgtcaatggagacgacgctgttgccgatatgctcactgcctgcatccgacgcctgaatggcctgtgtggagtaagtggtcatttcagccatagtttcagtcatcgcggtgatgtctgttgccatgtcgctaacccgtgtctgattagctttagcgctgcccacttggcgttcgctgcctgcggccacatcttgaatggctatggtcacatgctcgatagcccgggtcgtttgttctgcacctgctgcaagctcctgcgaggatgccgacaaattgcctgtcatcgcttgaatttctttaatcatgttacgcaggttatctaccatttgttgaaaatatcttgataattcaccaatttcatctgtgctggtcgtagctacgttaatcgaaagattaccttggctgatggcatccatagaattacgtaatctttggatgggcttaagtatactgctgattagccacattgcgagtacaccaatgatgatggctgcaatcaccaacacgatgatcgtcgtgataagaatcggctgggcggaggcactggtttctgctttgtccatcgttccggcaattttccagcccgtcagcgcattagttttgaaaatcaggtgtttgtctacgccattaaaatcgtaactaaagctaccttcctcggaggcaaacagtttgggtatcgtttcccccattttggtacttccgctgacttctgtcgggtgggttacgatacgtttggtgccatccaatatcataataaaaccattttgtcctatttttaactttgtgatttcttttaaattattcaggttcagggaaagaccgagaacgccgctgttgtcgggaagtgtgcgtgaaatatacacaacggggaccttagccgtattgagtccaacagggctgattacggtttgtccgggtttctccatggcctgtttgtaccacggacgctcacgaggatcgtttgtggagcctacggctttaccaataatgagtttaccttcgggagttccgacaaacatatcaacagcttctgcatgcatttttaaatatacttgtaattttttcagaatggcatcatctgcttcagcactgttatcactaaccgtcatcgttgtagagtaatattcgagatcagcaattttggcctgaatcgtttgagtaaccgcacgatcagatgcggtaacgctagacgttgcactgtccagtaattggcgatctgtctggttgtacgctgcctgataggagaaagagcccacaataatactaggaacaagcatgaccagtagaaatgctgctgtcaatttcttgcgtagtgttaatgttttcagtcgtttcagttgtttcattaaacccctgctttctatctacatattcatttctgatatttataccatatgtaattactatcggttattttgagctgaattgatagatttattactaatttgtccaatacgctaaagaatttcttgcatagcatggagtatcttgcaatttggagggatagggtatgggtttttttctggatatgagaagctccaccaattcatcaaaaacaggtgagggtcccgatatacagctgggtcctataccggagcggttcggtttgatcactctgcgcacctttcttgtgccgggtccgattgtaacttttagtggttccattggtctgatcggtgagcttggcgatacgtatgcggttgaaatcgtacgtggagccgactatgatccgagcgaggtaatctaccgcgccgagggagtactgggcgtgactggggctaatgaaacgcaagcttttaatgcacaggatctgtccactccctgggcaatacaaaccgtatattcttcttatatttctggtgtatcgaccactgttcgtaatggtccagaggtgttcacgggcatcgcttcaactccgtttctgtaaatatatcaggtgaatatttttttagtaaatgctcgctgcctgttcgtggttctcctaggataggccgctgcgcccaagctatctagccacgagcatagacagacatctgctgcagactcgtggctataattctcaacaacacctagagcacaaatgacctagttgttgtaatttcctttatgagcgtgttctacagagttgattgtgtttctcggattctatctctttagaatctctcgcaaatacactgtcaactcatctgctgctttggcatgggcggagagcccgggatggctgcgagatcctatcgtttcttccgtcgtattaggtagttggaataccgacacattccgatccctcgttctttttttgtatgcgtctaccgctcggtagattgagggcatcatcggagtacccagcatcccataggcccacaaaatatgggcagcaggattgcaggtccgaagcttgacaagaaaacgttcgatagcgctttcaaaatcttgtaaatcctcttcattgaatgtaccatcctcgttcaagcgttgcttgtacactttcccgcttgctgggtccgtccatgcaggagaataaaaggctcccccgtcattagtccccaaattcactacgaccacgtccggctgccatgaggtaaaatcatgatctgaaaatgcccctaatgtttcatttctctcaccagttagcacaccacatacctgctcataatatgcgggtatgtttgcatgcggattattatcccagcttgttaggacaccccatccgctttgtgataacactcggtagtccgcattcagtgcttcggctgttatggctgtataattgcgtagtgctgtgaacagcatgggaacccagtctgtctcctccttcgctccaatcgttccttcccccgaggtaatgctgtcaccgataaattccaccttgagggacttatcagtgactggcagcaattccccgtcaaccttgagggcatagatttgcaacaagcagcgcgagtccgaactcataggctggacatccttgaccacacggacatttttgaccgtatcagggttcaaccctctcaaaacacagatcgaatgtcgtcccgcggtcaccatcaggcgactcatcggaacaccattgatgacaatactgatccagggttcatacacctggtaatcggcctcaatttcaatccacagctctgagcctttgatattcaattcaatgccactgcctgtccaaaacagagtaagaggtgaacgtgtttgcgtagttcgaccatgaacctttacatgctttgcttttgtaagtgggtatgtcttcaatctcttgttatgtgacatttcaacaccctcctcatgatatataaatgatgaatgctagtttctgtaatattgtaaaagaagtgacagggaatctcaaattctatttctaaacaagcaagggtccaaggctttatatagattattcttttcgatcacggactttagaacaacatatgatatcaaagaagcaccagcccattgaattttgctggtgcttctttgatatacggagcaaagattacttgctaagtggattttttcacaaatattattttatctattaattagctttgccaaacatgacgatattaatcgccttgccgaagtctatacctattttgccagttaactctgctgttttttgtgctaacacgactgcattgacaccacaagagaacagcgcaatatcaaagtcatctttatgtgctgcgatccattggagtgtttcgggcatttgttcatattgatgaaatgccagcgtgtgggcgatatgcagcttgtacggatcggcctcaagaacaggctttacttcagcagccgctcgggtgactagcagaatgcgtcgatttttcagcatgtcccagaaagcgggtgtctcagccaaataccgattcaggcaggcatggcaagtcagcgcgggggaaagagcatagtgagcaaaaacctgatcggtcagctcccgcttcatataggatggtgctttaatagattcgtcatcatatggcaaaatgccagcaatgctggctttgctcactgcctcagccaccgcgtcccgtagttccgtattcggtagaaacagtcccttttgaccgagattggctttgaccgcccaacgttcctgtaataccttttccatcggccagacggtgtcctgcgacaacaccaaattttcaccatccccaatacgaatgagcgaaaaggactggtgctgatcgagtgccagcttcaatcgtttcagtacctcgtcaatctccagataccttggattcgtcatatcatgttacctccctgtcgttccctgcttgttcaacttttcagatggagtaaaaaactttgtaatctatcatatgtcgaaagcgaaaaggtttttgtatgaacggctattctttttggattctacctatttttacaagattcgttgcatctgtacgtgccgtttcaaaagcgtcttcataacttgagagaagacggttgaaagggaggaagatcaatgaatcgcaagattgtaattgaaattaattttaataactatgggatgaaccccaaccgcctgacacgtgagtggatcagtgagcgactggatatattcagaacctttacgctgcgtagtttactcagtcagacaaatacggatttcttatctgtcgtcaagctggcgggcggatgcagtgacattgtggaagaggagctggccaagcatgagcccattcccgaccatattcgttttggtacgagcatcgaaagtaaacgtcgtatcaatgcgtatatcgaagacgcggacgaactgctcattgctcgaattgattctgacgatttgtatcaccagtcatttgtacaacagttgcatgattacaagtttcaaccggagacggttgcgttggtgaaccagatgggttacctgtgggatgccgttgaggggcagatggcaccggtgtttcaccgttcgccttctttttatgtgtttcgctatcaagtggaggattttctaaatgattaccgtgtcgtcatacctgggaagggtacgcacggatatgtaacggagctgccgcatgaggtcattccgcttcgcaactatgtgaacgtcattcatgccgccaatacttcggtgaaaaaagtgccagagaaggatcggctgtcagagaatgaaatgaatgctgtgctggctgaatttctgggaacaggcattgccaattcataacggtcaggaggagattatattgttcaaaggaaaaaaactgctggtgaccggaggaacaggatcttgggggcaacgcctaactgctgaattgctaaaggagggaccgacggaaattcgcattttctcacgcggtgaatttgcacagattgccatgcagcggcaatttcaatctgatccgcgcctgaatttcattattggagatattcgagatcttcaggcattgcaggaggcatgtcgcggagtggactatgttttccatttggcggcattaaagcatgtccccgtgtgtgagagacagccggaagaggctttcaagacgaacgtacacggtacggaaaatgtgatccgggccagtattgaacagggagtcgccaaggtaattgatgtctctacagacaaggcggtagacccggtgaatgtatatggcatgacgaaggcgataggtgaaagactgatgatccgcgccaacactttaagtgagcgtactcgctttgtgtgtattcgtggcggcaacgtgctcggaacaagtggaagtgtcgtgcccctgttcaagcgccagatcgcggaagggcaggatttaacgctgacgagtccagatatgacacgctttttcctcacgctcggagaggcgattggcttgctgctgaaggcttctgtcacggcgattgggggagagacacttgtgatgaaaatgaagggctgcaatattgcagatctggcagaagtgatgaaagaacaggcggggcagcctgcgttgaaagtgaaggagattggtatacgtggtggagaaaagctgcatgaggtgctgatttcgccctatgaggtgccgcacacgtatcgctatgatgatcgttattttgttattcttccccagcaagcagacgaacgcttactgagccaatatggtggattggaacgagtgagcttcgatcaatatcgctcggacgatgagttgatgaaccgcgctggaattgctgagctattgagaggcatggagtaacgatgaaagaggtgggtattttgcagcttatggagaaaataactaaaggaactgtaaaggttgcggtcatcggcctcggttatgtagggctgcccatggcagtggaaatggcaaaggctggttatgatgtatatggtgtagattccgatcccgtcaaagtagccaagctccttcaaggaaagtcgtacatcatagacattggcgatgatgcattggaaggtctgatcgggcagcaattgcatccggttacggatatcaaggtgctggagcatgcggatgtcgttgtgatctgcgtgcctacgccactgacggacggacaccagccggatacgtcctatattgaaacggctattgatcaggccatacctcatttgcgtagacaaacactgttgattctggaaagcaccacctatccgggaacgaccgaggaactgattcggccggtgatagagcagcgcaggggctggacagtaggtaaggatttttatgtgtgcttttcaccggagcgtgttgatccgggcagcgttcattttaacattcgcaacacacccaaggtgatcggcggttgcacaccggattgtctggcggcgggagtaggtttttatgggtcctttttggaccagattgtaccagtcagctcgacaaccgtggcggaagccgccaagctgttcgagaatacattccgcagcgtcaacattggaatggttaatgagctgacagccgcctgtgagaaaattggcatcaatatatgggaggtactggatgcggcggcaaccaagccattcggttatatgcctttttatccgggacctgggatcggggggcactgtatcccggttgatccgctatacttgtcatggaaatccgagcagcatggttttccactggaattcgtggacttggcagatcgcatgaaccggcgtatgccgctgtatatcgcggagcgaattgaagccatgctcgctcagaaaggtaaagccataaacaaagccaaaattattctggcaggtgtggcctacaaaaaggacattgatgatgttcgggaatccccagctcttgtcctgtttgaacatctaataaaaatgggagcttcggtgagcttcactgacccatatgtatcgagctttaaactgaacggtgaagcaatctcctctcgaacggcaaatgcccagttatgggaaagtgcagatatcgtagtcatcacgacagaccattctgtggtggattaccaacagctggtcgaccatgccccgctggtcttcgatacacgtaatgcgactgcacattgtacaggtggacatgtcgtcatcttggggcatcccggtgatggagggggcgccgctgttggctaaccgtgatcaggtaaatgaacgttattacgggcaaatcaattcggaagagtcccatgaagccactcgcaatagaattcactggatttgccgccatgtacagggccatactgtgctggatgttgggtgcagtcagggcataacgtccattttgcttgggcgggaaggatttaaggtaacagccattgatttggaagagggcagcatttcttatgcgaaaaaagaacttcgccaggaatccgcacccgtccggggaagagtccactttcagttaaaggacatttcacaattcgagcgtcctcccggtggatttgacaccattattttaggggagattttggaacattttgcgcatccccacaccctgctggctcatgcttatcgcttgttgaataaaaagggaacgctcgtcttgtctgtaccttatggataccatccgtttcatgatcacaagcggacttactatgccgggagcctctcccgtgtgttgtatccttattttgatgaacaagcgctggaggtgcatcacaaatatttgtgctttgccggccgcaagaagtcgaaagaactgcgtgaggccaaaccaggggtagagcatctgaatgaatggatgaaactggacgaggagcaatttcgactggtggagcagcagcatgttcgcaaaatgaatcagcgaaaggccgcactcgacaaggcggtacagcgaatccggcatatggaggaacaacttttgccgttgcacaggtatgcacgtgtcgaacagctagacaagacgcaggctgaaaggagaggtgcatatactgatggcgagtctaccggaaaagcgacggcagaatcagccaaaggtaaaggggatgacgtgaagtcatgattgagcatccaacgactatcagcttgtgtatgatcgtaaaaaatgaggagcagacactggcccgctgtctggattcggtcgcagacctgatggatgaaatcatcattgtggacacgggatcgacggatcagacgaagacgattgcagcccgctatacggatcggctatacacgtttgtatggagggatgattttgcagccgcccgtaatgaatcgtttgacaaggcgacgtgttcctacatcatgtggctggatgcggacgatgtgctgctggagccggaccgtgagcgcctgcgtgccttgaagcagcgtttgtctatggatatcgacgcagtggtaatgccacttcatctggcagagggggagcagggtgaactgttgttcacctcacgccgtatccgtctcgtgaagcgtgagcgacaataccgctgggaagggcgtctgcatgaggatctggtgatacctcaggggcaaatcgtgtattcggatgtggcagtaactcaccgccgaatgcaagaccacacgctccgtaaccaacgtattctcgcccggtggatcagcgaaagcggcaagctggaggggcgtctgctgtatttgcacgccaatgaatgttttgaccgtaaagaatatgccgaggcggcagaggcgttcaaccaactgttggaggagccaagcggctaccgtgaggatcggattaccgcttgtgcgcggtcggcggaatgctatcttcacctcgggaagccggagcaacagctggatagtctgttacgctcctttcgatacggtgtaccgcaatcagacttgtgctgcatgatcggtgactggtttttcacacgaaacgaatggaccaccgccgcatactggtatgaaaaggcattggagcaacagcatcaccttccgggtatgcgacctgttccactaccatgctactcctggttacctcatgtgcggcttagccattgctatgcccatgtaggtcagctggacgcttcgtatgagcataaccaaaccgctttacgctatttgcccgacgacccgcatttactggatagtgcacgcaagctcaaggaggctatttccaactccccaccctcagcccgttcctcaaaatagttcaagctgttccggtccgttatcctcttcgggtggcttgcgaaggggaaaaggtttagggtccatgccaagcatggtcatgagctgcttggcgttagcagcggcgtctccacctgaattgttattgaaaataacacacacctcacggctttgctgttccagctccagcaatctgtctctccattcggtcaattcttgttcattgtaccgatacagataacgaacctcccgccaattaggcgcggagctttgattccagcccgatatgttccgtccgtggagacgtacaactgtcagattgccgtctgtagccaacggtacaatgggaaccgaccccggtcccgcctgcggctcgtcgcatacgctgtgtatccagccttcttcacgcatgaatgccagcgtttgtttccgaaaatcaggtgtgaaccagctttgatgtctgaattcaagtacggatgggacctctcccatcctttttttcgtgtctcgcagtacagcgacattctcacgtgtacagtcgaaccagggtgggtactgaaacagcacggctttgagcttgcccgcttcgcgaagaggttgtatagatgcatgcagtgcttcgtacatggcatctattgttttgaagtaaggctgcttgccgcgggtatgcccagtcatgccttgataggctttgacgagaaatgaaaaagagtcaggggtttccgccgcccagcgtgccatacgatctgtgggctgcaccgcatagaaagaactatccatctctactaccggaaaatggcttccatagacgcttagtttttggttagctttggtgccggttggatacaagtcatcatgatcgccccaacccgtaagtccaatttgaatcataacttccccgctcctttctcttatgaatccttctaaaggcgttcccatgaatcattttaatgataaaatggggtgaatcacatgaagttggtatgaagttcctatgaatatttaagctcaaatgaatccatttcataaatgattaaaccattttgatctatatgtactctttattaaagctactgaaggtattatgaaatggattcaaataacgattattgtaacatgtttgttgttcaggattttttgtaaaactcttattcgtaatgcttttgagtttccagtttgaaaaagctaatatagtatgtaatagagcgaaatgagttcatggaggagaaacgatatggcagaatggtacgagcaaagctttggggaagattatttattggtatacaagcatcgcgactttcagggagcctatcaggaagtgcaaaaaatgatctcctggctcaaattaccgcaaggctccagcgtattggatttatgctgtgggatgggccgtcattcgcttgcgctcgcagatgcaggttataaggtgacaggtgtagacctttccaatgtgctgctgagagaggctcgtgcagctgattccgaagggcgggtaagttggcatcaaggggatatgagagaggtgccgctggatgaaaactatgacgcggtgatgaatttgttcacctcctttggttattttgaaaaggatgaggagcagcttaaagtattaaaggaaatatatcggctgttgaagccgggaggacgctttatcatagattatttgaaccctgcttatgtaaccgctcatttggtaccgcattcgtcacgggaggatgaagggaattggattgaggagcatcgggtcattgaagatggctttgtgaaaaaacaaattgcgattcggtcagctgcatccgttgcgggcactgaggcagcttctgctctgggcacgactcctactgagggagaacctgcgcgcgtgtatcatgaacgagtgaagctatatccatatgaaaagtttcgtggattgctagaacaagccggactatctgtagagcaggtacacggaagctataatgaagatcaatatattgaagatgcttcgcctcgaatgatttttgtcggcgtgcgggcttaaaacagaaaggcggatggaagccatgaaattgccagagcttacaccgtgtgagcgaatagacggaggctttcaggtcaaaatatccatgtcctttccgctgcgctgggtgaatagctatgtgctcaagggacagcacggttttacgattgtagacccggggccgcgcaatatggacactgaggcagaatgggcgcatgtcttccaacagctggggatgtcttttggggatatctctgacattgtggtgactcatcatcaccccgatcattacggattggcgggctggatgcagcagcaaagtcaggctcgtgtacatatgtcagctcgaagccataaggaagcgatgatgatgtgggacgctccagagtcgacggtcgctatggagaacaggcttcccagcttttttgtccagcatggctttcctttggagctagtgtcggccttggaattacatatgcggcaggcatatttgcaagtaaatccacagcctgagattaccgttattcctaccgggatggacgctcgtctggaatggggtgaacgcagttggctccccgtcgagacaggaggacatgcgcccggacatgtgtccttatatgacccgaatagcggcgttatcctctgcggtgacgcagttttgccgcagatttctcctaatatcagtctgctgccagacagtgatgcccagccgttgaagtcttatgtagacggcttgcagcgtctaggcgagctggaggtagcgtgggcatatccggggcaccgcaatccgtttggttattttcgggagcggacgcaagcgttgctggcgcatcatgaagaacggctggagaaattccagcagctgatccaaccggagggcagcacggcctatgagctgtgcatggccatgttcggtggcaagctgggtattcaccagctaaggtttgccatgtccgagacgctggctcatctggtggaactggtgcgccgtgaacgggcctctatgagcgagacggactcaatcacgcgcttctatcccctttgccgtcaatagtcgcggaaagttaaccaacaaagtgacatgacaagagcaacatgacaagcggcatgcatgccggaaaagaggattttatgaatttgctgctgctgggagctaccggacgcgtaggacggtacatattagattatgcattagcggacggccatgccgttacggtccttgttcgttcaccggacaagctggaggattacgcacccggatacgggaatcagctgcaaatcgtacaaggcgatgccactaatgcagaggacgtagcacaagcgctgaagggtggggcgacgactgtgatcagtgcgctgaatacgggtggaacgactaccttatccgctaatatagccctgctgatccggctcatgcaggagcagtccatttcccggctcattacggtaggaacggcagggattttacaaagccagaccgaaccggacctgtatcggtacgagtcctccgagacccggcgacgcagcactcgtgcggctgaggaacatcggcgagtgtacgaattgctgcgtgaatcagcactagactggacaatcgtatgtccaacctatctgccggatggagcgcggacagggatttatcgtgtggaaaaagattttttgcctgaaggtggctcacaaattaccaccgcggatacggctgattttacctatcgtcaatgcaagagttacgaatttgtccgtacacgggtaggcattgcctactaatcatgaacgccaaacatagcttcatttttaagtattcaaccagagcgcggtaagtgtacctactcattgcgttctttttttcatttgacaaacactcaagcttagaatactatgattcttaacggaaacactgttacctaaaaatcttgtgtagctctttaatttattatagtagcatcaagcgacagttcttaataagcaaaaggaagtgtattgaatcatgtccgagccatcgcatccctataaaacctattcggaagtgaagctacagcagcagcaattgctacgtaaaaatgtcatcgatgccgcatgcatccttcttgcggaagaagggccagaggccgtgaccgtgcggcgagttgcgcagaaattaagctgttccaccaagatcatttatagtatttttggcagtaaggacggtcttgccaatgagatgtacctggatggatgtcggctattggctgaatccttccagcaagtacctgttaccgaaagcgtactcgctgatcttgaagctctatgctgggcgtactgggaatttgcgcagcttcattcagcttattacaaaatgatgtttggcggtgcattatctgatttcaagccggatgaacagagcttggagggtaccacaacggcattgtcacgaattctgcacaccgtcacacatgctatggagataggggcactgaaagaggaagatccgctgttggttgtccgaatgctgtggtctgctttacatggagtcatacatcttcagtttgcaggtcatttttcagatgtagatatggctcaaggagtgtatacatttacactgaagaatatgctcgtagcatttaaaacatcctcatccccatcgtaaatatgaagtgtactgaggtcgtcatagtagatgacttcagttcattatagagtagtggtaacaatgtttctgaaataaaactatgatactatggaggttatcatcatgtttatgtacgcaaacaaaacagctctgatcacaggggcttcatccgggattggcgaggcctttgcctattcgctcgcagctaagaaatgtaatctcattttggtagcacgcaatgaaaccaaattagagacgctggctaaagaactctcagctaaatttaacgtaaaagcaacggtgattgcgacggatctttccacaccaggagcaccacaagcattgcaccaggaggttcaaaagcaacagctgaaggtagatctcttgattaacaacgccggttttgccacctatggatactttgagcaggtttcaggagaacgacagcatgaggaagtgatgctcaatgtggctgctttagtcgacatcacacatgcatttatgcctgatttattgcgtaagcgggatggtggattaatcaatgtttcttccacagctgcatttcagcccgatccttatatggcggtgtatggagcaaccaaagcatttgtgctttcttttactgaagcgctatgggccgaaaatcggaaacgggggcttaaagttctggccctttgtccaggctcaacagaaacgcctttttttgatattgttggcgcaagtgaagcgtcagttggaattagggaaactccccaaaccgttgtgaagaacgcgttgagagcatttgaaaaggggcgtagtcacatcatttccggtcgccagaactattgggtagctcaggtatcccggttattctctcgtcaatccacgctgggaattgtagaacgtgcactgcgtccaaaaaatggattgtaatttatgaatgaaggtaatctgggcttgaaatgtcaggattgctaatcaatatgttgtgagttttatgcaccgggtctgatcgtttctaactcgacttgaatcagacccggcgttcctatttgtatagatcaagcacttagaccctattcaagccctcgggaatatagtaaaattccatcccgtttctcccagccgttagctgaccagaagcgttgaccccctgcgttatgctccattacaaacagatgacatttatcaatgccttctctcagcaaagcagataacgccttatccaccagtctgggcgcgatcccttgaccacgatgtgctgtggctacacccagatgatacaaaaaccccctgcgagaatcgtgacccgctaaaatcgtgcctataatgtttccattgtactcacagacaaagctaagtccttcgttccgttgtaaaaagcgtgcaatccgctccggtgagtcagcctcgcttaatcctaatccgtctaagccattccaaagctcaatgacctgatcataatcgtcagcctgcatcgtacggaatgtatatccttcagttacgtttgccatgtctagttctcctctaagcttgtctatatctgttatattctaacgtgttgtttataatttagggtgttattgtttttttaacgggttgtattcggtgcactttcttccccaagctcctgctcgcgttctgcctgtttgcgatgggcgatacggctgctggccgaagctgcgatagcgcccacgatgtcgtccaggaacgtatggatcggcccgaggcttttatcgttcaggcgttccagcacacccggtttaagcttatcgacataaccgtaattggtaaatccaatgctgccgtacacatttacgatggagaaggccagaatctcatccactccgtataatccctcatcattctcaatcatgtcctgcaatgggggaagaagagcgccctgttcggcaaggatgtccagttggatgcccgtgagcactgcattttgaacctcgcgcttcatcagcaccttgtccacattctcaatacattcttccatcgttagggtcgggtaatattttttttgtaaaagcatgaccagttctgcgatttcagtcaggtgtacaccacgcttgtgcagcaactcgcgggtggcatcggctacctttttactattcaggctgtatggtgcttttttcttgtccataaagttgaaattccctcctcgtatagatcctgatttctactgcaattatgaccagtgtgtccagtctgctgaaaaagtagttattttttacgcgaggctcgtatacatattagtacaatctgtacaaaattgttagggaggaacttcacttatgaatataaaacacccatggcgtatgacctctgtagctggactgctatccctacccctgttgttgtcgggctgcagccttttcggcaacgaatcggcatccattgaccccccgccgtccacgacagagcagtccatgattaaggctgtaaccggaaaagcacctgccagtacaggtcaactgagggctgtttttttgcaagaccataacggtttgctggccccggtatctttaccgattgctacaggtgatgtgcaggcagatgccaagtcagcgttggaaacattggttgagggcgggccgtatgctggattattaccagagggatttaaaggggtcataccccagggtacagaagtaaaaagtgtgacagtggacaagaacaacaagctggctgttgtcgaattcaacaaatctttcgccaactataagccacaagaagaacgaaaattaatggagagcttgacctggaccctaaccgaccgtcccgatattgagagcgtacagatctgggtggatggcaaaaaactgaacgaaatgcctgttggcggcacaccgctagatcatccattgacgcgtgcagtaggtattaatttggaaattggtcatggcgtgacacccctggattccagtccagtcactgtgtatttctcttcttcttctcctgctggagttcaatactatgtacctgtaacccggttggttagccctgagaaagatcgtgtccagtcagcactgcatcaattgattcaagggccgcagaccaaagatgggttacaagaagtgatgacaggggagacggcgctgaaatcggtagaacgctccaaagacaacgtaattacggtatctctctcagatgatatgtttgctaaaggagaagctgtgcctgctgaatttttggaatcggttgtgctgacagcggcagacaattcagatgatgcggtcaaaacaaaaattcggattgaactgaatggtgaaaaaagcgtaattggacaaaataatcaaaattatggagagcctgtagccaagccgcaacatattaacgaaatccctctttaagggcggaaaatcgtccttggggtgcttttgcctgcacactttggtaaaataaacatataagaacaggttgcatacgacgtaggaggaaaaagcatgagtagatctaacggacgaaacggtgatgagctgcgcccgatgaaattgacagcaggagtaaataaatacgcggagggctctgtttttatagaggttggcgagacgaaagtcatttgcacggctactgtagaagaacgcgtacccccctttatgaagggacaaggaaagggctgggtgaccgcagagtattccatgcttccgcgtgcgactcatagccgtaatcagcgtgaagctgctcgtggcaagctgacaggccgtaccatggaaattcagcgtctgattggaagagcgttgcgttcggtggtcaatttgcaggcgcttggtgaacggacgattacgttggattgtgacgtcattcaggcggacggcggaacacgcacaacctcaattaccggttctttcgtagcgttggcgattgcggtcaataaaattgccacccagcacaagttgcctgtttttccaattaccgatttcctggcttccgtcagcgtaggggttgttggtgaaaaagcgttgcttgatctgaactatgaagaggattccaaggccaaagtagacatgaatcttgtcatgactggcagtggaaaatatgttgagctgcaaggtacaggtgaagaaagcccatttgaccgtaacgaattggatcaactgcttagcttgggcgaacaagggattctgcaaatgattgagcgccaaaaagaagtgcttggaccgattgctgataagatcggtgctggacgtacaggagctggcgcctaatgcggctggatggcccggtcgtcattgtcgctacgaaaaataaaggaaaggtacgggaatttgcgcatgcttttgcgccgtttggcaaggaagtcagaagcatgtacgattatcccgacattcctgatgtcgttgaagatggcaaaacctttgccgaaaatgcactgaaaaaagctaaagcggttggagatgtgctcggtttgcccgtactagccgatgattccggcctctgcgtggacttgctggacggtgcaccgggggtatactctgcccgttatgctggagaaggtgccagcgatcacgaaaacaatattaagctgctcgacgttctagaatcgaagcagctgggtgatgatacgggacagcctttgctaagcccggctcaattcgtctgtaccttgattctatataatccgcagactggcgagacgttggaatcgacaggctccgtggagggctggattactactgaaaccgccggcagcggcgggtttgggtatgatccgctgttttatttgccagagtttgaaaagacaatggccgagctgacgttggaacaaaagcaggctatcagtcaccgagggatagctctgcgtgatttggcaacaaaactgggtaatccacaggcatagcattggtaacaggggcgaaatcatcccccattcacataacgaaaaaaggctatccgtcagtcataagctgcggatagccttttaggtactttctgttccccgtatagtacacagcgaaaaattgccgctgccgcttagaagctctattgcttcagcattcagtgtagcttatcgaatagctaccttgtaagtgcgcaaccagttatccacttgagccaaataggcgaacaactggggacccgacatcagctgaccaaaccaaggcagattggtggatgcctccggtgaggcggcaatatcgcgtaccttttgcgcatcgatcagtttgagcagtggggaagaggaatcatccagcagttgcagcgcctgctttttcacagcctcaagataggaagggttatgcgttttgggatatgggctttttttgcgatacagcacatcatccggcagtacgccctccagcgccttgcgcaaaatacctttttcacgtccgcctgtcatcttgatactccacggaatgttccatacatattgtaccaatcgatgatcgcaatagggcacccgcacttccagtccggcccccatactcatccgatccttgcgatccagtagagtaggcataaagcgggtgatgttcaaataggacatgacgcgcatttgcgcagcttttcctgtttcccccggtagcttcggcacttctcctaccgcttctgagtagcgatcgttcaaatactccagcggcttgatccagtcccgtacctcaggagacaacagactggctctcatatcgggtgcaactgcccacgggaatgtacccgaattcagcatatcctcccggtggaaccaaggatatccgccaaaaacttcatccgcagcctcgccggaaatagcgaccgtagctccttttttaatctcccggcaaaagagatacagcgacgaatccacgtccgccattccgggtaaatcccgcgttagcgtggagttgttcagagctgctacgacttctggcgtatcgaattcaatccagtgatgatttgtccctaattcatccaccatccgctgaatccagggggcatcggctccgggttgaaacgcatgggctttaaaatgcttgtcgttatccacataatcgaccgaatacgtatgaacttgtccctgcccggtacgtttgtaataatcgacagctaatgcggatagagcgcttgaatccagcccgccagacaataaggtgcacacgggaacatccgaaatgagctgccgctccaccgtatccagcaacagttctcttaccttaagtgccgtttcttcggtattatcctcatgcgcaatgctttccagtgtccagtaggcttggatgcgcacgccgtcgcggctgtaggttaacgtatgcccggggcgtagctccttcatagacgaatagacgccgtgtccgggggtacgtgcaggcccgatgataaaaatttcggccaatccctcggcgtccactgctgcctctaccgctggatgctggagcagtgctttgggttctgagccaaatacgaatacttcttcggtttggctataaaatagcggcttcactcccagccgatcccgtgccagaaatacctgctcccgctcgctatcccagactgcaaacgcaaaaatgccgtttaaccgatccacacattcagggccccattcgatatatgattcgagcagcacctccgtgtcgcattgtgtacggaaaaaatgcccgcgctgttgcagctcttttttcagctcaggcgcgttatatatttccccgttatatacaatcgtataagtgatatcctccagctgccggatcatgggctgagcaccattttccgggtccataacactcaatcttcggtgtccgaaggcacacgggttggatatccaggtacccgcagcatccggtccgcgatcggagagcgtttgtgtcatattcagcagcagctcagattgatgcattaagtctccgttccactgtatgaaacctgtaattccgcacatgtctgttcatcctctctttgtcgtgttcatccagtgttggaatgaatcaaaaactaaatccccagttcatcagtatatatgccgaaaagaagcataaaatgtctgtccgttccgaaaactacagatggggtaacccgtctactcgcaaggaaggagggagaccatgtactacatcaaggatgccaaaatacgccggttcactgaacttgacggagtgcgctgcgctgaggtagaggtgcggcccggtgctgcagatgacccggaactgctggtctatattacggccaaggatcagacggatggtcagcatgactatgacatggtacggatcatccgcaatgacgccgatctggagctggattggtacgacaataatctgcattcggcatttgaggaagtgacagacaaggcttttaccgactctacacacattactgctggtgaggagcgagagaagtttaaaaaagaattgctctcctatgggcagctcagcacagagttcgccaaggagttcggggcatgaggatatggtgtgctatgcctcggcttttgttgatttgggccccggcgccatcgccggatcagcgtgaaaggagggggaaatcatagacggcaaagcgaattataagaaaaacaaaggcagcagttatattcataacaatgagttcgcagaagaagtgctggagaaaaacgtaagacatgaagtacggagaagtcctaaacgctttgggaataaataagcagccattgaaccaaatagcaacagcaactcatcaaaaatgaccctaaagaagcctccgtatcccgccaaattagcggtatgtaggaggcttctttttgaactaagccgcttcacgcagcgtcataatccctttgtagatgttataaacaaaaaccccgagatagaccactacgaatagcagtacaaaaccgatcactgaacctgcatgattcgccgtaataataaaatacactagcggaattgccgcaataatggggaaaatatgcgataaaatagctttttttgcatgtccctgaacatattcgtcccgtactgcaatccacacaatgacaggcactagaaaaggtgcgaagaaaatgctgaaataacaaagtgacgacaaaagacctctcacagattaacccctcctttatgcatggttctttgtacataataccccgttagcgtccaaatgattccttttgcagcccacttccctacatcatgaaaaaatgcttttgacagttgcccgaaatgtgatataataatcaatgcgctgaatacataaggttttattgatttacatcttgtcccagtagctcagctggatagagcaacggccttctaagccgtcggtcgggggttcgaatccctcctgggacgtcgaagcgttcagatatgtaaagtttgaacgaaattaaaaatgcttcaaatccttgatatataagggtttggggcgttttttattttattggggttacgatagaaaacgttagaaaaaggtgtgatcaatacacctgcacgctatataaacgttcaaaaatgtctgttgttttgaatcctgttcacgtagctctttcataaggtgggcatatgtagaggtagtgatatctaatgaggcgtgaccaagccgctccgaaacatacagtaaactaatacctttatatagtagcatgcctgttgaataaccacaaaatggtagaaaaaagatcttcttttctgtagaatcgttggtaccatccaaacgaatccgaaagaagacgatctcatgaaaaattctatcacgattacacctatccttgaatccatgctgactcctgaagaagttcaaagggttgtgaagttaataggcccaaaagaattattactcatcgattcaaccacgatgacggtgggaaaaacgcgtttgccttgggctccttatcacggggagcgtgcaggtattaaacttcaagtcgctttacgagcagaaaatgggcaacccttcaggtgatcgaaacgctgggcttcaagcatgatggccccatgagtgaagcgttggctcaaccggactacattttggtgatggaccgtgcttatgggaaactggagcgtctggatcacttcaaaacccatggacaatcgtttgtcattcggcttcgcgataacgtccatttggaaaagcctcatgcgctacgtcgccttacgaagccagattcatctgtcattcgggatatcacttgccagttggggacccctcagtgtcgttccagacaacgtcatcgtgtggtgatgtttcgggattttgaaggtcgggaaattcgggtggttaccgatttaatgcaggtgaccgcagaacaaatcgcacagatctataaggctcgatggcagattgaagtcttctttcgttggatcaagcaacatttgaatattccatcgctgtttggtacgactgaaaatgcggtctatgggcaattattctgtgctctaatcgtctatgtcctgctcaattggctatttgttgctgctcagacttcatggtcccaacatgccgttctttcctttgcgcgattttctcgtctatttcttcttcaaaactacctgttgaatggctgattcagattcagcgtgttcttcttcagtgcacctcttgtttcatgaattgagttacttattttggttattcaacaggcgtggcagaatctaaaagtatctataatcataaagatttattccacttttagataaggattgagaagaccatttcagctaactgcggctttagtttaataacaatcttccataaaagagcgcgattctataataaggatcagttcgttttcattaaagggccatattatatcttttaatttaagtgaaactgcctaaaaagtatgttaatatcagatttaacagacagacaaactagtatttatagaggcgaaattatgaaaaaatatagaatatatcaagtagactcatttacaaaaaatagatttcatggtaaccctgctggggttgttccaaatgcaaatggacttacagatgagcagatgcagagaattgcaagagaattaaataattcggaaactgcatttatttttgaaacagattcttcaaattatgatgttgaagtaagattttttactccaacaacagaggttccaatttgtggtcatgcaacagtagcagcgcattatatttatgcaattgagagaaaagctgaaactggaagaattattcaaaaaacaaaagcaggtatattgcctgttgatgttataaagtatgaagatgactattctattgtaatgacacagggagaaccttctgtatcagagcctttaaatgatgaaataagaagtcagattgcaaatgcgttaggtatttcttgtaaagatatttgcatggaatatccagttgcaatatcttcaacaggtcattctaaggtaatggttccgatttactccaataaaatactacatagtttaaaacctgatttgcagaagcttacagaaatcagcaagcatattggatgtaatggatattatgtttttacattaaatccacaagaggatatattggttcacggaagaatgtttgctcctgcaattggaatagctgaagacccggtgacaggaaatgcaaacggaccgcttggagcctatttggtacactataacattttgcaaaatgagaatgagcagtcttttgattttgatattttacaaggtgaggcaatcaaaagagagggaacaatgcatgttcatgtgaaaaaggaacagggaaaacccgtattagttcaaattacggggaaagcggttattgctttttcaacggagatcatactttaaaaaagtctaacaaatttatcaataagcttaatgacggattgtcaagccaagtacaaacccaataacaccaacgtcccagcaagtactcctgggacgtatagcaaaaagcttcctacatggaggaagcttttttgtgttccagcaggataattgattctagctttataccgtcgccttctccttatgagcaaagaattgaggtagatgctctttgtgtgcttctagcaattcatccagtacggtttgagcaatgtccccgcttggtacgagcggattcagggtgaaggcttgcagtgctgttgcatagtcaccggtgaccgccgcttcaatcgtcagctcttccattgccttcattacttgcagcaagccccgctgtgcaggtgggaatttgccaaagttgacaggttcggcaccgtgggcgcgaataacactggtcacttcgatggcgctatcataaggaacatcatcaatcgcaccattgttacgtgtactaacgaccatcaatgtgcctttgttgttataaatggaattaatgatttcacaggctgcatcgctgtaatgcgcaccaccgcgtttggataattcctctggtttgtaatccagattcggatctttatacagttcgaacagactttcttccagacgtttgaccacttggccccgagttccttcgtttttggcttcctctaattcttccttgagcatgttatccgtcatatagtaataccgatggtaaggacaaggcagcattttcaattgacgaacttgatcatacaggaagcgcatgttcttaatattttcaacgactttctctggttttgcacccggagcgtacagtccttcaataacttgctctgttaattcggcccctgttttgtcataaaccttgtgccaatgaaggtggttaatccctgcaaatttaaagaacagctcttcttccggtttgtccagcacagctgatgcactcttgatcgcgccgattggaacattacataatccgatgactttatcccactgaccataacgaagcacggcttcggtgaccatacccgcagggttggtaaaattaatcaaccatgcattcggacatagttctttcatatcttcgacgatactgaggataacgggtatggtgcgaaacgctttgaacattcctccggccccattggtctcctgaccgatcatgccatgttttaacggaatactttcatccttaatccgggcttccagcaagcctacccgaaattgggtcgttacaaaatcggcgtccttcaacgcttcccgacgatccagcgtcaaatgtacctcacaatcaatgcctgcagccttcaccatccgtttggccatagcacctacgatctccaatttttcacgtcctgcctcaatatctaccagccacaattcccgaatgggaagctctgcataacgtttgatgaagccttctactaattctggtgtatagctggagcctccgccaatggttgcaatctttatgccttttttcatagttagtgcctcctaagtatgttttgtaaaccgctttcttaagcacaaattcactgtaatccctgtaatgcattacaggtcaagcgcttttaaaaaacttattttgggaaggtgacaattatagggcggacactacgaacatgctaaacacgaacatgctaaaatagaaagaacgaggtgagaaaaatggcgaatattcatgaaattgcaaagctggcgggggtatcctcggctacggtgtcccgtgtcattaacaaccatccgtacgtgagtgaacccacaaggcagcgcgtgcaggaggtcatagatcggctggattatgttcctaatttaaatgcggtatctttaaaaaagggcatgaccaagctcatagggattatttcactttcttttaatgattcattgggtttatttgtgcgtggatttacaatgtatgcccaggagcatggctttaatatagcgctgtttattacgaatggggagaaggggcgagaacttgaggcgctggaaatgttgcggagaaagcaactggacgccttggtctgcatgattcgtgtcaatgagtggagtgtgattgagcattatacaaaatatggtccgattgtgacctggcagcgtgtaaacattgaggcaattccgtctgtatttatggatcagtatcagggctatacgctggcattggaacatttgtacgcccgaggatatcggaaaattgtgaatgtgtacggcagcatgcgggggttgaatacaaaagaacgcattcgagcttatcatgacttttgcgaaaaatatgatttggacgctgaggccttcccgcatttttatgatttaaattcaatagcagctggtgaacaaatagctcattggtgggcagaacgagcacaaactgacaggccggacgcctttgcctgttctaccgattatttggcagcaggtcttttgactgaagcgcgtaggctaggtgtttctgtaccgagtgattttgcagtagtaggctttgacaacaccgaaatctcgcatttgcttgatttaactacgatccattacccgatagacaagcaagctgagaatgcgttcattatgattcgaaatgccctcgaagggctggatgaaacgatacatcatctggaattcaaattagtagagcgagcgaccacctgattccaaaagggacctcatgttagtggttattaatttccatattaaagtttatatagtaggaataatggaagaaaaatgttgacacatgttaaaacttggtgaataatttgaggtgaaagtataaaatttggattttttgtatgaagggtggttatgacttgggacatacacctacgattttgacgaagttagaggattatttaggggaaaacaatttgacgctggcacaatttgccgaacattcaggtgttcatcaaagaacacttaataattggattgccaagcatcgtcctgttgctatacatcagcttgatcgaatcacttgggctatgggactaccagaaggttttttttacgaactatacatagataactacatcattgagcgttccccggattggaggcgaattgagccgttgttgtttcgctgtgcggaactggacaagttggatgctatccagcttgtagtgggacatattatggacaaccttctatattccccaaagttatttgatgcagcagaaaaattattcgcacaaggtcagcacaatgctgcattgttgctctacgaagggattgcggaaggcgagaagtaccagcattctgaacgtttggctatctgtcagtatcgtctgtttaccattcaggtgggtaacaatcagatccgaaatctcaaggcggctacacgatttgaaccctttgtcgaacgtctgaatgaaatagatcaactcgatgcgttaaaagatttggcgaatgtgtatcgttctctgcgtgaatgggacaagctcgatgcaactgctcgaaaaatgagagccaaagcggagatccaatactctttgaaacatcaacagaaaaagcgagagtgggaggagtctgaaaagaggctgagtcgcccgatgtttgtgtacattacctatgctgatttactgtgtgcgagtgtctgtgaagcccaaggcgattatcagcaagcattacaatttacaaatgcatacgcagatttagattgggtgatcgagacagaccagaaaactcaacactgggtcaacttgttcaagcattgggcagaaggtaatacttatgtaaataaactcctatctggagatacgaatgtgcttcctcattatgttgaatatattgcatccacatcaatcactaccgagaatgaaaagctatccaagttgctgaacgttatgatagctgctaaccgatatgcaatagatatcaatgatgtcctttcacgttttgaagtggagattaattcttttgctctgctatcacaatccactgatatgtacactcaacaagtgatgccggattattttgcatggtttggttacgaactggcttattactatttaagacggggaatgttcaatgatggctttaaacacttaatatatgcattggtaaaagcccacatactaaataatgagacttattttataaactgtacgggactttttgcacatttccaagcacatgcgcttcccgaaacaagggaagagtatttcaaactattagaaaaggtgtggttagacaatgttgaaaaaaatgattctgctggtcatcgcagctagcttcttgtttattttagcaatgcctgttcagtcacataaccaaaatcaaagaataacgcctcaagtacaaattggaggtgcttaaaacggttaggttgtatgttctaatattcattgaatctttttatggaaagagcctcggtcccactttattagtggagacggaggcttttttacgtggattttgaggcttcgctgtttatgcaaacttttggaatgttctttttttgttaggcgcatcatttgaaaatccaaaaaacgtctttttgttataaaatatgacatataggagggatcatgctgatgaatcaaagtgtgactttactttgtgtcgaaagagctaggaagaaactgtaccaggtccagaaaaagtatggatttttaacacatcccaaagtaatagaacaatctaaaaagctggatgatctgttgaatcaatatcaaacgtgtagatcggatcattgagaaatgagagcatatttttctttaattccttgaccgcacctctaacctgctctgtctgtgtcacggctgaaatcaccgctacaccatctgcacctgcacgtgcgacttcctcaacacggtccactgtaatacctccgatcccaacaatcggcacatcaattcccgctttacgcatctcatataaaattgccggtccctgtacggcatgggcatcatctttcgagatggtgggatagatgggcccaacgccgagataatcagcaccttgcaggatgactcgacgtgcttcctcgatggtatgggcggagacgcctaaaattcgatttccgatacgctcgcggacggaatcggcggattcatcgtcctgaccgatgtgaacaccgtcggcgtcgagttcaagagccaactccacatcgtcattgatgatgaaggggacaccagcgtgatggcacagttcctgtagctggcgcgcaagttcgaacataggaacgcccgttaacgcgccgagacccttttcccggaactgaaccatagttgccccgccagccagagcctcctgcacgacccagcctggttccgcgaggcaattcacgcttccaagcaccaggtatatctgtagatggcggcgcaccacctctgacaatattctgccgctcatagaagcatctcctgacgacgtcggtaggcccaatgattggttgggccgtgtccctgtcccagagacaacgtatcctcaatcgccgcctggatgaaggctttaccattcgagatagcctccggtacagacatccctttccctaattccgcggtaatcgctgccgagaaagtgcatcctgttccgtgtgtatggacagtccgtactcgcttgccgctcagctctataaaggcggttccgtcaaaaagcaggtcaacaatctgtccgctgatctcgctctcgtcagcgtggccacccttgatcacaacgaattttggtcccatactgctaatatgtctcgcagcctcgcggcgatcctccatcgtatggatactgatccctgtcagggcttccgcctccgggatattcggtgtaacgaccagggccaaggggagcaggtcgtccttcaaagcctgcaccgcttccagctgcagcagttcagcgcctcccttggcaatcatcacgggatcgacgacgacctttttccagccgaactttcggatctgctcgctcacaagacggatgatgccggcattgaacagcatgccagtcttcagggcatccactccaaggtctaatcctacggcttcgatctgttccgctgttgcttcctctggtagcggatatacgccgtggactcctaaggtattctgtacggtaacggctgtaatagccgacatgccgtacacgccaagttcttgaaaggttttgagatcagcttgaattccagccccgccgccactgtccgaaccagcaatcgtcagcgctctgggtacacgaacgtctgtcatcgcgcaccacctgctgctgttgttccggcttcatggatcgagacatgcccctctagtgaacctgtatgcagtttggccagctcgtcgagaaaggcaatctggaagctgccgggccccagctctgcggtacgtgctgcggctcgagaagctgctgcaccgtaaaatgccaaacctgctgtacctgcgagcagcaggttgggttcaacagctgcaaaggcacctaacacagaggtcagcagacagcctgctccggttaccttcgtgaggagcgcgtctccgccgctaatcattcgtgcttcggccccatcggtgatgacgtcctcttttccagtaatgacaaccatcgtattgagcgttcgagcagcccgaattgccagatcgacatggccgctgtcagcactgtcaccggcatctacgcctttaatctcacgcgcttctccaacaagatgtgcgacttcggctgcattgccccgcaccaatgagattttgacttcactcaggattcgcagtgccgattcagttctaaagctcgttgctcctgcaccgaccggatctagcagcaccggaacaccgtgtgcattcgccgattgtccagcaatgatcatggcatccaccagttcgcggttcagtgtaccgatgtttaacacgacggcacctgctatttttgccatatctgctacttcctcgggtgcataggccatcaccggggaggcgcccaatgcatacaggccgttggccgtaaagttggtgactaccacattggtcatattgtgaacgaggggtttgctgttttgtaccttcgtcaggagatccgaataacttttttcccatgtactcataatgattatcctctctatagttggtggttcaacagggcattaaccgtacttcacgcatcgaatcgccaggctgactattccaagaccgctgcctgcatctggaccggccattcttcctgcttataagccatatcccagaacttatattccagctggcagctcagtctaaaatgctcaatcatccgctcccgctcagcagccgttgcgtcttccgcccaagcatctacacgttctcggaacttgagtgttgtatcatcaagctggtctccatagaagcccatccattcatagaacggatgagactcatccggctttacttcatccagcagcctgcgaccaatctcggcatacgtccacatacatggcagcagcacagccaagatctcgcccaggctaccctcatgcgcaaccgtcagcatgtgacggatatagtgatgagccgacggagcgagcggatatccctgcaactcttcataggccacccctgcgacagcacagaaattttgatgcggatgaacctcgctgtggagaataaaagagatttgttcattaaatacagccatatcctcccgattcgtgcatttggagattgcgatgccgtatatccgcatgtaggcgttcaaatattcaaagtcctgttttacatagtgaatcagctgtccccttgtcaaacttccttcagcaatacctctcacaaaggggtgctcaaaaatcgcttgaaaaatgccgtccgcctgccgacggagttcttgtgtaaaactcaatttccccacctccattaaattgaagagcaagaagtcctgtaagaatataattccggaacaacgctaaaaagccgccccggaaaaatgggagcggcttcaacaataggcccaatacgcaaaaaaacgtttgaaaccttatatacgaaggctccactttcctacgctagtacgaactagatcaggttcaaagggtccaagatacgttcttgtctcagccatagcggctcccctagtggacttctattcttttgactattactgtacatacgttcatacgctatgtcaaacatagtgtgtaaaatatgaaatttcctctagttaggtgttttgggcttagtgagggtgatgaattacattttccacagctttgaccttggcatattccggtttccacattgcatctcgtatagcttgttccacatctgaaatgtgcgcctgagctacctgatcctgtatcgcggcttttgcaaccgcaatcgcaacagcgtacgaaacttcgcgtaattttcggatatgagggagtagtgcaccgccaggcgtattcgaatctacaccattggcaacagcaactgctgccgctgtaaacatcgcaggggtaatccttttggctttaaccacaatcgcacccagacccagtcccggaaaaacaaaggcattgttcgcctgtccaatctcaaatttcgtaccgttataggtgacgggctcaaaaggacttccggttgcaatcagtgctttgccatcggtccaccggatcaaatcctcgggtactgcttctgcaaggtttgtaggattggacatgggcataatgatcgggcgttctacatgtttcgccatctccttgatgatctcttcagaaaaggcacctgctacaccggaagttccaatcaatatcgtaggcttcacctgacggatgacctctagcagtggtattttgccgtcacccgaccgggtccatgagctgacttcatcctttttgcgcacatacggtttctgatactccaatacgtcttccatatcttccattaacagcccgcgataatcaaaggcccaaaaggacttgaaggaatcttctgcggaaaggccgtcctcgatcatagcaccccgaatttgatcagcattaccgattcctgctgcccctgggccgaaaacaagtattttttgttcacgcagcggagtcttggtgacatccaccgccgaaagaatcgcagccaaggtcaccgctcctgtaccttgtatatcatcgttgaaggtgagtatgctttgaccgtattttcctataatatggcgtgcatttacgctgcccacatcttcccaatgtaaaagcgccttcgggaattgcgctaacgttttgctgataaaagtatcaataaactggttataggcttctccgcgaacccgtttatggcggtttccgatgtacagtggatcattcagcagcttttcattatttgtacctacatctagtacaattggcagcacccgcccgggatgaatgcctgccgcagccgtatacactgcaagcttgccgatagcaatgttaatccccccgacgccccagtcaccaatccctaaaatactttcggaatctgtcacgacgatcagatccacatcatggccgctcaaaccagaattatggaatgcttgtccaataccgttcgggttatctatcgacaaatatatgcctccaggacggttgtactcgtgactatattcttgaatcgcggttcctacggtcggcgtgtagactacgggcagcatttcactcaaatgatcggttagcagccggtagtagagtacgacatttcggttgtgaaggtcgttgagagaagcatttttacgcagcatcgtgggttgtgccagaaactgctgatatgcccgtacgctctgtttctccaatgaaaggacggttggaggaaggattccttccaaacccagctctttgcgttcttcttctgtaaaagcgacacctttgttcaaaaggggatttgccaacacatcctttccccgtaatggagtagataatgacccatcgcgattgacataaaatgcttccatagaaagaccttccttctcttcattttcataactattcataacgaaagatgacatgttgtccatagtatggacgtgcaaatatgttttattcttgcatttatctatgacaaaataaccatatttgtttctttctaatgatataaaagaactaactttcaatatagattcgctaaccattcctaatgattttggttctaatgaatcaggtctaaatgctctgtttttatcaaatatgaaaattagtttttcttctcttatctccatatatatcatggagtgtcagttattttgttaaggaaatatgaagtatttggacattaatttaactcctataagcaaacattcttaattctttttcaacaaaatagaactattcggaggaaaaggagaggtttgtgtgcagggacctatagccatttttagcgataacgacagggctattgattatcccaatgtgatttgtttttaccaatatatacagtgcgaggacacggaggcagcttcagtctacgagaacgcatgttgttgcctgattgattatagggagccggggcaggcagtgcggaaagccaatcagatccgtagccaatttccgcaaatgccattgttactggtgacggatgtaacatttccgttcagtgatcagcatatggtgcaaatcatcggagtaggtcgtttgcggctgctattttggcaagccaatgacaacgaagaaatgctttcggaaatacaaagcttgctctatcccgagtattcgaccaaaagccaacatattgcatttatcttgtctgtatataacgaagagcaacgttttgttcatgtcaaaacctttgctgaacgattgcaggtctttatccgcagccatattattgaaggttcgatttatctcattgatgatggcagctacgatggtacgaatgccttgattaaagcgctggaggcagccacggacttgtccgtaaaccggattaatcagaatcttagcccgctgcttcaaacaagggaattgggacgcaatacacgtaaggcaggcacgtatctggaagggatgcggaccattggtgcggattactacgtatttgtggacgcagatgactccttttttattgaggatattgccagaatgattaatgttgttcagcagggctattatgatgtcgtgatcggaaccaaggatatgaccgccgaaaatcgatctttattgcgatctgtcgtcagctttggtaagcgggtcatttcccgcccttttttacccacaggtgtggtggattcccaaactgggcttaaagtgatgagttcggttgcagtgaagcgaatgtttccgcatttaaaggaacagctcggactggcgttggatttggaaatgatgtttattgccaagcgactccagcttcgtgtgctgcaattacccgtcaaatgtattgaccgggatggctcgcacatccatgtctggaaggattctattcgttttttgcgctccatcattgatatttggcgactggatcggcgggtgagataacaacgtgtacaaccgagtacgatctttgatgtttcctctctttaatgtgctgcttaacggatttaattttttcttccacattgcagcgagctggtatcttaccggacaagcttatggccaggcgaatgcgctgctggcgctttttgcgcttttatccgttttgggtttatccatccagctattaactgccaaactggtctctaagggagaccaaaagcttgcgctacgaagcttaccgctcggttctctattactcaaagcacctctggtactaaccgtgcttgccgtgatcattctactcatctttcatccgttactgggttcgctattaggcgtcgaatccggcccgctgttcatgctgtatggcttgatcggactgcatattcttgtgagttcgtgccgcggagatttacagggcagggaacgcatgttggcgctcaatgtgaactattacattgaggtattagggaagctgagcctgttttttgttctggctgcactggggttaaagctggaagcgctactgttggcgagctgtgggggaatgttactgtcgctgctccacggctggatcgtttcggctcgtggcttgtccttattcacatacggtagagaacatatcccttctgggctatggaaatcattgagtcaggatttcaccgatagccttatgacgaatttattcattttgttttgtatctccatcgacatgttgtatgtacagcattactttcccgagcaggccagcagctatgccattgcgctgaagtacagccagttggtttattacgtttcgtatagcctcattgctgcatttattccaaagatcggtgcgcaggggcatgaccgccaagctttgggcaagttgattgccgtctatgccggattaatggctgtagctgcgatctgtgtatatgtgggcacgacctttgtgttcccatcctctattcccatattattcggagcctcttaccaatcggcagagacttatattccatggggaggatgggtgtactggctattttccatcgtgctgttttttgtacatgtgcacgtattggtgggcagacgcaaatttatgtttagtctgatggcaggagccgcggccttattagtagcctttcatatagcccacacagacccggtagattttttgctatctgagttcattgtttacggagctatggctctctactttgtgatagacgcctatgtacatttgttcaaaataaagataaagggggatttaccccatgaataccatacatgaacaggacggtaaaaccgtagttctattgctttcctggcgtgacattcgttcacctaaaagcgggggagcagaaattttcacccacgaaatgcttaaacgctcacagcaaggccgcttccaattcattcatttttcacctcaatttgaggggatgcctgagcatgaagttattgacggtattacgtatattcgaaaagggaacatatacagtgttatttattatgcgatgcgctattaccgtcgtcatcgaaggaagatcgactatgtgattaaccaggcgaatacgcatcaattctttacccgattttgggtggaggcatccaagcggatttttttcatacatcagctaacaagggagatatggtttgagaacgccaaattcccgctaaatgttattgggtttcatatggagcccttgatgcttaagctggctcgtaaggatcggacgcttacggtatctccgtctactcgatacgatctacttaagctgggctttcacccggatcgtgtccatcttttaccggaaggcattgagtttgatcattggccgcgcgaacaatttttaacgaaggagcctaatccgaccttcatgtatgctgggcgcttcgtcaaatataaaggcattgatctggttgttgaggcctttgggcagctcaaggaaaagttccctcaggctatgttatggattgccggaaaaaccgataaaacctatgtggcagaacaattgttgccgattatgaaacgatatggattaacatacggagaaccggatgaacaggggcaatcgcaagccgatattaccttttacggatttgtttcagcagagcataagctggagctgatgagtcgtgcccacgcgctggtgtttccttccttgcgtgaaggctggggattgacgattaccgaagccgcagccgttggaacgcccagcattgtcagcaattcaccggggctggtggatgcaacggatttcggaaaaagcgggtatctatgctttcacggcgacatccggggattatctgaacaaatggaaagagcagcgaagggcggcgaagattacatggccatccgtgagcgggcgtatcaatatgcgttaagattccattttgatcatacggctgctacgtttgagcagttgatggaagattgggtagaggaggcagaacagagtggacaaagtggtcatactcttctccacgtacaacaatgagcggacgatagagccttgtttgcgaagctgtatggggcaaaattacaaggatctgcatattgtaattgctgatgatggctccaatgaccggaccgtcgagacgattcgtatgctgtcggcagggagttcagtacccgtaacggtactggagcttccccatggggagcggggagtcgccagggtcagggcggttgaggaagcaaaacacttgggggccgaatacatatttgtattggattccgatatgattttagccgaacatctgattcagcagagcatcgacttttttgacgatcatcaggatattggcgccttggtcattccggaggaggcgtattcggaagcggacaattttttttccaaagtgaaagtttttgagcgaaatgtgattaataacgcgggtgagaccttgggaaaacgctccattgaagcggcacgcttctggcgaatgagcgcttatgaatcgacgggcgggtttaatgcggagcagattgcttttgaagaaatacagccaaccttgcgttatatagagtctggcggagttattcgccgggcggtatttacacgggtataccatgatgaaaaacaggtgtatctgcacgatgtattacgtaaaaaagcctactacttttcagtgatggatcgtacgatgtcatctgaagagggcggattgcgaaaggcgctggaacgttggtatttcttccgtccggtgctgtatacatgggggaatttgaaaaactatatctgtcaccccttgctgacgatggggatgttgtggatgtatgtatgcctgactgtgattggggtagccgccgtgttaaagggcggcacccgtcactcaggcgatctcgctaaggcggataaggcgtaacgatgaatgtccaagggtcagcgtatccagcgtgtacaggtcgggatcggaagattccgactcctcatacggtatatataatgaatgcgtggttaactgaataccttccccgtcaggatgacgtagtgagcagccgacaggatacagctcagcgagtgcaatgtgtacagcggttacgatatcttgttcattcagtagcacatagggtcggtacggagcgttcaaaatgctgtctatgaatgctgacaggtcggaagctacgttctgttctgcatgcaggctatttcggttgagtttggcctgatcaagcgcctcatacagtattttttttagcgtatcatcatccaactccagcggtttcgtcaaaaaacggaacacaccgacttgattaatcgccgataaaatggactgcgtatgcaggtgaccagacaaaatgattcgtacgatatgtggataatccttcttaatcatgcgaaggaaggtaatcccatccagaccaggcatgagcagatcggaaacgaccacatcaatcgggtgctgttccagcacttgtaaggcttctttgggcgtgtgagcggtatgtaagttaaatgcttcttgcgtcaaggtccgttcgagcagggacagaaccatagggctgtcgtcaacaaatagaatgttttggggtgtcataagaactgcgcaactccaatcaggaagtaagaaatgaggaactacatgtataatatcagcgttttggcatttttgaaagatgtcaatacagaacgggcgttgcgtcttttttgtgaacgatttgattcggctgaacatgccctctgggaaaaaggtatgcgtctccttcatcagtatcatgctgcacggcatacaggagtgaccctggctgtctccagcgcacttcagcatatggacgatcgccatgatatttacgttgttgatctgcgagaatacggtgaggaagagctggatcgcttatatatcgcaaaaacatgcgagttgatcctactgacggacggggcaacggaaaccgctgcgaggtttgctgccctccagcgtcgcactccccggttgctgtgcgcacggctaccgctggtcagctacgagctggaatgcctgatgcaggctattttgagccgtcttgaacaaaatggaggggacaggaaagcatgaaacaatgggctttgttgaaaccaggttggcaaaagctgatcctgtacctgatcgttctgggtgtgacagtgtttttggccgctgtgcttcaatggtttgtcgtgcgacaattcagtgttcacttggcggagattcagaacgaacagctccagtatgaggtacaggaactttctagcagcataaccgagcgttatgccgaatggcaggctgaactgaaggagctgtcgtccagtctgggcagagatatgctgaatcagggaacacgccagtatcctgagggttttaagcgtgaaagcggggccttttatgtgctggatgagcagtatcatgtgatggtcggacgagataatcgtgagatgaaaagtgtagtccagcagattaaatggctgcaaaatggttgtgcagtaagctcttttgtgacagaggatcatcagcctgcccagtatatagtatgcaggattcaaggggcgcagatgggtggttttatggtgcgcacggttgacgctgatatgctcagcgggattattaaaagtaaaccgattaaccagcatgagactttattttataacggtcaatttaaggtcgtagcttcccgaagtacttcggatattaaccgaacggacatcacgggcgtaacccgtaggctgctggaaggcaatacaggtatcatcgaagatggcggagagaaacacggaataggattcagccgcattggggaagaggccctttacatatcggttaaggatgtcagtgaggatacagctcagcgaatcagctcctttcgcaaacagttatggatggccatggttctgatattgttcattctgtgggccatgctcgtacagttccgcaaacagattgtaaaggatgccatcgtgaacaatcaggtgcgtgaccaacggcgagatgaagatatgcgacagcagcaggacacctattatttgccgttaatgcagacgattgagcagcagctacaagagttgcaagagcagactagccgtctcacaggcggtgatgatttgaagctactgggattttatcatgatctagcaaaccgctttgaagcggcttcgagtcagggaaaaggagcctctcatgaggaactggagtattttcgcgagttgaatgaaaatttcatccagggtcgtctcagacaggaatcctcactaggagagttactgacgggagttcgtagcttgcgcgatgagctggaagagaagatgtatgataatagtggaattagctttacagatatgaatgaagtattgtctgagtcgctgaaatgggcgaaccgttcattgaacatgaagaacattcaagtgatcttgcggcaagagcctgttccatccattgcagcacaagcacccatgctgtacaaaacgattcaggggctgctggaaaatgcagtgcaggccatgggacaaggtggggagcagcctgagaatcaggaaaagggccgaacaggtctgcggtccaagcggcaatctcaagtgcttaaggttagttcacggctggaagaaggagaaattattattaacattgaagacacgggcggcgggattgatgataaaatgcgttggagctatttccagccagactattcccaaaactcgcaggagcatgcgttcagcctgtatcatatggatgcatacctgaagaccataggcggtcgtttaaagttgcgtaataccgatcagggcttgcaggcaatcgttcgtttgagaagataggcccaagataaccgacacatatacgagaagttcaagagaggggggcaagcatgaaaaaacggatatttcgctaccgctacgatatggcggcaatgatgttgatgctgattgcgattgttgcatatcttgcacccatctatggaccagggcaaattgtgtttagcgacattgcttttggagccacctctcatcggtatctggaggaaataaccggagtatggaacgagcgatggtctacctcgaccttgttcaatgctccacgtatcctgtacatcttgcccttctatggactgtcactcttatttgacgaaagcggcccggtcttgctcaagtcgtttattacaggcttgttatttatttcggcattttcgatgtatgcctttgccaagcggctggttagcgtgtattattcaccaagctttacgaagacacgtatttttgctatcatggtcggctcgttgttttatgcgctgaatccgtgggttattttccgcattcagcatatttatttgctctgtggatatagtttgtttccgttaatgctgcgattcttctttagtgcggtggaccccaagtttcaaattcaacaaataaaaaactatcatccccacaagctttatcaacggaactggatcgacctgttcctgttggctgcggtattcaccgttagtgctgcggcaattcattattttttcttcggcatgatttacttgggattgttcaccttgttgctactgatcaaactaacctggacccaccgaaaggctggtcgcagctatttgcagccgttatacggcaattttttgcgtaaagggatcatttttggcgtcttttttggtctgctcagtttttattggttgtctctatatgtcggtagcatgttgatggacgctcaagcgtctcagcataatatcaacgtcgtggatacgttgtctctgttcagccgcaacagcagtttatataatgtaggttatttactgagctattggtggcccatgttttccttgtcctcactgcctagcatgttttatgtaggagggggatttttgttgctattgatcggatatgcgatggtgacacgttcacataaaaatccgattattctgatcttctcgctacttacgctgctgtttctagttgcagctaccgggacgacgttcccatccattgccaagtggtttgtcattttggttacgaaaacccctgtgattggttcggttttccgtgatcctaacaaatttattggactgattgcccttaatttcggggtgttgctgacctttggtgtcattcaatttatggaatggttcggatcatccccattgcagcgtgtatataaaaggctggcggttgttatcgttgtcttgtgcctgggggtgtattttgctcccttgcgtactcagttcattgaggggtactacaagccggtacaagtgccggaggcttatagtcaaatggctgaaaagctgactgacccggatcgtttcgatagcaaggcattatactttccgattgctgacaatatgattcagagctataacggagtagccacgcccaaatggaataaagggaagaccgcaaacgaaaaggcaaccggagattttcaggtatactcttctcctaaaaatacgatctttcatcatgaggggaatgatcccggcattacatactatatgaattttctgcagtatgttatggacaacggattaagctcccggttaggctggctgttctctacctttggggtcaaccagttggtctaccatgatgaatatgtgggccaggagaagcggcaggatttccacctgtctcagctggaaggtcagaccgggctgaaacgtacgtaccaaaacgggctattttccatattcaatctcgatcagacaccgccctatatgaacatccttgcgagtaaaattgtaacaccttacggttttagccgactggagagctacagtcatctgcctggttttgattttaaccgctttggagtgctgttcagtgcgttaaggcctgagctaaaaaccatccagacgattaacaaaggggattatgtggaagcggcgtcctttaatgacttgctgttgtcacagcttccagcaaaggattacttacggccttttgatgccattgaggatggtaatgcctttttaaaatggtccaaaacctttgcctcgaccaacgattggttatggtatttatcctcccaaaatatacggaactttccgttcgatatggaaatggatgcagggattgcggtcacctttgctagtaagaagctggatgtggccccgtatcagatgagcagcatcgaagggaagacggtcgtggactttgattccatgttgcggaccgaaaccttcttcaagccggataatccgcagttgttcagtgtgcaggctaatccccgtgaggaattgaatgatgtgcccactctgcacggcgaaattatgaagggagacccgagtaatatatggcaggtcgctagatcgggtttgctggaagccaaggaaaataatccgtatcagttccaaattactgtttccggccgcgggacgaacaaaatgcatgtaaaaatgagattttacgataagcaaatgcgtgagctgggggttagctatgttgtggcgccctcggagggatataattttgacagtgtgaaattttacggggaatacgtttcgccgcccggcagctactggatgcgaatggatttgttaaccttacagcgtccacagcaaaaaaattactggtggattcatgatatccagctgcgtgatttggggcaatacagcaagcctaacacgtttacgatgcacaaaaaactggatcaacctcaaacctcgcatgtgtatgctagagtgtttatgaatacggcaggtgggaaattacaagtcacactaccggacaaagtggttagtatcaagactcaggatgatggcttgaaccaattccaatgggtcgatctgggagtgcatgcctttcccaaaggagataccccggtcacggttagtaacctgcaaggctttaatgcggtcaatcaatttgcgattgtgcctgtggatcagctagatcagctatcttttccagtggagcaggcattgaagcggggcaagctctttttcaccttggaggcagagaacgattttaacgcccaaggcaatgtgcagacggaacgtgctttaccaagacttagtatggggcgggggatcagctatcagaaggggaggttaagcagggatgtggaagtcgccaaaacgggaacctatgccacagctattttggctaatctccccaccgggtaccaggggtcattaacgatgaagtggacgaatgaagagactggagaggtgttgaccagaacgattcatacgggggagtcgtataagcgattacctgctacctctttatccgaaaagcaggttattgaaacggtgcccaatcaggatggttttgccaagaaaatcatacagattcccggtctgctgaatgactatggccgagtcgaatttaaaaatctgttcctaaccaaggggaagtatcgcttaacccttgtcctggatagtcaggtgccgtcattgagccgttttggagatattcatcgaatgggcgggcaggaagtgacggtgatgcctggggaggatacgaaggaatcattgagcacgacggatgtcggatgtgtggcggatattcgacctgggcagacgaatctgtcaatcaaggacacaggactgtctatccgttacgcacctagctattcctgtgactggaatatttatgcgtccaagaaaatgaaggcagagccgctgcaagagtatgccgtgcagttggatgcgcgatcagaacaaattggaagtcggcatatgaaggtcatttttttgaataaagcgtcccaggttctccaaacctcctatattgatgaggtggaggagagagataaggaacaatggaatcattacgatcaaattgtgaaggctccggcaggaactgccttgatgcagtttcagattttggcgcacgcgcacaagaagcagtcaggcttatttcaaatgaagcaatattccatcatcccttatcaagcgatgattactgtggatcaatttacgttgtttgagggaacggatttggataccttttttatggctccccacacttcggaaagcattcaggctactcgtgaaaattccatggaacgcagttttacgctatataatccaacgcatgagcaggtgctgatccgggagaccgaatcacccaatccactgtgggagttcaggctgggtagcgaaaatcagcgagcccgtctgtccgtcaatggagtgactaccggattcattaccgatggtaacggaaacgggaaagtcgtcgttattctggcttccgcctaccgtttcggctgggtgctattcctcatagggatactgggtggagcagcttgttttcttccttatcggcgatggaagaagcgaaagcttccataaaaagcaagctgctcagtggggaaatgggtagccatgatacggctacatctcatatttgtagcctctgccccatacagtacggatgtgctgaggatttttagggtcacgttctatttttttgcggaggctggaaatatgtacgtcgatagtgcgatccagataagcgccatctccgcctttgatccgatccatcagctcactgcgggtaaagactttacctggataacaggacatctcttttataatagaaaattcgatttgagtaacttctatttcttggtcatcgactaacagacaatgacggtaatcattcacccaaatccttacctttttaatcttttgagttaccgtttgcgattcagtgagcatgttgcggccgcagcggcgcagcagggctttaatgcgagcatttaactctatcagactgaacggcttgcataagaagtcatctgctccgtcatccagagcctttattcttatattcagtacggtgttattagagatgaccagcatagggactgtggtaaattggcggatttggctgatcagcgcacattcgactttaccggaaaacatcagagcggtcacaataatatccggcttaaaacgcataagtgtaggaattgcaagtttagagtcataaataagctcggtatgatagccttcctcctgaagatgaagagcaatcatatctgccaaacttttttgatcttcaatgacgagtatttttatgggcatgactgacatctcctgtacagacaaagatacaatagcagtgcataatcatgtattttccacgataatacatacttatgtattcggcagaaatgcgaaaattgaacagtcctataatgtaagaaaaatattaatttacaggaagaaggttgcatctttgcgaatgattttattatctggaggttcgggtaaacgtctatggcccttatccaatgtgaaccgtcccaagcagtttctttccatactacgtcacgacgaacggcccgaaagtatgctgcaacgaatatggaggcaattagatgacgcgaatttggcagataaggcctatttttcgacgagtggaactcaggccgagctgatccgggggcaaattggcggaggtgctgtagtcattgaggagccgactcagcgggataccttcccggccatttccctggctacggcctacttgcatgatgttgcaggcgcatcacgcgacgagatcgtaggggtcatgcctgtggacgggtatgcgggggatgaattttttgaacatctgcgcaggcttccttcaatattagagcaatcaggaagccatatcgcattaatgggggctgctccaacggagccctctgataaatacggatatattgtgccttcagcctcttcttcacttgaccagccatattatagagttagttcatttgtagaaaagccggatatgatccgttcagaagcgttgatccgcgaaggggccttatggaattgcggggtgtttgcttttagactgggctttttgttggatattctggagcaaatgggtttaccagccgactacaattctctttcgacaaattatgcagacttgcctaaaactagcttcgatattgcagtagtagagcatactcataagctctccgtgcttccataccatggagagtggagagacttgggcacatgggattcgttggtgcgggaagtaagttcgaagctaagtggcccaggatatatttcagaagcttcacatgactcgcatatcatcaatgaactggagattccggttagcatctggaatgtcccggacattattgtcgttgctggtccagatggcgtgctggttacggaccgacagtcgtcaacaggaattaaggatatggtggcggaaattgaaatcggcccgcgttttgaagagcgcttctggggaaagcaaactgtattatcccatcagcaggcggcaagtggattgcagacagtgaccaaacgcgtggtcatatcgaacggaagatttatcagctatcatgagcaccagtaccgtaaagaagtatggaccatagtttctggaaccggaagtgtctctatcaatggcgtgacacagatagtcagcccaggtgagattattgtcgtagaacccggtacaaagcattttataggggcagtagagggagatttagaattcattgagtcacaaatcggacatatcgtatccgaaacagatattatccgatatgaatttcctgattcgattgacgaccatactctataagtgcctaccattatagggactgatagatacgaacgaggtttatcagaaggcagtgaagagtaggaggaactattttttattagagcttagatgacctgtgcattcctaagaaaaggtattcatgtattatagacatgaatacctttttttgcataaatagttctttttgtttgtaatgaaatgaatagaaaagagacttataaaataattttcttggaagtcagccactcttttacggcgtccgtactgaggtctcttttaggtgtccattctattttatcaaccagtttgccatttctgaattctgcaatggtgggggtgtatttaacgttgtaatcctctttgaatttattccattgggacttgtccttatggattttgtgaacgttcaaaaaagtaattttagagcctagattatactgctcaatcatcttgttaaagttaggctcaaaccggttgcagtcgccacaactgggtctgccgacatagacaagtacacttcgatcctgttgaattaaactcttaaaattttcaaatgtaaccgcattcaagtggtcatatatttccgggtaattgcttttgctcgcttggatttctttgtctttttgttgaacaacctgctctatgtcttgaaatttagctacagctgaaatagcgataccaatgataagtaatacaatgacacttaacccagcgatatatccttttttcacagaaatcctcctttttttacaatcttacacttacagtaagtgatatttccatttctagctgtaacacttgtctcattatgtataaaaaaagaagctttccattgttgggaaagcttctttagtctgatagttaaaacgttagaccacaacagtcaacaagtaatcctcacgcttcacttcagtttccattgtgttcaacacatccaggtattgagcggaatttgttacgataattggtgtagctgtaatatagcctgccgccttaatttgctcgatatcaaattcaagcaacagttgtccttgcttaaccacatcgccttccttgacgcgcttgtcaaagaattgtcctttcagcttcactgtattcacacccacgtgaatcagaatttctgctccgtcattggaagtaataccgattgcatgtccggtcgggaatactgttgtaatcgttccattgacaggagatgtcagcacaccctctgtaggatcaatgaggattcctttccccatagcacctgaagcaaaagcaacatcagaagattgttccaaaggcaatactttaccttgcagtgggcttacgagaatttctttctcgattgccacttctttctttacgggtgcagcttctgtttttgcagtttcttcttttggatcttcaaagcccaaaatcataaccaacacaactgcgagtacaaaggcaacgagcaaaccgatgactacccacaagaatccagctccaaaataagttggcaacgccagtaaactaggcagggagaaggattttgcagtcgctccgccagaagcgataatagcgcccccaataccaccggaaatacaagcataaatgaaaggctttttcaatttcaaagttacaccataaatcgttggttcagtaatcccgaatacagctgccagtgtagaggaaccagccaaagccttcatctgggtgttccgggatttcaggaatacccccagtgttgcaccggcttgagaaagtacagctgctgtaagcatcggaagcatcgtgtcataccccaatgttgcaatattggacagcatgataggaacaaagccccagtgtacgccgaaaataacaaatacttgccagaatgctccggcaacagctccggcgatcaatgggcttaaattgtatacccatgtaaaaccgttcgccaagccctgactgatcaggttaccgactggaccaaaggccaaaaacgtcaacggaacaacgaccagtagtgatagcataggtacgataatgtttttaactgattgatggataaaggaattgaaccagcgctccacataggactgtacccataccgcgagaataattgggattacgctggaactgtatttaattaaaatgattggaatcccgagaaaagccagttttgccggattgtccaccgccgcgataacatccgggtagacaagggctccagcaactgcgacagatacaaaggcatttgtcttaaatttacgggacgatgtaatagctagaaatagaggcaagaaataaaatacactgtctgaagcggcgttcagaatcagatacgtaccgcttgtattatcaatccaatggagcgacaaaattaatgccagaatccctttgagcaaacccgcccctgcaagagcacccaaaagaggagaaaaaatgctggaaatgatatcgaccgcttttccaaggaaattcgttttttcagaagattcttcttttttcgcattaggattgtcagcatcctgtaaatttgtttctgccatcatatgctcaaacacttgacctacattgttgccgatgaccacttgaaactggccgctgctttccactacggtaatgacaccaggagttgcttccagtgcggctttgtctgcttttgtacgatcatttaatttaaatctcaagcgtgtagcgcaatggaataccgaattgacattctcttcgccaccaacgagggtcactatttttttagatagttctttatcactcatgttcagaactccttatgggttattcttgctactgataggatttactgtttacagctgttgctaagatacgccggcgtgcatcttttttttaacttgtaaacaagaaaaacctaaactcgtggtgaaaactacgcactctctcctatagaggaacgtcgatttcaccatcagtttaggttttgcctgccttaccagtcacaatccatgaacgatgaaggtatgaagttgttagtcttatatgttattacgttcagttacgcgatgaatatggatagttagatatacgtattcatccttgcttaaatattgatcgtatgttttttccagatactcattgatcttttgagcacaagcaaaagcttcggtatacgtctgcttcacctggttgtacaaaaattcttcaccactgtgaataacttctttgcgaatcactcgcatcgcaaaatattgcaaatgtgtcaaaaatctcgaatagctaaaagaagactcatccagcacaattccataatgatacgtaataatgttcaatatatgttgaacaatctcggtcattttcagtgtggatttcatttcgttaccgtcgatccgtgcattcaccacatgcaatgcaataaatcccgcttcatcttcgcccaattttactccgagcgtattttcaattttttggagagcatccagcccaactgcaaattcttttttgtaaaagcgtttaatttcatacagcatcgcgttttggagtgccagtcctttttcttgccgttgtatggcaaaatgaatatggtcggtcaacgttaaataaatattatcgcttaactccgtatccaatacttccgttgcatgctttacaatttcattcacgacctccagatgagatacaggaatatcgttcagcaactcggttagtttggccgtgaactcgttttcatttaacatgaaaatcttatctattttatcatcatcgacttgatcgccagccacctttttgaaggaaatacctcttcccatcacgatgacctctttgcctttatcgtttttagtcaataggacgttgttattgagcaccttctcaataatcattgaagttccccctcccatcctttaccaataaaaaatgcctaagcacaattcaatactattgttagcaatagcactcaattgaactcaggcattgcccgcatcaccggtcacaatccttcgatatagtgctattgtagcacaaaaaaaagcgatttcaacatattttattctctttcgacaaaaaatatttcatatcaaggcccttttgcctaatttgcaagtacatcgttaccttatgtagtcgtacgttcaatgaggctgtactctagcgaatgaagcttcatttggcgtccaatcagctgaggggaaagcatgaaaaaggcattttgtgcttgagccatgataggattttgaatcgttgtaatccccagcgtatgcgccagctccgtgttatcgaatccaacaattgccagatcttccggtacattcagtttttgtctgcgtgcttcgcagagaatgcccactgctacataatcgttagcacataaaatagcctctggaaattcgtccggatgctgtaacagatcccgtacgacctgttcgccatcacggatattataaatagaagagtgattccagtgttgcaacactggcagattgtgctcactcatgatctgttcgtaggctcgttgtctactatgggtattaatactgctcggacggccaaaagcattggctatacgagtatagcctttttgtatcaaatgtttgagcgctaacatatatccttcatactgatccatagcgacggagcgaatatcggtatgctccattcgttgccacgacacgatcgggccatatttgcaataggtgctcaaaaaatcagtgtcattcacgcaggaaatgatgaccagcgcatcgactctttttctttttaagtcctcaaaagcttgaagctctttctttttgtcttctcccgaagtataaataatggtttgaaattcatattggcccgctacttccacaaagctgtccagaaaagcgagaacaatttcattaatagttgaagtaatgataccgatctgaagcgtctgacccttggatagagaaatggcattccgattaggaacataatctaattcctgcatgattttcaaaatcttagctcttgtttcgtgactaacatggggggactgatttaatactctggataccgtagctttggaaaagcccgccagttttgcaatttgatcaagattcgacatggtgcttctcctcacataagaaaaaatacttgacatgaaacgcgttacaacgattaggatgcttatgaaggcattacgtctattttaaggtatctgtcaatgcatttcaaaggagaacggttatcgttaggttgcattgttcgctgaaatgggctttaaagtattattgtcacattatgagacaccgctaggtctgactcagaagtataatggctggctgggtcgtgaagtcatagcattacgtaaattatgccgaaacagtgtttacacgctataaggataaagtaaaatactggatgacctttaatgaaatcaatgtaatgaccatgagcccgttcaccggtggcggtgtggttattgacctctgtgtatgacacgtatcgcattgattacttgcgtcagcatattgcccaatgaaggaagcgattgccgacggtgttgatctgattggttacaccagctggggtcctatcgaccttgtgagcatgtctacatccgaaatgtccaagcgctacggatttatttacgttgatctggatgatgacggtaacggaacgctcaaacgctccaaaaaggactcatttaactggtataaaaatgtgatagcaaccaatggtgaagaattgtaattccatatcatctcgggcggatatagcagaagacatcctaaggatgaaatttgctatatccgcttttttgatagacataataatatttcagagggcttcacaaacttttcacttgtaataagctgaaagttttctgtataatgaataaaaatttcatatgtctggttgatgtttgcgggagatggaacgaaagttccgaccgaaggggcaaaactctcaggtgcttaggctgattacagcaacaagcggggaccgtaaacggacagaactctggagagacccttaattgggcgccgaaggtgcaccgcagataacatctgcttaaactctcaggcaaaaggacagagacgcgaataacctgtgacagggaataccctaggcttttttatgagctattagaggtagtaacctgcacaagatggttgtattttttcgtgcctttaacctctccaggagtcgaatcagctgatttgactcttttttgttttctaatatgctggaggagcgggttgaaatgaatttggtacatgtattggaaacgattgacagctggatatggggagcgccgcttcttattctcgtaatgggcactgggttgtggctaacgatccgtttgaagctgctccaggttattcgattgcctttggcgctcaagctaattggtaaagcgccggacgaaggtagcggagatgtaagcagcttcggagcattgagtacggcactggcagctactgtaggtacaggaagtatcgtcggcgtggcaacagcaatcaaactgggtgggcccggttcattattctggatgctggttgcagcttttttcgggatggcaaccaaatatgcggaaggattattatctgttaaataccgtgttaaagaccggaacggacaattttcgggtggtccgatgtattatattgaaaacggacttggccgccgtttcaagccgctggcgatgttgtttgccttttctggtgttcttgtagccctatttggaatcggtacttttccgcaagtaaaggctatcgtttcttcgacggaaagtagctttggagtgccaacggtagttacagcgatcattatttccgtgttaactgctgttgttacgattggaggactcaaaagtattgccaaggtatccacaaagattgttccattcatgtcggggctctatatcgtagtttgcttaattgtactcattaagtttgcaggagagcttcctcatgcgattgctttagtattacaaggggccttctcgaccacatctgcaacgggtggatttgccggagcgacgattatgttggcgatgcgaagcggagttgccagaggtatttttgctaatgaagccggtttgggaagtgcgccaattgcagcagctgctgctaagacgaaatggcctgcagaacaagggctgatatccatgacaggcgtatttattgatacgatgattatttgtaatttgacgggatttacgttgctggttacgggaatatggagtggaaatgacgatggaggtctgatgacccagcatgcgttttccagtgcctttccggctggtgcagagctcgtgacgattagccttattttatttgcattcacaacgatactgggctggaattactacggagaacgttgtgttgaatatttactgggtgtcaaatggattaaaccataccgttatctgttcatcgcacttgtagcaggaggtgcgttcatcaagttggaagccatttggctactggcagatatctttaacgcaatgatggctttcccgaatctgatcgcactgcttggcttatcgggaatcgtagttgcagaaacccgaacctatatggattctttgtatcctaataagaaaaagggcattcttgcaggtgccaatgtaggggctgctatccaagtagaagaaaaaggacaaacggttaattcataaattcaaaaagggagtgccctcagccatcataggcttgaggacactccctttttgattttaaagtgatgtgcgtaaagtagccataatatatgcctgattcaacttttaccaaagcctccatattccatttcaccggctgcaatgtttacgattttttctgattgctcatcattaatattgtaatcgaccagggtggaaggggcaccgagacttgtccagaatgcactcgtatgcgtcaccgcgctgccccatacgtatttttcgttcgtttctcagttggtgataacagaatccgggttcatttctgaaccggtgggggcgagtgtgtggatgttgctgaatggcagagcctgggtcggcatgtgctttttgttgataacattcgacacatcgccgtcatctttagcccctgctgcagttcttcaatttgatggtctccaaaataaattgggtggggttataatatgtgaatttgttcatctggaaagttcccctcagttcatagttcatggtccaatcgtaacttgcttaacctgattgtctgtcgaatagctgacttcatcatgtaagctatttgaaatgacgattaactattaaacatgaaatgaataagggtattcaggtaaatctaatctttgaccgctccggcggcaagatcggaaataaactggcggctaatgaaaagaaacaaaataataagtggaagtacagccagcagggtgcccgcaatgaccatcgcataatccgtattgtaaattccgttcaattgtgacagtgcaatctggagcgtgaatttacgctcatccgttaagacgattagcggccataaataatcattccaagctcctataaaggtaaacgcgccgagaaaagcgaacgcaggacgtagaataggcagtgctacattcaagtacagtcgaaaaaagctgcatccgtccatccggcccgcatccagcagctcctttgggatggattcttccgcatattgacgaatccagaaaatgccgaaggcatttaccatccccgggatgataagcgctttgaacgtacctacccatccaaaggaggccatcatgacaaaggaggggacaagcgaaagttgtgaagggaccatcatcgtagctagcagaaggataaatagcacttttttgcccggaaaatcaaacttggcgaatgcaaaacctgcgagtgaatcgaaaaacagaaccaatagggtaacagaactggctacaaaaagggtattaaaaaaggctccggcaaaattaatctgctgtaatactctcgttatgttatccaagaagtggctgccaaaccacaattgcggtggaaaacggtagatgtctgaagtggtacgagttgccatgacgatcagccagtaaaatggaaacatcgacaggatgattcccaccaacaatccggcatataaaacaaaggattttgcgcgtgtctgcatcatgttgtgaagctccttcccatcgttattttttaccttgaacgagtttccagtttatgatggagaatagagcaatgatgaggaacatgccccatccaacggctgctccatatccaaaatagttgttaatgaacgactcgcggtacaggtataaaacgatggtcatgccacttgccccggaaccgccgtcattaccgaccaggacctgtggctcggtgaagagctgcataccgccgatggtggacgtaatgaccgtaaacagaatgactgggcgcagcatggggatagtgatgcggaaaaaagcttgcgctccggttgccccgtctattttggcggcctcatatagcacatgcggaatactctggagtccagccagatagatgattgcgttatagcccatccatctccatacgaccatagaagaaatggcaatttggataccccatggcacattcaaccattgaaccatgggtagtcccaagagttgcagaatgtagttgagaaatccaaaattgttggcaaataaggcaccaaatatgatggcaacagccacaatagacgtcacattgggcaggaagaatccaactcgccataaggtgcgcattttcacaaaaggggcataaagcagaaaggcaataatcagtgcgaagaatagcatcggaatcgttgcatacacccagatcacaaaggtgttgcctacagcctgccaaaattcattgtctgtcacaaggtagcgaaagttgccccagccgttgtaggtcatgtccccgatcccgtcccatttgtgaaacgctagatataatgaaaagccaatcggaaacagtccaaagatgccaaacagcagataaaacggcgagatcgcagcataaacggcacggtgcttccagatttctctcagcatattgtccacacgccttttttgaattttgtttttttaccgctgtaattcccgttcgattcgatccatggtttccgtccataatatttcgggattggcatcctgcttggcgacattagcaaggcgacgggtcacaatgccgtggatgacaggatagcgctcgccgaaatagctgcttttcacatgacgtgcggaggtagcaaagatgagtccggtggcctgaccaccaaagaaaggctcgggtgtctccatgataggatcgttatagacgccgggagtggacgggaacagtccgattttgtggtaggcttccagctggtgttccgggttttgcagccaagtcaggacttcaaaggcttctttgggatgtttgctggatttgaggatagaaatgaatgaacctcccagattgccgtctccaccaggagcacgggcaactctccatttgcccgctgtatccggcgcggcctctgtgagaacttgcttcatccagattgcccctacaaaagaggcgatttttccgttattgaccgaagcgttccattcgggagtccagccatccgcattggcgagcagatgcttcttgtggaaatcgacagcggttttccagcccagacggatatcaggagattgattgccgatatagctgccatccggcttgaagtaaaggtttgtgtgctgagcgagtatctgattgtaaacgtttacaatattatcagccaaaaatgaactgtttccgaatttctgctgaagttgttctccggctgccatgtaatcatcccatgtgcggatggaggcactaaccttttcaggatcactaggcaagcctgcttgttcaaacagatcacttcggtagaagagggcggtaggcccggtatccatgggaaatgcaatcattttaccatcaggagtgatcccttgattccatttccattccaaatattgatccttcaagcggtctgctccaagttcccttaagtcataaaaacgatccgcactggggaacagctccaccatccaatcgttcagagctacgatgtctggttcaccggaacgagctgcgagcgttgtcttcagtttggctttgaagtcaccgcctattttttgagtttttaattcaatgttgggaaattgtttttccgcctgagcgagtagttcatcgtcaatggaacggttccagtaccacaatgtaagcgttatcttttttctgtttgacaaattagtttcagatgattgactttcagaggacgagggttcactacaagcactgaacatcgtgagaaaagcaagacataataccagccattgtactgtcttcacatcatttccctccttgctgtctgagataatctacctgcctaacaagttgtaaatggtttagctccatcatatgaagctgttacccatttatgtgcattgccttaaccaaaaacaaaaaatttgaaacgtttattactaaaaaaaagcacgcgcgtctgttatatgaagaacgcacgtgtttaagttagggattcagcctatgacatcagccgctgtatttcatctttcagaatttcggaccgagttccgaaaataacctgtagagtaccgttaccaagcctagtgattcccgacgctccgagctgcttgagagcttgatcgttaaccgctttgtcgtctttgacgacaagacgcagccgcgtgatgcaggcatcaatgctttggatattgtctgaaccgccgagataggttagtattctgcctgcctgactggactgagtgttggatgtggtgcttgcctttccatcggatatagtttcgttaacgtcagacaggagactgtcttctacatcatcttcacgcccaggagtttttaggttgaatttgagaatgataaatcggaacagaaagtaatagatgagggcgaagacaagcccgaccgggatcattcgcaatgggtgggtggagagtttcatattgaccagatagtcaatgagtcctgctgaaaaagaaaagccaagtttgacatccagtaggtatacgaccaagccacttagccctgtcagcagagcatgaacgccgtaaagtaatggtgcaatgaacataaacgaaaattcgaggggctcggtaattccggtcaggaatgatgccagcgcggaaccgatgaagatggaagcgacggctttacgtttttccggtttggcggtatggatgaatgcgagggctgctgctggcagcgcgaacatcataatggggaagaagccggacatgaatatacccgccgatgtatcgcctgcgaaaaaacgcgtcaggtcaccatgaacgacctcaccggtagcattggtgtagtcaccaatttgaaaccatgcgatcgagttcaacacatgatgcaaaccgagcgggatcagcagccgattagcaatcatgaataccattgatccgattccgccaaacccaacaatccagttgccgaaggctgcaatcccatcttgtaccggactccagatcatgccgagcagaatggccagaatcatggtcgtaaaggcggtgatcatggggacaaagcgtttgcctgagaagaagccaagccaatctggaagttgaatattatgatattttttaaacagaagagcagaccatccaccgataaaaataccccccaatacgcccatgtccagcttgacgtcgtctggaatatatgcaaatacacccggcactgccgccaaaatacgggtcagcaccatataggcaatgactgccgataatgcggctactgcgtcgcctgccagaccaatggcaacaccaatggagaaaatgagcgcaaggttaccgaagatggcccccgccccctcgttcagaaaaggagtgatataatgattcagaaatccgccaactccgggaccaagtggtatatccgtttcataattaatcagagctaatccttgcaagatccctgcagcgggtagagtggctactggaagcattaacgacttgccgattttttgcagaaatttcagcataacattcttcccttcttcatcgagtttgggagtatcgtattcatcctgaaatcctcacattaaaccattttttcacatcataaatcggggaatctaacatggtcaacgattattttaagctatggaaagacgtaaatccgcagttgacatcgcttacatgcttatatagtatcaaatttaagttaataatcgtgacggagacaagagagccacgcagacatcccatggtacagcacagggttggtttgtgatggcttttctttttttgtgcgatgaaagcgatcaaaatcggatgatctattgaggaggtaggttgtatgtcgccatacgcagccgaattcatagggacaatgattcttattgccctaggtggcggagtgtgcgcaggggtgtccctgaaaaagtcatttgcccacgcttccggctggattgtggtcggaatgggttgggggctcgcggtagctattgcggtgtatgcagtgggtcaaatcagcggagcgcatttgaatccggcagttacactggcgttggcatttcagggtagttttccatggcaagatgttcccggctatattgtggctcagcttcttggggccatggcgggtgcagtgatcgttattttgcattattggccccactggaaagagacggaggacacagcaaccaaactcagtgtattcgcgacaggaccagctattgatcatccgtttggcaacgtgcttagtgaaatgataggtactttcatctttgttcttgctttactgtcgtttggcgccaattcatttacagatggtctgaaaccgctgattgttggttttttagttgtcagtatcggtttatcccttggaggcacaacgggctatgccatcaatccagcgagggattttgggccgcgtctgatgcattatttactaccgattcccggtaagggggcgtccaactggaaatatgcatgggtgcccgttataggaccgctattggggggatctttcgcagggccattttatcaggccgtttttaaggggagtgtgactccggctttctggattttgctaggggtcatcgtggttgtactcttgattaccttccgtatgagtcgaacttataaaaatcataaaatggatcacaaacttacagcgtaaaaacgatggatttacacggggagagatgaacaatgggaaaatatattttgtcactagatcagggaacgacaagctcaagagcgattttgttcaatagcgaaggagatgtagtatactcggctcagcgagaatttccgcagtattttcctcatcccggctgggtagagcagaatgcgaatgaaatctggagctctattctcggggtcattgcctcctgtctttccgaatccggtgtaaaagcaaatcaagtggctgccatcggcattaccaatcagcgagaatcggtggctgtatgggacaaaaatacaggagtgcccgtgtataacgtactcgtatggcaatcacgccaaacttcggacatctgtgaagaattgaagcggcaagggcacgaggagctttttcacagcaaaacaggcctgttgatcgacccgtatttttcgggcactaaagtaaagtggatactggatcatgtggagggcgcgcgggaaaaggcggaacgaggtgacctgttattcggtacgatagactcgtggctgatctggaaactatccggcggaacggcacatgtaacggactactccaatgcagccaggacgctgatgtacaacatttatgaactaaagtgggacgaagagctgctggacattctgggtgttccgaaaatcatgctacctgaggtaagaccttcttccgaggtatatgcgcacactgtggattatcatttctttggtcagaatgtaccgatcgccggtgcagcaggtgaccagcaggcagccttgtttggtcaggcatgttacgaaaaagggatgatcaaaaacacttacggcacaggctgcttcatgctgatgaatacgggggatcaaccagtggaatccaagcacggcctgattacgaccatcgcttggggactggaggaaggcaaagtgcaatatgcacttgaggggagtgtgtttgtagcgggccggcgatccagtggctgcgagacgggctgcgtatgttccgtgaggcgaaggacagtgaaccttatgccgcccgtgtttcgtctacggaaggagtgtatcttgtacccgcttttgtcggactgggcagcccctactgggatagcgaggtgcgcggagcgatgttcggtttgacacgcgggaccacgaaggagcattttatccgcgccacattggagtcactcgcttatcagaccaaggatgtgcttacagccatggagattgattcaggtattgcagtgaaattgctgcgggtggatggaggagctgtgttgaacaattttctgatgcaattccagagcgatattctggatgcaacagtggagcggccagttatccatgagacgacggcactgggagctgcatgtctggcaggtttggctattggatattggaagagtacggatgaacttcgcaagcgggtgagggtggaaacctcttttgccccgaatatggatgaagcaacacgtgaaagcttgtatgaaggctggaaaaaggctgtgaatgcgacgatggcctacaagtaatagattaagcgatgggtctctggatattaaactgcaaaaagatgacttctgaatttatcaggagtcatcttttttaaggcatatgctaactcttgaccttcgtatggtcccaatgttgccgggctccgcaggagctacgaatgactagttccggctctactttaatacatttcgtatccatttgtttattcatcaggtcaaacagcaccatagcggctagacggcctattttttgcttgtcttgttttacagtcgtcagtggaggttcggtataacgacaggcttctatatcatcacatcccactacagcaatatcctcgggtaccctcaagccgctttccttgaaagcacgtatggcaccaaaagcaagcaggtcggtcgccgcaaaaatagcttttggtaaatttccttgctgtatccacgccttcgcgacctggtatccatcttctgccgcgtagtccttaccatacacgacccattcaggtctaacgtcaagactaaaccgctttagtgaggcgataaaggcttcctctctctctttaataaccaaagaggggcgttcaatgcctataaaacccatttcgcggtatccattcatgtaaaagtgctcaacaaccttcattgaaatcttctgattgtcggacatgatatagcaggaactagctccggttagctcaatatcgacaccgatgcaggggatagggctggcatcgagatcaaaaacactcttctccacctcatctccagcaataataatgcacccgtccactgaaaaatatttcgagcgagccaaatagtcctctccattatccagaaatttctcatttgagaaaaatagcagatcgtaaccgagcaagccaatctgttttttgaagacattaatgatatctacaaaaaaaggatgactaaaatcaacattcagcttgccggcaaatataacgcctaccagattagattttttggtagcaagcgttttagccgaggaggagggtctatagcctgtttcctccatgattttaagtacccgctgtcgggtttcctcactgatgtctgtgtaattgttaatgattttcgaaaccgttgccactgaaacgcctgccatgctagctattgtttttatattcatggaatcctccgtaactaaactgatttagttaaattgacttttcttttcaaacttaatgtttactcgtattctatgctacctcatagaagtgagtcaacagtgtgaataaaggatgttgcctaatatttcaaggagtaataacggtgatttatgttttatttgataatttacaactctctatttacaaatacaggctatccgatacataatagtagctgtaattaactaaatcgctttcgtaaaagtaaatgcatttattctaagagtacagggggaattttgcaatgctgaaaaagtgcttttcctgatatccatgtaactcccgaattcgctgattccgcaatttgctctcattaatagcctgggactttacaatacccagcttggttttgttttactgaaaacaacaggtaccggcatcgcttttctgatgtttgtggggtatatcaagtctgtctcccgagagctggatgaagcggctgccatggacgggtgcggatattcacgatatttgtttacaattcttgtcctgctgatgaagccggtgttggcaacaggcatcattttgacagcgattggagcgtggaacgacattataggtcctactatttatttgtctgatcctgcttatcagccagtgaccaagggattgttctccttctacggacaatacatgaacaactggccgctgctcgcttgcggcattctgattgttacactaccgctcgttattttgtatattttcctccagcgctttattgtcggcggtgaatggccggagctgtgaagtcttgattcctgaaaggatgataccgagtatgagtgagaatacctatacattccccaccacgtttatgtggggaacttcgacctcttcttatcaaattgaaggtggcgtggatgaggaaggaagaacgccttctatttgggatactttctgtcgagcacctggaaaggtgataggaggggactgcggagatgtggcttgtgaccattttcaccgctttaaggaagacgtgcaattaatgaagcaacttggctttttacattaccgtttttccgtggcctggccgcgcattattcccgcacccggcgtggttaacgaacaggggttgctcttctatgagcgtctgctggatgagattgagtcggccgggctaattcctatgctgacgctgtatcattgggatctaccgcagtggattgaggacgaaggcggttggacgcagcgagagattatccaacattttaaaacgtatgcttctgtaatcatggatcgatttggacagcgtataagctggtggaatacgataaatgagccctactgcgcctctattttgggctatggcacaggagagcatgcccccggccatgagaactggagtgaagcctttactgccgcccatcatattctgatgtgtcacgggatagctatgaacttacacaaggaaaagggactgacgggcaacatcggtattacgctgaacatggagcatgtcgatgcagcctctgaacaccccgaagatgtagccgctgctgtccggcgggatggttttattaatcgatggtttgccgaaccattgtttaacgggaaataccctgaggatatggtggaatggtacggggcgcacttgaacggattggattttgtacagcctggtgatatggagctgattcagcagccaggtttttttttgggcatcaactactacgcccgtagtatcattcgagcgactacagacgcttcgttgcttcaggtcgagcaggtttccatagaggaaccggtaacggatatgggatgggagattcaccctgaatccttttataagctgctaacgcggattgagaaggatttttccaagggattacccatcctgattacggaaaacggagcagcgatgaaggacgagctggtgaatggaaagattgaggacattggacgtcagtattacattgaggaacatttaaaggcatgccatcgctttattggggagggaggtcagcttaagggctattttgtctggtcattcctcgataactttgaatgggcctggggatacagcaaacgttttggtattatacacatcaattacgacacgcaggaacggacacccaaacaaagtgcgctgtggttcaagcaagtgatggctaataacgggttttaaatagaaaaggcgtcgaagacttggtttcacagcagcctgtgacgacgaataaagtgccttgtgggtttagcggctacacagcacgactggcagcagatactgccgtcaatcactgtacgatcatcgggcatgtgaatgatattcactctatcaatgaacggattacggaaatcgcaaccatgccttatatcgagcggaagccggaggaagccaaagcgttgatcgaagagttgacggatgaaatggcaacgcggacatccattccgttatttgacgaatactgccgtcagaactatctggataacctgttacgtggtggttatccattgctgctggacaacggcactgagcaaccgtttgtatatcatgtattttcacgcaagcatggggatctggaaccgttgctgggataggtggaggtggcagatcattcgtctttgcgtgcttttttccaattgtcgttcaccccgggtgagctaaacatatcattcatgacaacatcgcgctaaagcaaacggttgagacgtttgtaaccgaagctctcaagcattccgaacaatgctatgaggctgattttggtgaaggtttctggatcgaccattggacatataacatggatctaatcgaaagttatctaagtatctatccagacaaacaagaggaactcttgctcgcgacccgagagtacatgtattacgacagtccggcatggatacagccacgtcgaaacaaatacgtgcagatgaaggacggacgtatccgtcagtacggggcgatcgtagagagcaaggagaaagaagctcagctgcacgcccgggatcgcgatgttcattgggttcgaaccaaacatggaagcggagagatttataagtcaaatttatatgaaaagctgctgtcattagtagccatcaagctgtccacgctggacccagagggcttgggaattgagatggagccgggcaagccgggatggaatgattccatgaacggacttccggggctgtttgcttctggattcagtgaactgtgtgaattacagcgacttgtaagatttttaatacatgcacaggtgaagctttcgggtaattctgtgctacggctgccgcgagaagttgctaagttgatccaacagctgaggctcgcaatggaggaatactaccacgattctgatgaggctgattgcagggatgaaagcaaggattacagcttctggtcacggatttcggatgctagagaagcgtatcgcgaaacggttcgttttggattgaaggggcagaaacaccattagcgtttgaagatgtactggtgtttttgggccaagctgaacgtaaactccaacaggggatggataaggctctgcttatcggtgaggggatatatccaactttcttttattatgaagccagagaattcgaggtacaggaggatgactgcgggggcaagctcgtaaacatacattccttcgaacgtaaggatacaccatattttctagagggaccgactcgggctatgaaagtggttggcgacattataaatgggcaggagctatatcggcaaatcaggcagagcgggctttacgacaggaagctgggtatgtataaggtgaatgaaagtctggcggggcagccgtttggctatgatcatagggaactatccttgaggctgaagcccaagttgccaggtgacttattttaatacggatcgtaaggatacttatgcaacggaatgcagagtgacccaatatgtactgcattacgtcagtggcgaaaagaagacgatatgccaggctgtattagatcaaaaagaagcgcaagatgtgagagtcggttgatttctcgtatcgaggtatatttgggggcatagctccattaattaaagccgtcatgctgccataacagagcataacggctttttaagatttcataaatccttgtgtcagggcagggggacctatgctgaaatatcttgtaaatccaatatcacagggcagtggtcactgcctgtaatatgacaatcaatgctcgcatccatcaatagcggacgaagtctctccgaaacgaggaagtaatcaatccgccagccgatattcctttctctcacctttggcatgtaggaccaccaggaataaacatccgtccggtcaggataaaaggatctgaaggtatctataaatccggcgtctagcagctgtgacatgcgttcccgttcctcaggcgtgaatccggcatttccgtagttagctttggcatttttgaggtcaatctcctgatgagctacgttcaaatctccacaaatgatgacaggcttcaaagcatccagttgttgcaggtagctgcgaaaacggtcttcccattccagtctatagggcagtcgggataagtcccgtttggtattcggtgtgtacacattgacgagataaaatttttcgaattccagagttatggttcggccctctggttcttcgttttcctcaagtccataatgcacagagagcggcttgattttggtgaaaatagccgtgccggaatatccttttttctcagcgtaattccagtattgtgtgtattcctccatgttctccatgaggatttgaccttcttgaagcttcgtttcctgtacgcaaaaaatatcggcatttgtttcttttagataagtataaaaccctttggtcacacaggctcttaagccgtttacattccaagatattaatttcatttgattaatctccttgctaattcacgcggtcaagcgatgtgatttgtatatcctttgttgacataagcttataaatgtcttctatctggacttcataggtttttcattaaaatggtcctgaaatggtgcaacatgaatagatgatagcaatttctgcccttttttgaaagagtagagacttgaaaccagcgcctaaagtagtgatgggcagactaatctttctacattatttataatgaaaaaagctcccttgcggaagctatttttgatgtaatttatcaagagagatactctccctatggtcggctgcgaagtataggctaacgataccgatgacccgacgttcccccgtggtttatctcagagaacaaaaaaagcctccattatggaggcttcttgttatgacgtcccaggagggattcgaacccccgaccgacggcttagaaggccgttgctctatccagctgagctactgggacataaaattcaagcgaatattaatatatcatatggataaaagaaattcaagtcttattttgcatatatcgcttatttaggctttatacagcataaattctgagtagacgtagttttttttgccttataaaagggtatgttagaatacaggtgaatatgtgtaagacgagtggttggacttcggctactgtttctcatataatctacaaatacttgagcttgcgaaggagagggggtgccttgaataaaggactccaaggtgacgacaaaagaaaataatattgtattgtttccgaagacactggactattatcaaattcaacttactgtgatgcttgaaaacgaacgttacggagaggcgatggcgatgctgcgttttttaatgcagtgtcagggacaggagcagaagcaatacgatgaatggaacgctttattacaatggctggaggctgcatttccacagtacgctgacagcggggcggtaacggacgctgtggaagaagaagtcagtgaagtagagttagctcgccgtcatgcacgctttaagcaggagcaggatgcaggctacggaaacaagctgttgcggatggctatggatgaacccttatccgaacagacgattttagcgttggagcagttgtcctatctggaactgccagaaatcgacgatgccttgcttcgctggattacggaacgggaaatccatcctttacttcaattccgtgttctacagacaatgcgacgacgcggaatggaagggacgatagaaatcagacggggtgatgaacaagcggaaatcgacattgaaacggttccgttacagccaggtgattttccagagtcgattatgcgtattttggaacgggtggccgatcagactgaggtgcacgagcctacactattctatttcgcacaggagctgtggtcacagtttgtgatggcagtatacggtacgaaagattatagatcaatgttggtggaagaggacgggatgccggatatttgggctgcagcactccatcagacggtttcggaaagtttgaacggaaataataatgaggaggaaacccgtgctatatatggcattacagatgcgcttcgcttccgttttgagcaggcgtatcggtcgatgcgactattcgtagcggcgggaatgaacactccttaatgaccggaaacgtttacctgtgaagcattcaaagggctgctcttgaaaaagacagtaatgttagatatactatagtggttattttgtgtgcgttgattgtaatgaaaactaagtgaagattttgttggaggggaaagcataaaatgaaagcaacttgggagaaaatagagaagaaccttggggttcttgaagttgaggttgacgcggatcgtgtagccgctgcactcgacaaagcttttaataaagtggcaaaacaagtaagtgtaccaggattccgtaaaggtaaagtaccacgtcctatctttgaaaaacgctatggtattgaaagtctgtaccaggatgcaattgacatcctgttgccagaagcttacagccaagctgtagagaaaacagacatcttcccggttgacagccctgacgttgaaattgaccaatttgctaaaggcgaatctttcaaattcaaagcaaaggttactgttaaacctgaagtgactttgggcgattacaaaggcgtagaagtgcctgtaagcaaactcgaagtaagcgacgaagaactggctcaagaattggagcgcctgcaacaacgtcatgctgaattggttgtcgttgatgaagatgctgctcaatccggtgatacagctattattgacttcgacggttccgtggatggtgtaccattcgaaggcggacaagctgagaagtattctttggaactgggctctaacacatttatccctggttttgaagagcaagtggttggtttgcacactggcgattccaaggacgttgaagtaacgttccctgagaactaccattctgctgaccttgctggcaaacaagcggtattcaaagtgaaagttcacgaactgaaacgcaaagttcttcctgaactggacgatgaatttgctaaagatgtaagcgaatttgacacactggctgaattcaaggaagacttgaaaaagcaattgttggatcgtaaggaaaacgaagctaaagcagcccgcgagggtgctgtagtggagaaagttgctgagaatgcaacaatcgacattcctgaagcaatggtgaagagcgaagtgcaaaacatggttcgcgattttgacaaccgtttgcgtagccaaggtatgaaccttgaaatgttcctcggattctctggtcaaagcaaggaagacctggaagagcaaatgaaagctgatgctgagaagcgcgtacgtaacaaccttgtgctggaacaagtggctaaagcagaaaacatcgaagtttccgaagcggaaattgatgaagaactgaaaaacatggctgaagcttacaaacgttcagttgaggaaatccgtagcattctggaaggtaacggctcgttcgctaacctcaaagaagaaatttcactgcgcaaaacgattgctttgttggtggaaaacagcaaagaagtagaagcgccagttgaagctgctgaataattcagacgataaaatatacggagtatgctgtaacaagctgcaacgtagcaattagatagggataaggcacgtagtgaaagttacgtgccttatttttacctttggtaacccaaattttagtcgtttatggaaagtgctgtgagtcgtgttttttgttttacataagtcactaccgtatatttgcacatacatacgaaacatggttaaatatgagaaggtctcggcagagtgtactgtaaacagcccgcactgcatatatgagcgcatgcaaatatgacacgagactctgaacatgttaaaatattttgtaaggtgttcacgtttcatgcttgctgcttccgttttaatgggacataaggaagcggatgaatacaggtgttcattttaataaagaaaagaggttggtcgtgatgagtctcgtccctatggttgtggaacaaacgaatcgaggagaacgatcttacgatatttactcgcggttgcttaaggatcgtattattttcctaagtggcccgattgatgacgatgtcgccaatctcgtcattgcacagttattgttcctttctgcggaagatccagagaaggatattaatttgtacattaactcgccaggcggttctgtaactgcgggcatgggtatatatgatacaatgcaattcattaagccggacgtatcgacgatctgtgtaggcatggctgcaagtatgggttcgttgctgctcacagcgggtgcgccaggcaagagatacgcgcttaccaacagtgaagtcatgatccatcagccgctcggtggcattcaagggcaagcctccgatatgctgattcatgcggactggattatcaaaacacgtgctaagctgaatcaaatctatgtagagcgtacgggtcagcccctcgaaaaaatcgaacgtgatactgaccgggatttcttcatggaagcggaagaggcaaaagcatacggtatcattgaccaggtgctgtctaaaccgattaatctgtaaaggggtggctctatgtttaaatttaatgatgaaaaaggacaattgaaatgttctttctgcggtaaatctcaggatcaggttcgcaagcttgttgctggaccgggcgtatatatatgtgatgaatgcattgagttgtgcacggagattgtagaagaggaattggggcatgaagaggaagtagatctgaaagacattccgaaaccaatgcaaatccgtgacattctggaccaatatgtcattggtcaggatcaagcgaaaaaatcgttgtctgtagcggtatataatcactacaaacgtattaatactcaaaacaaaattgatgatgtggaactgcaaaaaagtaacattttgatgcttggacctactggttcgggtaaaacgttgcttgcgcaaaccatggctaaaattttgaacgttccttttgctatcgcagatgccacttcccttacggaagcaggttatgtgggtgaagacgttgaaaatattttgttgaaactgattcaagctgccgattatgatgtggaaaaagccgaacgcggcattatctacattgacgaaattgataaagtagcccgcaaatccgaaaacccgtccattacgcgtgacgtatcgggtgaaggtgtacagcaggcgttgcttaagattttggaaggcacagttgcttctgtacctccgcaaggcggtcgcaagcatccacatcaagagttcattcaaattgacaccacgaatatcctgttcatttgcggtggtgcctttgatggtctggagcaaatgatcaaacgccgtatcggtaaaaaggttatcggcttcaacgctactagcgaacaaaaagatctgaaaccaggcgaatatacttcaatggtattgcctgaggatcttttgaaattcggcctgattccggaatttgtaggacgcttgccagtaatttctacgctcgagccgcttgatgagaacacattggttcgtattctgtccgaaccgaaaaatgcgttaaccaagcaataccagaagctgcttgagctggataatgtgcaactggagtttaagcaagatgctctggaagccattgctcgtgaagcgatcaagcgtaacacgggtgcccgtggccttcgtgcgatcatcgaaggtattatgctggacgtaatgtatgaggttccttcccgtgaggatgtgactacttgcgtcatcaatgagcaggttgtaaaagacaaaattgcaccggaactcggtggtacagataaggataaaaaacaagaagagagcgcctaaggattgatacttcgcgatctctaaaacatgagaagccggatctccacttcactaaacctgtatgaggttttaaggggtggaggtttggcgttaatgggagagaaaagtacatgttcttaagacaagacacacgtcccgttaaagtcgggaatctgacgattggcggcagcaatgaagtcatcatccaaagtatgtgtacaaccaaaacagcagatgtggaagcgactgtagccgagattcttcgcttggaagaagctggatgtcaactggtgcgggttaccgtcaacaatgaggaagctgccgcagccattaaggaaataaaaaaacggattcatattccgttggttgcagatattcactttaatcacaagctggctctactggccattgaaaacggaattgataaggttcgcattaatccaggtaacattggacgacgtgaaaaagtggaagctgtcgtgaaggcatgtaaggaaaaagggattccgattcggattggtgtgaacgccggatcattggaacagcatttactggataagtatggctaccctacgccagaagcgatggtagaaagcgcactgtatcatatcgggatactggaagaacttgatttccatgacattattgtgtcactgaaagcgtctgacgttcctatggcgattgcagcttatacgaaggccgctgaaattattaagtacccgctccatctgggtattaccgaagcgggtacgctctttactggtacggtcaaaagcgcggcaggtatgggcgctttgctggcctcaggcatcggctctacaatgcgtatttcgctcagtgccgatccggtggaagaagtgaaggtagcacgtgagttgctcaagacttttggattgatcacaaacgcagctacactaatttcttgtccgacttgtggacgtctggatatagatctgttctctattgccaacgaggtggaggactacattgcaaaactcaaggtaccgattaaagtatcagtactgggttgtgcagtaaatggcccgggtgaagcgaaggaagctgatattggaattgctggggcacgcggtgaaggccttttgttccgttatggaaaaatgattcgtaaagtacctgaggctgatatggtcgacgaattgaaaaaagaaattgatatcatcgtcaaggcttatgaggaaacagggaaaatccctggacgtgaagaacgtcataccgccgagaaggtgtaggcaaaccagttatataaagaggcatagtcataatctattgtcatcatttaaacgccgtggagagcagctctgctacagaactgttcttcacggcgtttttgtatttctctctgatcttttgaaagaccgccgtttagctatcgcggaaaaggaaatactgtttttcatagagcggcatttttcaaattgctgagatgagaaacggaggaaatacgatggacttgactatgattttgttattggtgcaaatgtttttcgggattgtaattggtctgtatttctggaacctcctgcggagccagaaaacgaaccgtagtgcggtggatcgggaatcccgcaaggaattggataagctgcgcaaattgcgatctatttcacttactaagccgttggctgaacgcacacgtcctgccacattacaggatatcgtgggtcagaaggacggactgcgagcactcaaggcagcgttatgtagtgcgaatccgcagcatgtcattatttatggcccgccgggtgtagggaagacggctgctgcacgcgtggtgctggaagaggctaagaagaatctgtcctccccgttcaagggagatgccaaattcacggagattgatgctacgacggcccgctttgacgagcgcggtattgcggacccgctgataggttcagtgcatgatccaatctatcaaggggcaggagcgatgggggtggcgggaatcccgcagcctaagcccggagctgtgacgaaggcgcatggggggatgctgttcattgatgagattggtgagctgcatccaacgcagatgaataaactgttgaaagtactggaggatcgcaaggtatttttggagagtgcgtattacaactcggaagattcgaacactcctgcttatatccacgatattttccaaaacggtttgccagccgattttcgtttggtaggtgcgacgacccgttcgccgcatgaactgccacctgcgattcgctcccggtgcatggagatttatttccgtgccttgcagccacaggagattgctcgtattgcagaggatgctgtccacaagctaggctttggcccttgccctgaggcggtagaagttgtacagcgttacgcaacgaacggtcgggaagcggtcaatatgatccagctggctgctggtttggcacttaccgagaaaagggagcgtctcaatgcttccgacgtggaatgggtagcgggcagcagtcaaattcaaccacgtcctgaccgaaaaataccgggcttgccgcaaatcggattcgttaacggattagctgtatatggcccgaacatggggatgctgctggaaattgaagttacagcagttccggttcctgagggaaagggaatttataatattacgggggtcgtggatgaggaagaaattggaggtgggtcccgcacgctgcgccgtaagagcatggctaaaggttctgtggaaaatgttttaaccgttttgcgtacgctcggattatctccatcgaattacgatttgcatatcaatttccctgggggtacgccagtagatggcccatccgcaggaattgcgatggcaacagccattgcttccgcgatgcggggaattccggtggatcatgaaattgctatgactggcgaagttagcatccatggtcgtgtcaaaccgattggtggtgtattagccaaggttgaagccgcttttcaggctggagccaaaaaggtgatcattccgcaggacaactggcaagctctttttgacggtattgagggtttaaaagtcattcctgtacagtcagttaccgaagtgttccgacatgtgtttggggaagagatgacgtcagatttgcctgtgcatgcgccaattgagacttttcgcccatcccaatcttccttgttacaggctgatggaacgcatagcgggacgatatcagatacaggatcttgctgatgaaccaccctttcattggttttttcataaaacatttgataaaatatgaaagataacaacgtgaggattgtaaaatccggaacctgagaatcactggaggtgcgaaagcgatgggacccaccaagacaaaaggtcgtcgttttcctttgctgcctttaagaggacttctggtctacccgagcatggttctgcatctcgatgtgggccgggaaaaatcggtcaaggctttggaaaaagcgatggttgaagacaatttgattctcctgtgttctcaatcagaagtaaatattgaagaacccacacaagaggacatctttcgagtcggcacggtagccaaggtacgccagatgctcaagcttcctaatggaactattcgagtattggtggaagggctggaacgcgccgagattattcaatatacggacaatgaagaatattacgaggtaatggcgaaggagctgcacgaggcagaaaacgtacagcctgagacggatgcgcttatgcgcactgtattaactcagttcgagcattatatcaacttgtccaaaaaggtaacaccagagactctcgctgcggtatccgatattgaggagccgggacgacttgcagacgtgatcacaagtcatcttacgctcaaaattaaggaaaagcaggatatactggagacgatcgacgttactcagcgtctggagaagcttctggatattttgaacaatgagcgtgaagtactggagctggaacgtaaaatcaaccagcgtgtgaagaagcaaatggagaagacgcagaaggagtattatctgcgtgaacaaatgaaggcgattcaaaaggaacttggcgagaaggaaggccgcgcaggagaagttgaagaactgcgcaaccagctaagtgaactggagctacctgttccggtgaaggagaaggttgaaaaggaaatcgatcgtctggaaaaaatgccggcaagctctgccgagggtggcgtcatccgtaattatgttgattggttgttaagcttgccgtggaacaagtttaccgatgatgatctggatatcgtcaaagctgaagaggtactcaataacgaccactacggactcgataaacccaaggaacgtgtattggagtatttggctgtgcgtaagctggtgaagaccattaagggaccgattctgtgtctcgtaggcccgccaggggtcggcaagacctcgttggcccgttcgattgcaaaatccatgggtcgggaatttgttcgcatttctctcggaggtgtgcgggatgaagcggaaatccgtggtcaccgccggacttatgttggcgcgatgccgggacggatcattcaagggatgaagaccgcaggaacgtctaatccggtatttttgctggatgagattgataaaatggcttccgattttcggggggatccatcggcagcattgctcgaagtgcttgatcctgaacaaaacaatacgttcagtgaccattttgtcgagctgccgtttgatctgtccaatgtgatgtttgtaacgacagccaatgctgcacacaacatcccgcgtccgctaatggaccgtatggagacactctatattccaggctacaccgaactggagaagctggaaatcgccaaccggtacctattgcccaagcagaagagagagcatggcttgaacgaggaacagttggtcatcggggaggatacgctcctgcgtgtcattcgtgaatatacccgtgaatccggtgtgcggaatctagaacagcaaatggcttctctgtgccgcaaggcagcgaagtccgttgtatctggtggcgaagggccgattcaaatcacaccggataatctgaaggattatttgggtatcgctaaattccgttacggtgttgcagaactggaggatcagatcggtacggttacaggcttggcatggacagaggtcggtggtgaaacactgatgattgaagtgacggtcgtacctggtaatggtaaactgattcttacgggtaaactgggagacgttatgaaggaatctgcccaggcggcattcagctacactcgttccaaagcagttgatctgggcattgaactggacttttatgagaaaaatgatatccacattcatattcctgagggtgcgattccgaaggatggcccatctgcgggaattactattgctaccgcattaatttcagctttgaccaaccgtcatgtatccaaggatgtagctatgacgggcgaaattactttgcgcggccgagtattgccgattggtggtttgaaagagaagtcgctggctgcccatcgggcaggctacaaaaaaattctgcttcccaaagataatgaacgggatttgaaggatattcccgacagtatccggcaggatgttgaatttgtccccgttgcccatatggatcaggtgctaaagcatgctttggttgagcaggcaagggtacattagagaggaataagaacacaatgaaagtaacaaaagcagaatttataataagtgcggttggccccgatcagtttcctgtggacgctttgccagagattgctctggcggggcgctccaatgtaggaaaatcttcactgattaatcggttgattaaccgtaaaaatttggcgcgtaccagttctacgccaggtaaaacccagcaactcaattattaccggattaatgatgacctctattttgtcgattttcccggttatggttatgccaaggtatccaaaacgtcccgcaaggcttgggggcagatgattgagtcttatttgctggagcgtgagccacttaagctggtgcttcaaatggtagatttgcgtcatccgccgtccaaggacgatatcatgatgcacgattggctgcgccatcacgggcttccagtctgcgttgtaggcactaaggcagataaaatccctaaaacgcggcgagaaaagcattataaggtaatcaagcaggaactcggaatacttcccgggggattgtttatccccttttcatccgaagaaggtatgggcaaggaagagctgtggtctgtcatctccagctatatagagaatgacgacgaagagcagacggaattgtaaggttagggacgtccttgagggcgtccctttttcatgattcgggcttcaaaaaatattaaactcactaaaatggtgggaataatatataataactaaaggaactgatggaatttaagcagaaaagtgagtatatgagggataatgcagtctcaaccccatcattttctgtttatttccgatgtatggcggaaatttatgatttgatgtgcaagaaaagcgttgtaggtctgatgtataataaagcataaagcttaaacttataggttcaggaaagaattgaggagattggtatggctcagcggttagccacagagtatgttaaaaccactttgaccttgtcggaaactcaaatggacgaatttttgcgggcagtggatgatccccaggtgcattactatattaaagttctagataacggaagacaggaaatcgttctggagcataatgcgggtgaggaagttcatttgttttttgaagcccaagagggagcgtttgtgtgtgaattgacttgccgcttaattcatccgcaactaaccctgtttatacgcaaactttttgttcgttttaagggcgaaggcatcgtttaccgaatgtatcaaggattcactatggtgtatttttataatgaaggtacggttcgtaaaattatggagaagaatgccgtaggctccaggctggtatttgaatataaaaatacggttcaggaactgcaacagctttttcagcatcagaacgtcgaaaatgaaatatcagacgtatatcatctcattaattcgttgcttgaccagcggaatttggcgcgtactttctcggagctggagcagattgaccacaagcttcgaatgagttgctcgaaattatttgcactggaagcttaataaggcatgaatacatggagtgaatcgttatgcagtgtagtccctttctttaccgaaaggggcttttttattccaaaaaaatgattgcatttgctgcacatagatgttatttttaatctcgttgaaaatgaatataggaaccaggattcactcaggacattgaatgttgcgagaggttattccctcgggaagtgaatgacgtaggtcctagcggatgaaattttttcaaacattttattcctaggaagggggaaccgaaagatggaattggagtactcaactttcggaagacacgttgccgtagatacttggggtgttgagtttgaattactgaatgatgcgcagtttttggaggctcaattagttgaagcagctgaagcttgcggagcaacggtgatgtccgttcaatccaagcaattcgaaccacagggagctaccgtgcttgtactgttgtcggagagtcatctctctattcatacgtatcctgagagaggatttgccgctattgattgttatacttgcggtgagactgtcgatccgcagctggctattgattacctggtatccgttctaaaaccgaaaaaaacatatgcgaagaagctgattcgcggcttgggagaacttcaggtggaatcaccggagtgcaagttggctgagttggtgtaaatcgttcttttatggagccctttgtgcgtcctatattataaccatggaacatttccatggttatttgttttaaaagtggtttacactaaatcaaatcatacagaacgtgctagatgttcatgaacgccatccaattttcataaacaattcataaaacagccgaaggagattcggacttctgtgatataattaacatagtttatgataacagtggttattcttattacagtttaggcaggtgaatttgcaatgcacatcgtcgttgttgggttgaattatcgtacggcgcctgtggaagtcagagagcgttttacatttgcagaagaagatttgccaaaagcgctggaacaactcaaacttaccaaaagtgtgttggagggcgtagttgtcgcaacctgcaatcggactgaaatatatgttgtggtggaccgccttcacatgtgcggttattttatacgcagttttatggagcaatggtttggcattccgcgtgatcaatttacacaacatttatatatatatgaggacgagcaggcgattcggcatttgttccgtgtgacttgtggccttgattctatggtaatcggagaaacacaaattttgggacaggtaaagaatgcttttcttcaggctcaatcccagaaaattacggcaacgtggtttaatatgttgtttaagcaggccgtcacattgggcaagcgtgcccattcggagacgtctattggagaaagtgccgtatctgtcagctatgcagcagttgagctgggcaaacgcattttcgggatgtttacccataaaaaggtactgattctcggtgctggtaaaatgagcgagcttactgttaagcatttgtacagcggtggagcagctgaggttattgtagcaaaccgaaccctgtcccgtgcggaagaccttgcctccaagttccatggaacgccggttacgatggaggaaggcatgaatcggttggcggatgtggatattgtcattagttcgacaggtgcccagggttatattctggatcggactcgggttgaagcaagtatgaaacgtcgacagtcccgtcctttgtttatgattgatattgcggttccgcgtgatctcgacccggctattggtgaattacagaatgttttcctgtacgatattgatgatctggaagggatcgtggagagtaatttggaaatgcgccgtaccgaagctacaaaaatcgagcatatgatcgaagatgagcttagcgagttttatcaatggttgaaaacgatgggagtgcgtccggtgattcgtgcattacaggaaaaagcggagtctgtacatcaggatacgttggaaagcttgttcaataagcttcctgagctggatgaacggcaacgcaaagtgattagccgcttgacgaaaagtatgctgaatcagatgatgcatgatccgatcaatcgggtaaaagaactggctgttcaaaagcaggggaatgaggccctagacatgtttagccatatttttgctttggaggatcgtttggatgacgccgctcagaaagtagataaaagcgatgcatctgcgttaatgaaaccggaagccggtgttcatgaaaaaaccgttcaggctcaggctttgccagcgtcgtttgcgccggccagcctgtaaaggtgggtgaacagaagtggcttcaggcatgcttatatatgattcaatgatttatgtttttgccctgagccttctgtttgtattctcggatgggattcgtcgcaatgcgaatgctaaacggacaggtacagggcttcttgttgtcgttctggtgctccagcttgcttatatggggataagaacctggaatgaagggcatctccctattttcgtgacctacgattttctatttctgttctcagttattttggtactgatttctttgattctgacacgttatcagcgatccgaatttgcggtattgttgcttgatattattagttttgcagtgctagtgctcaacaatatatggatggagcctctcgacaacccgcttggaaattggcataccgtgcatggtctgctcctgattcatattgcgctggctaatcttggttttgtagcaatgacggtagcagctgtattttcggggttatatctgtttttgcatcgtaaattgaaagtaaagaaatggaatgacacgatcagacgcctgccgagtctggaaatgatggaccggtatacgcatatggcgctgttgattggtactcctttgttgggggtctctattgtagttgccgttatttctattattgccgaggaacgctggcgtctcttgctagataccaaggtgctgatgacagcgattgccttgtgcgtgtatattatatttttagtgagcaaaagattgaatcagcgttcagggcttgtaatggcaaagtgggcattggtgggctacacgctattgattcttaattttttgctgaattcctggtctgtatttcatcagtggacgggagagtgaaaagccttttgcagcattttgtcccgatttcgttgaattgtaagaataagatctgttgtgttgtaggtggcggtaggattgcggaacgaaaggtaaaggggatgatggaaagtggggcattcattaccgtcattagcccgaatataacgccggatttacaggttctggcggatcacaagcagctccactgggtaaatcgcgtatatcgcgagggtgacctccagggagcctttcttgtatatgcggcgacgaaccagagagaagtgaattatgagattgcgcatgaggccagacaaaggggtatactggtaaatgtggcggatcgatcggaagagggagactttataacgccgggtaccattcgacgaggaagactgacgattagtatttccacagaaggggctggccctgctgtaaccactgatattacatcagctttgaatacgttgtttggtagcgaatacgagccatatctggatttcatgcacgatatgcgacagatcatcaaacgtaagataagttccccacagcaaaggaccaaactactgaggcgcctggcgagtagcgggattttggatcaaatacggcgtcatgaatttatggcttggaccgaaaaagaaatagacctatggattgcgcaaaatcaggaggaataacatgcgaacaattgtggtaggcagcagacagagtgcgttggcgttaactcagaccgggcatgtcattgaagatttgaacgcgctgtgcgcgaagcatggaatggatttgcaatttgtcgtgaagaaaatcctgaccaagggtgatcgaatattggatgtaaccttgtccaaagtgggtggcaaagggctttttgtcaaagaaattgaacaggccatgctggctggtgagattgatatggcagtacatagtatgaaggatatgccttccgaattgccggaagggcttgtcaacggcgctgtgccgcgccgtgaggacccacgtgattgcctgatcacattgggcgccaagagcctggaggatttgcctcaaggggcaaaggtgggcacgagcagcctgcgcagagccagtcaaatcaagtccatgcgacctgatctacaattggagcctgtgcgtggtaatattgattcccgtctaaaaaagctggagacggaaggttttgacgctatcattttggcggcagcaggcttgcatcggatgggctggaaagagcgaattacgtcctatataccggaagaagactgtttgccggcggttgggcagggagcgctaggtattgaatgtcgtgcgagcgatgaagagctattggccttgctgcgcctttacaacgatcgggatacctcagctaccgttgcggcagaacgaacctttctaggcgtgttaaatggggggtgccaagtgccgatcggggctcatgcggtctgggctgatcaagaaatcagcctcacgggcatggtaggctcgccagatggcgaggttattttgaaggaaacgctcctgggaaatgatccgctaaagctgggagaagcggtggcggccagtttgatagccaaaggagcggaacagattcttgcgcaggtgaggggatgatagcatggcaggaaaagtatatttggtaggtgcaggacccggagacgcaagattaattacggtcaagggttgggaatgcattcaattgggcgatgtcattgtgtacgacagactggcaagcccgcgcctcttgggattgatgaagccaggtgcccaaaaaatctatgtcggcaagttgccagatcgtcacaccatgaagcaagaggaaattaatcagctgctggtggatttggccttggaaggaaaaacagttgttcgtcttaaagggggagaccccactatatttggacgagtcggcgaggaagccgggctactgcgtaaacatggtatttcctatgaaattatacccggcatcacatcagcaatcagtgtgcccgcctatgcgggcattccagtcacacaccgggatatggcctcatcgctgtctatcattacaggtcatgaaagtcccgataaactcgacaaaagtattcattgggataaagtgacgaacgcaacgggcacactgatctttatgatgggtgtagccaagatcggctatatcagtgaacagctgataaaacacggcaagccgtcaaatactcctgttgccttgatccgttgggggacccgcgccgagcaggatacgctggtgggtacgctggcggatattgaagctaaggtgaaggccgcgaattttcaacctcccgccgtcatcgttgtcggagaagtggtcaatcaacgtgaacagttaaaatgggctgaggacatgcctttgtttggcaagcggattttggttactcgcgcgcgtgcgcaggccagcagtctggttcgccggattgaggagcttggtggcgagccatatgaatttccagttattcagacggtagccccctcggacgagccaaccaaacaggagattaaagaggcatttgcgcgactacctgaatatgattgggtgtttttcactagcgttaatggagttgaatactttttcacgcacttaaaggaacagggcaaggacgtacgcatgctgttcaaagctcgtattgccgcagtcggaccagctacagcagctgcgcttcggacacacggaattgtggcagaacagatcgaaggcccttttcaggcagaaggtttgctcgaagggtttgagcaggatttgcaggcagggcagaatgtatttctacctagaggtgatctagctcggccttggctgccagaaaagctgagggagatggggcttcatgtgaccgaggctgatttgtatcaaactgtgctggcagccaacacacaggatgacgagctcctcaagctgcttgaggaacgagccattcacgcgattacgtttacgagttcctcaaccgtcaccttttttctggaagcgctcaggcaaatggggatccatgatccgttgacgctgctggagggagttacgattgctgtaataggtcctttgaccggtgagacagctacccaagccggtttgactgtgagttttatgtcagagaaggcaaccattgaaagtctgatccaatcgttatgtgactggaaacgatcaagtactcttatgacattataattttttgtttttgctaatgaatgtataaaaaatggaggtttgtattcatgagtgttccttttactagacatcgtcgtttgcgccagtcggctgcaatccgcagcatggtgcgtgagacggtattgaatcccgctgattttatccaaccgatctacgtaacatttggcactggggtgaaacaggaaattagctctatgccaggtgtataccgtttttctctggatcggctggaggaagaactgaaagagattagtgagcttggcattcccgccgtgctcctgtttggcataccggaaacaaaagacagtgtagggacttcggcttttgtggacgatggtattgttcaggaagctactcgtttgatcaagtcgcgttatcccgaactgctggttgtggctgacacttgtttgtgtgagtttacggaccatggacactgcggtatggtacacatgcatgagcacgatggtgagatatgcggtgaagtattgaatgatgaatctctagaggtgctggtacgtacagccgtttctcaggccagagctggtgcggatattatcgcgccatctaatatgatggacggttttgtacaggcgattcggcaggggctggatctggaaggcttttcacatattccgattatgtcgtattccgtcaaatatgcgtctgctttttatggtcctttccgggaagccgcagactctgcgccgcagtttggtgaccgcaaatcctatcagatggaccctgccaatgcacgtgaagcattgcgagaagcggagtctgatgtgctggagggtgcggatatgctgatggtgaagccttctctttcttacctggacgtgatgcgcacgattaaggatcaatttgatctgcctatggtggcttacaacgttagtggtgaatatgccatggtcaaggcagccgctctccaaggctggattgatgaaaaagcaatggtgctggagattttgacaagcatgaagcgtgcgggtgcagatatgattattacctattcggccaaggatgcggcaagatggttgaagcaataagtctattttcagaagataggagtggtcagattgatcgacgaacaacggaaagtgcgcaaggatacgaactccaaagtagcctttgatgaggcaaaacaatacattccgggtggcgttaacagcccggtacgggcttttaaatctgttgggattacacctgtatatattgaccatggcgaaggatcgcgtgtatatgatattgatggtcaatcctatttagactatgtatgttcatggggaccgcttattatgggccatgcacatcccgaagtggttaaagctttacaggctgctgttgtaaaaggaaccagcttcggcgcaccaacgttggcagaaaccgaaatggccaagctcgtatgtgagcgtgttccttctatggacattgtacgtatggttaactccggaactgaggcgactatgagtgcgattcgactcgcacgcggatttacgagccgtagtaaaattcttaaatttgagggatcatatcacggtcatgcggacagcttgctgattaaagcaggctctggggttgcgacattaggtttgcccgatagtccgggtgtacctgaagtcgtagccacccataccatcaccgttccttataatgatttggcttcggtgaagctagcttttgagaaatttggcgaagagattgccgcaattattgtcgagccagtagcaggcaatatgggagttgtaccgccacagcctggatttttggaaggtttgcgtgaggtaacccagcagtacggaagtctgctgatttttgatgaagtgatgactggattccgggttggacttcattcggctcaaggtcgctttggtgtgacgccggatcttacctgtctgggtaaagtgattggtggtggactccctgtaggtgcttacggcggacgtcgcgatattatggagcagattgctccatcggggccaatttatcaagcgggtacgcttagcggaaatccgctggctatggcagcaggttattcgacacttaaattgctgacgccagaagtatacgatcgcctggaagagcgggcagcaagacttcaagccggattcgaacgtaatgcgagcgagctgggtatccctgtcacgatcaatcgcgtgggttccatggtttgtccattttttacagaagaaaaggttgtcaattttgacacagctaaaacgagtaatcaggaccacttccgccgttactttactgaaatggtgaatgagggagtcagtgtggcaccatctcaatttgagggtatgtttgtgtcgggcgtgcatacggtagaggatattgatgccaccattgaggcgaactatcgcgcgctcaaacgtctatgagctggcaaggtggctggaaaagaagaggaccgtggctggaagtcacgccaggacgggaaatcacagacggggaaaaaaacaatgctgatgctgtagatcagtggttgctgaatcgtttggaattaccggaaaagctgtggcgcagactgcgtcatgcaaaagagattgaacttacaggggaccggctgcggctggccctttttcctgtaatgaaccttggaatcacccctcgttggtatgatttgaaggtactgtatgaagatgatttttgcctggtagtgcataaaccggcaggtatggcagtacatccggatggcgctgtgcaggatggtccgctgacgttggatcatgctgtcgcatcctactatgagatgaatggcattcatgcggcggtacggcatgtacatcgtctggatgtggatacgacgggcccagtgctatatgccaaaaatgaatttgcgttgctcaagctggacgagcaaatgcgagctaaggatataggccgcaggtatgtggctttggtacgagggaaagtacccccatcgctgcgaacgttggattggccgattggcaaggacaggcatcataagcagcgccgtcgtgtatctccaactgggcaaaaggcggttacccatattgaactcggagaagtatggggaagcggtccaagtgcagtgagtctcgtatatctgacgctggagacaggccggacgcaccagattcgcgtacatcttagtcatgctggctacccattgcttggggatgtattatacggggggcgggctactgattttggcaggcaggcgctgcacggagagcgtcttactttctgtcatccgctgagtggcgaaacgattaccgtggaggatgcttggccggatgattttcaaaagctacacaaacagctataaaagatggcatgccttctattttggcgcatatacttgaacctagaaacggtttgcaatatggagtttccgtgcgcctgaccagaagtcagaggatgtgcggagactgcccaaaggaggatgccatccttgaacaaacaacagaatgatcagccgcaaggcttgcgttttgatatttatgaacgcattcatttgacggaggaagctgccgggattgctgagttggaggaaattgagcttctgccacgcattcaggttgtaacccacggcgaccatgccgctttgcgagggcatttgctgctggagggcgtgtaccgcacacctgaacagatcacgagcgagcttcatcatttgatccctgtggaaattaccattccgctaaaccgcgtagggagattggaagatatctctgtcgagattgaaaattttgatgtggacctgctttctttacgtagtctaaacattacaggcgttctttctttgcatggcgtggaaagctcgcacgcggaggagacggcggtttggctggatgaggaatttaccgtagtgcatgcacctgagcatccggttcaatccctttccgccgatggagagcatcatgcagaggcctattctaccaatgactcgtcctccgattacgttacagatcctgaaacttcctacagggtgccagcacaacaggagtccgtttcttgggaacagccgtctgaggaacatgaggaacagaagtcattgtcggaacagcaagcttatgagtcggcagtagatcctaaccgattctatgagccttggacgggcaaagcagttgaagacagctctcccgaggtcaagcatgagcatgggtctccggaagtgtggggatttcagcaagaggaagcatgggcagggggaaatgagcccaaagtatcttccgcatctcctaatatagtatatgaacctttgctgtctgaaccgcatcctgccacggagtccgaggtctatctggagccacagttggaagcgagtcaagtagataacttcgacttcaggcctgaagcgtcagaacaggttaaccacgaggcccatgacacctttactgaggataagccagagatgcgtgtagcgctcaacagtaaaaaggatgaaagggcagacgagccagacccggttgtctactcatcattgctccaatccagccgttcggtgaaggaagccgaataccagcagcagttggagcaggagccgcaggatcaggatcagaaagccgaagaagagcgagagaatgctaagtggaagaaccttttttttcatacacaagatgaaacaccttttcgcaaggtgcggttatgcattgtacagcgcgaggatacactggaaaccattgctgaccgttatcagctcagcacacgtgagcttcaactgtataacagattggcggagcatcatgtggaagaaggacaggtattgtacatcccttgatccggttgctgaaaaatgcacggcgggtgttgactatagtcaatgggaaatgtatgatgtggtatagttattgaaagactgagatcgggaagagtaggcagcaagcccttcagagagtggaattgcagcgctgtgaggttccgcaggaagctactggccgaagtcacccgggagtcgcctgtttgaacggttcctcatttaattcctacggaagataagaggctcacggtagaataaggccggtccgcaaccgttatctgcataaagtgtcacaccatgtgtaatggatcagtggatacatacacaaggggtgaaacaaaggtggtaccgcgagagaacagcctttcgtcctttgaggatgaaaggctttttttgtttgccaattgaaaaatcatggaggtatcctgatatgtcagaacaagacaacaagacaaccttggaaatgccaacaacgtacgatccaaaatcagcagaacaaaaatggtacaaaacgtggatggagaagggctatttccgcgctgggcaacatccagaggcagagccttttacaatcgttattccaccaccgaatgttacaggtatgttgcatataggacatgctcttgactttactttgcaggatattattattcgcgccaagcggatgcaggggtatgatgccttgtggctgccaggggcagaccatgcgggtattgctacccaaacaaaggtagagcaaaagctgcgtgaagaaggcctgacacgttatgatttgggccgcgagaagtttttggagaaagtgtgggagtggaaggatctttatctagataatatccataaccaatgggaaaagatgggcttttctctcgattattctcgtgagcgttttacgctggatgagggactgtcccaagcggtacgtgaggtattcgttaaactgtacaagaagggtctgatttatcgcggtaaacgcatcattaactgggaccctgctgcacgtactgcattatcggacattgaggtggaatacaaagaggtgaacggaaatctgtatcacctgcaatatccactgaaagacggtagcggatttattacggtagccactacacgtcctgaaacgatgctgggcgatacagctgtagctgtacacccggaagatgaacgttacaagcaaatgattggcaaaacgcttgtgctcccaatcatcggacgggaaattccggtcattgcggatgactacgttgataaagatttcggtagcggcgcggttaaaattacaccggctcacgacccgaatgactttgaaatgggacaacgtcaccagctgccacaaattacggtgatggacgaaacgggaacgatgaatgccgaagcaggcaaatatcagggccttgatcgtagcgattgccgtaagcaaatcgtcgctgatctgaaagagcagggcgtactgattcgtattgaagagcacgtacatcaagtaggccacagcgagcgtacaggtgtagttgtagaaccttatctgtccacacaatggtttgtggaaatgaagcctctggcagctaaagcgattgaagtgcagaaggctggcaacggggtaaactttgtaccggatcgctttgaacgtacttatctgcattggattgaaaatgtgcgtgactggtgtatttcccgtcaattatggtggggacaccgtattccggcttggtacgacgaagaaactggagaagttattgtatcggcggaggaccctacaactttgcctgagtatgctggcagaaagctaaaacaggatgaggatgtgctggatacttggttcagctcggctttatggccgttttcgacactgggctggcctgagcagacagaggacctcaaacgctactatccgactaatgtcttggttacaggctatgacattatttatttctgggtatcgcgtatgatttttaccgcgttggagtttacggaagagattccgttcaaggacgtacttatgcacgggttggttcgcgatgcggacggtagaaaaatgtccaaatccctcggcaacggtgttgatccgctcgacgtgattgaccaatatggtaccgatgccatgcgttatatgatttccaccagtagcacgcctgggcaagaccttcgtttccgctgggagcgtgtggagcaggcccgtaactttgccaataaaatctggaacgcgtcacgctttgcgctgatgaatctggaaggcgtcacttcggcagatatagacattactggtgacttaagcactgctgatcgttggattttgcatcgtctaaacgaaacttcacgcgacatcacgcgtctaatagatgcttatgaatttggcgagacaggccgccttctgtataactttatttgggatgatttgtgcgactggtacatcgagtttgcgaagctttccctatatggcgaaaatgcagaggcgaaaaagaaaacgcagtccgtacttgcatatgtattggatcggacactgcgcatgattcatccgttcatgccgtttatctctgaggaaatatggcagcatcttccgcatgagggagagacgattacactggccgcttggcctgtttatgatccttcttttgaggataaggatgcagttgcagaaatgaatttgctgatcgacgtaattcgcgctgtgcgcaatatccgtgctgaagtcaacgtgccgatgagtaaaaaaattgaattactcataaaacccggtgatcaagccgttctcgatatcattaaccgcaatggggaatatgtacgtagattctgtaatacgtctgaattcgacgcgggattagaattcaccgttccagataaagcgatgacatctatagttagcggcgcagagctatacctgccactggccggactgcttgatattgcccaggaaattagcagactggaaaaagaacttcagcatttgaacagtgaagtggagcgcgtggagaaaaagttatctaaccaaggctttgtggcgaaggcaccagctaaagtcatcgaggaagagaaggccaagcaagccgattactcagataagcgcgctaaagttatcgcacgtattgaagaactcaagggataatttcactcacaataaaatgacctgaaggtgaagaggatgtcagatacgatcaggggcggagacacggctcctttacaaagctatgatgaagcagtggaatggattaacggcttgattccgtttggtatcagacccggattggaacgaattgaacagctaatgagtaaattgggtgatccgcaacgacatctgaaatttgtgcatattgcgggaaccaacggtaaaggctcaacttgtgcttttctgacctctgtgctactgaaatgtgggtacgatgtcggaacttttacgtctccgtacatcacccgatttacgaaccgttttcaattcaatgggaccgatattcccgatgaaacgctggttttgcttgccaatcgcttgtatccgttggtgaaagaaatcgcagatagtgaattgggatcacctacaatgtttgaggtatcgacagcattagctattttatactatgctacggtatctttcccagatgttgtggtatgggagacaggtctcgggggaaggatggatgtaactaatatcgtgaatccaatcgtctcagttattacgaatgtcggctatgaccatacggatattttgggagatacgctcgaacagattgcaagggaaaaggccggtatcatcaaaccgggtgtacctgtcgtcagttgtgtttcccaacccgaggctattcaggtcatacgtgaaacggcgacaaagcaaggagctaccttgtacctggcaggagaacagtttacgtatgaacggctaaatggggatgaaacagctcagaccttttcattcgcggggcccttccgacatatggaaattgacatcacgttgttaggcgagcaccaatgttctaatgcggcaggagctatgatggcacttgaggtcctacgtcagtatatggcttttgtgttggatgatgcagaattgctggagggctttaggcaaactgcctgggcagggcgtctcgaacaagtcagtacctcgccgaggattgtccttgatggagctcataatccagaaggagcacagacgctggccaagagtcttcctcaagtgtattcgtacaaaaaattggttttaatgatgggaatgctgtcaaacaagcatcatgaagcatacttgcagcatatactgccactagtggatacgcttatcctgaccgagcccgattttcgccgcaaaatgaatgccgctgaattggctcatctcgtggagaagctgcggccgtcttatgccaaaacggatttaaaaataattgtagaaggtgactggaaaaaggctctaggcctgcttcagtcacatacggaagcggaagatctgggggtggtgtccggcacgctgtaccttattgcggatgtacgggctacccttatgtatcaaaccgattcggaaaaaggttggtgaaatttgttgattacttcggaacatgttcattttatcggtatcggcggctacgggatgagcgcgattgctcgggtcatgctggagatgggttataccgtgactggctcagatgtggcatcacaggagctgacagaaaaactggcggcaaaaggcgcaaaaatatatattggacacacacctgagcatattgcaggcgcggatatcgtcgtctattcaacagcattgtcacgtgacaatgtggagcgggtggcagcggaggaattgaatattccaactctgcatcgttcgcagatgctggctcgcttgcttaacgaacgtaagggaatagctgttgcgggtgcgcacggtaaaacgacaacctcttccatgatcgctctggttatggaaagatgtaacgttgatccaacgtatattattggcggcgaaatcacgaatttggggacgaatgccaaagcaggtaaaagcgagtttgtcgttgctgaggcggatgagagtgatggttctttcctgcaatatcatccttggcaaggcattgtaaccaatattgaagcggatcatttggaaaattacgatggcgactttaatcgtctgaaaagtgcctatgtacagtttttgagtcaaattcgaccggatggggcggctattgtatgtgcagatgatcagaacatccgggaaatgttgcctcagctccagactcgggtcattacttatggagtggagcatgaagcggattatatggcgacagatatccaattaggtgaccgtcgattaagcttcactatgagccgtaaaggaacagcactcggaacgatcgaactatcagtgccgggtaaacataacatgtataatgcgatggctactgtgatttcctgtttggaagcagggattccattcgatcaaatcgctgctactattgtagaatttcacggagcgaagcgtcgctttcaagtactaggtgaaagcaatgacatactgattattgatgactatgcgcatcacccaacagagattgaggctacgattagcgcagcgagagcgactggcaagcgtattattgctgtattccagccgcaacgctatagccgaacctttttcctgctcgatgcgtttagccgtgcgtttagcgaggctagtgaagtcatcattaccgatatttattcaccagcgggagaaaaacagattgaaggcgtgcattcttccaagctcgtggatttaatcgtccaaaacagcaatgctaatgcaatctatttgccgaccaaagaagccgtgatcgaggagttgaaagatcgattacagccgggtgatcttgtgctgacgatgggagcgggagatatctggaaagcaggtgacgcgttagcgcgccatcttcgcggacagcaagtgtaatacgtataataatgagttgttacgccaatgaattacatttattcaagggtattccgaacacgactgtgtttcgggatacctttttttgtaatgctggggcatatattcttagcttgactcatacaacagactatgaggaagtatgggacaaggagggagtgcatccatgaacaagaccaagatgacattccggttcgaccaacagttgccggagacaagccgggaggataagctacaggtgcttccgtacaaaaacgagtcgattacgaacgaacagcgtgaaacgattagaggaatgaataaaaatgctgtagctacgcaagaagcagagctcaatgagcctgaggatctgaataaacgcatttcaagtcggcgctttgctccgacattaagagtacaagagggatgggatgacccctttggccgttcggcggcttcttggtcagatgcggacgttctaccagatagcctagaagagaatgaggaagcttatcattctggccaagagtacagaaaacgtccgccccacccttctagatggaaactggttggttctgtagccagcgcactggtgaccggggggatgtttggatatattatgttgttactgtttaacggaggaggcatggtcccgggagcagatccctcagtagaggaggctgtaccggtctttaaagaatccgttggtgtggatgcaatatctgcaaaagagaattctgtccctgtcactgtcatagaggctcaggtacctccacaaacctactatttgctgcaatatggggttttcagcactccagaacgggccttacaagcaaaagaagaactgttgaaggcaggcattgcagcaggaggggataccgaggaccaaaaccgggtatatgcaggaatatcaccggatagggagcaagctaagttactcagcaatcagttgaaaacacaaggagtcgaattgtatgttcgtgagcttgaattgcctggattcgaaaaagcggcttacggaggccaaggcgataaactcactggcttttttcagttaagtagtttattggtgggtaagttgagcggactttcctcaaccttgctgggagaaggaggtccgaatacggtgccagcctccgacatgaaggagctgaacgacctgcatcagcagtggacacaaaatatcactgcacttcctaccggtcttccaaaggaagcggttgcttccgcaacctcacttgaaaaggcgatgaacagcgcgatctctgcacttggggaatataataagaatacagccaaggaacacatttgggagattcagtcctccatgatggaatatgttttgcgtgagaaggaatttatccaattcataaaacaatagactaaccatattttccggcaaggaactggaaatagttccccatgccggatttctgtttgtattgcagtacaaatcaccgtataataatgaaggtgtcaaaaaatggcgagggaagatcaggatgaaaaaaaatgtaggaatgcttatactgtttttgttgctcggttggctcttgggtgcatggattgccaaagcccttcaatcgatcaaattcctttcctttctgacccaccccactaggatatcttggtcgccgagagcggacctggatattatcagctacaacataacgataaattttgaattgagcctgcttagtctgatcggcatcattgccgcgttctggctgtaccgcaggctctaactgatgaaaaggagcttcccttatggacgggaaaattacgccccgcattattctggcatcgacttcaccaagaaggaaggaattgctcgcatttttgagactcccctttgaggtggtgccgagtcatgcggatgagagcacgcctgagagctggacgcctcagcaaatcgtggagacccttgcggcacgcaaagccgaagcggtcgtgaacaccgccactcagtcgaaggaagccggactggtgattggcagtgataccattgtcgtgctggatggttcggtactgggcaagcctgccgaccatgcggacgcggttcgcatgctgactgcattgcagggaagaacacaccgtgtgtacaccggggtagcctgcatacataccggaaccggcgaaatgcttgtcagacatcgccaaacggaggttacaatgaagcctctgagtcaagagcaaattgtggcatacgtgaatactggtgaaccgtctgataaagcaggagcgtatggcattcaaggcatgggtgctacgctggtggaatctattcagggttgttattttaacgtcgtaggattgccgctttccttgctgtcggacatgctgtccgattttggagtgaatgtgttgcgtccataaaggggataaacatatgctggagtcgccaatactgatgcttcgcgacctcccccatgaagaacgaccaagagagcgcatgatgacatatggggcggatgccttaagcaacgcggagttgctggcaatattgctgcgtacaggaacgcaaaatgagtcttcggtgcatttagcgcagcgtattttgcagcaggcaggaaatttgcgtcaactggtggatatgagcttgagcgagttgacccagattaagggcattggggatgctaaagcgatacagctaaaagcgggtatcgaactggggcgtcgattagcattgtctcgccatttggagaccccggtgattagttgcccgcgggatgtggcagatctgctgtttgagcagcttcgttatttgcagaaagagcattttgtatgcttgttccttaatactaaaaatcatgtcattgctcaggaaacactatctatgggtagcctgaattctgccatcgtgcatcctcgtgaagtatttcgggcagcaatcaaatgcagcagtgcttcaataatttgcgctcataaccatccgagcggtgatccgaagccaagcccggaggatgttcagttgactcgccgcctgatggaagcgggcaacatcgtgggtatcgacgtgcttgatcatattgtgatcggggacgggacctttgtaagtttgaaggaacaaggtctgatataatataatatttaaatcaaacatttaaacacgaccggataatccggcctgaataaaccgtttatacatggataacagatttcagggaagagaaaaggagattacatcatgctgggtggctttacaaaagatttgggaatagacttggggacggcaaacacgcttgtatacgtaagaggtaaaggaattgtggttcgtgaaccatctgtagttgctttgcgtacagatacaaaaaccattgaggctgttggtgaatctgcgaaaaaaatgatcggtcgcacaccgggaaatatccgtgcgattcgtccgatgaaggacggtgtcattgctgattttgatacaacagcaacgatgatcaaatattttatccgtcaggcgcaagcccaacgctctttgtttccacgtcatccgaacgtgatggtttgtgtgccttcaggcattactgcagtggagcagcgtgctgttgaagatgcgacgaagcaagcaggtgcaagagaagcatatacgatagaggagccgtttgcagcagcaattggcgctgatcttcctgtatgggagccaacaggaagtatggttgtcgatatcggtggtggtacaaccgaggtggcagtcatctccctgggcgggattgtaacaagccgctccgtgcgtgtggcaggtgatgaaatggacgagtccatcatccaatacgtaaagcgtcaatacaatctgatgattggtgaacggacttcagagcaactgaaaatggaagttggctcagctatgccattagagcaagtggaaacctcggaaatccgcggacgtgatctggtaacaggtttgccgaagacgattacgattacttctgatgaaattagcgaagcattatcggatacagtcaatgcaatcgtggatgcggtcaaagtaacactggaaaaatgccctcccgagttggcagcggacatcatggatagaggaatcgtactgactggtggtggagcacttctgcgtaatctggacaagctgttggcaggtgaaaccggaatgccggtgatcgtagcagaaaatcctctggattgtgtggcaatcggtacaggcagagcgctggaaaatattcatttgttcaaatcgcgcagcagttctgccgtccgttccaaacgttgaatcgggggtgtaggaactgtttaagctgtttggcaataaaagactatttgttctattgatcggaatcgttctgtttattgcccttatggggattacacttggacagagaaattccttaacctggcccgagaagttcgccagagattcaattggctttgtgcaaggtatcttttacaggcccgcttcagcaatagcgggcttctttgaagatatcggaaatatgcgcagcatctacgaagaaaatgaacgattaaaaattgctgtggcaaagctgactcgtgaccagattcagacccataattatgttgaaacaaatgccagactgcagaatgaactgaagttcacccaaacgcaaaaggcgaaaaataattatgattatcgtgttgctcaagtgaacagcgtcagcaatgattccaaaacgcttgtgatcgatattggtgagaaggacggagcgaaggttggtcaggaagtcagttcgcttgaaggatttgtaggagtcattagtcgtacggggaattttacgtccacggttacgttgttgactacattggatcctaaaaatccgaattcttatgccattgcagcgacagtcttgggcaaggagaatcaatcgtttggtatgattgaaagctatgatccgggtacgaacagatttcaaatgactcgcattgaagaaaaagacccaatcgcaaagggcgatcagattattacatctggtgcaggtgggaaattccgcaaaaacctaatgattggaacggtagagaagattcaggttggggaatttggcaaaacacggacagcgattattaaaccggcagccagctttgtggattggaaagaactgctcatcctttatactcctgaggtaccggaataatgaagatgcgcggtcaggttctaatactgctgctgtttgtactgtttatagctgaagggacgattcttccgtggcttcttccggatagttggcattcaagaatggttccgaattttgtatatgtcgtgatcttgtttgtgtctgtgtattacagtcgtcatacagcattggtgctaggtattgtttttggacttattcatgatgtagtgttctacgggtttatcattgggccttactcttttgcaatggggttgtctgcatacttattggggcttgtttttacagctcgacgtgcgccgatgcctattatgatggcagccgtgttgattggtagtttcctgctggattctatgctttttgctattgatcagctgttccagctgaatcatcagactttcaattgggcacttgctcagtatatgattcctgatttatttatccattttctgttcgccctcatcatttatgtcccggttcgcaagcaattgcagcgtttgggtacccgtgtgaaaaaggaagaggccgtctaggtctttttacacacattttgtccgggttagcagggatttgacatcccggggacgaaatgattgagataggagggacaggctaatggcggtgaaatcgaatcatgtcacgattaaaggcatcaaagatggcctggtattcctgctggacgatcaatgcgagtttgaggatttgctaggtgagctgcgttttaagctggagcacagtcatcaaaatattttaacaggcccgatcattcatgtggatattaagctgggaagccgagaagtgacagaggaacagaaggaaagtattctggagatcttgaagcaaaaggggaatctgctcatcaggtctgtagaatcacctggactgcctgtggaagtgcagggaaagccccctattcacacggtgacagggattatccgttctggtcaagtgcttcatcacaatgggaacctactctttttgggagatgtaaacccgggcggaattataacatgtactggtgatatttatgtcctcggcgctttgcgaggcatggcgcatgcagggatggagggaaatagtgaagcgatcattgcggcttcctattttgcaccgacacagctgcgaatttccgaaatgatcagccgtccaccagacgaatgggagacacgtgaatccggtatggaatttgcgtatctcaaggatggcgctatgcaaatagataaaatgagcaatattgtgcgtctgggccgcgattttaacgtgttcaaaggggtgtagcacatgggagaggctatcgtcgtcacttcaggaaaaggcggcgtcggcaaaacgacgacgtcagccaatataggaacagcgcttgcactgctcggcaagaaggtatgtttggtggatacggatatcggtttgcgtaatctagacgttgtaatgggtctggaaaaccggattatttatgaccttgttgatgtagcggaaggtcgttgccgtttaaatcaggcactggttaaggacaagcgttttgaggagctgtatatgctgccagccgctcaaaccaaggacaagagtgctgttacgccggagcaagttaaggatattattttggagcttaaaaaggattttgaatatatattgatcgactgccctgcgggtattgaacagggctttaaaaatgccattgccggggccgatcaggccattgttgtgaccaccccggaaaatgcagccgtacgcgatgcagaccgggtaattggtttactggaaagctcacatgtggtatcacccaagctggtggttaaccgcattcgcaatagcatggttaaatccggagatatgttggatattgatgggattttacaagtgcttagcatagaccttattgggattgtgccggatgatgaaatggtaattaaagccgctaatacaggggagcctaccgttatgaatccagattcacaggccgcgattgcttatcgtaacattgcgagacgaatcttgggcgatacagtgcccctcatgcagctagaccaaaagaaaagcgtgatgacacgctttaagaagttttttggtatgggtggatgagaaaattgtaatactagacacttaaataagtgataatcttatttaagtgtttttggtttatctttttaaattcctataatacggtttctcaaaatttagggtcactacataaatatcataaatacaaaacatatccggtgcgctagcgccggtttttttgatttttaggtgcgtaatcccgaaccggacaacataagttgaagcccgtcctcataagatgtatcaaacatacctcgctgagggggctgaacaggatgaataaaaattccggaatcaagcagcgcagagaagaacgtatacagcagctaatcgcgggaagcaaagcggagacgtatccctctggcatatatcagaacaggcacggggataaagatatgaagtcgatgcctatagacagtgccaactcgcccagagacccagaaactgagtggaaaaatgagcggcaacgctggcagcaatcttttgggacgaatcgtggtccgtctttttggacttccttttggcgaagatcagtcatagcaacggtgttatttggaatggtatggggaatgtttcgttgggatattccctatgcagtgaatttgagaatgtttattgcggatgccttgaataaggatatggattttgcagccgtcggacaatggtatgaaacttattttgacggagcaccttcctttttgccgatttttggcgaggagcatgaaacgcacaaggtagacgcaagtcgaaagggctctccaccgattgaaggcaatataacacaaccttttgtactgagccttaaaggggtagaaattacgccgaatgttaccgataacggggcaatcgctgttaaaagtatagatgcaggtcgagtattagacatattaaatcatcccaaaagcgggatttcgattacaattcgacacactggcggtatcacagcaacttacggaaggctttcccgctctaccttaaaagtgaacgactgggttcaggagggagatgagatcggtgtactgccagcaagtcacagcggcagcgaggcggcgactttgtttttggcagttcaaagaggggatcaatacattgacccgtcggaagtggtagcccttgattaatgtccgaggggtgaccttatcactacatccactgtttgtattggttatgctgacctctatattaacgggacattttatcgagatcataaccttatttacattggtgtttattcatgagctaggccatgcgacagctgcttcgttgttgggtgcgcgggtgctttccatacagatgttaccctttggaggagtggcggtcattgaggatcaggggaagctcaatgcgtggaaggagattgtcattgcgctagcgggccccctgcaaaacggaatcatgatcatcatccttttgtggttcagaaatgtgagtggactggagtatgattatgtaaattatatcattcaggggaatgcagttattgcactgtttaatttgctgcccattttaccacttgacggtggaaaaatattgcaggcactgattagcttatcttgttcttatcaccgcacattagtgtggacttttagagccagtatcgtaacgagtttgctattttgtatatatggtatttcgccgttgttaaggcaaaatggacctatccatttaaatctgctagcggtagggatttttttgctttattctaatattgtggattatcggaatatcccttaccgttttatacggtttttgctggggagggacgagcttttttaccacgaagtagctaagggaagtattgccttacctattgtatccctgccagtgaaacatttggagcctattttgcgtcttttcagaagagatcggtatcatatggtttatgttatgaatgaacagggacggattgtagccgtattgccggagcaacgtcttattcgctcttattttgcgacacgcccgccagatggtggagaacccaagcccaaataatgttttatgagttaaggaagaggctgtatccagagaggttgaaaaaccatgaagcaaatgattgtacaatgccagcagcagatgacccaaatggcgctgttggaagagggacgattggttgaatatgcggctgaactaccgcgaaaacggggaattttaggttcttttttcaaagcgagggtggtcaatgtgctaccaggtatgcaagccgcctttgttgacattggacagcgaaagaatgcctttttgtatgtagatgacgtacttcatgctcatttggacaagcagccggaggtaaagccatccatttctgaagtgttaaaggtagggcaggaaattgtagtgcaggtattaaaagaggctgttggtagtaaaggagccagggtcaccactcatttttcacttccgggtcgctggatcgtatatatgccccgtgctgattatgtggccgtatctaagaagatcgaacgtgagggcgaacgtacccgtttgaaagcaatgggagagcagctacgcaccagtgaggaaggactcataatccgtaccgtttcggaggacatgagtatagaggcgattgaaaatgatttaaatcaactgcgtaagcagtgggtggctattcagcgtaaagctggtgaacactcggctccgtgcgaattacaccgggatttaagtattgttcagcggctgattcgggatgtgtttacacctgaacaggatgaactggtcattgacagtgaagagcaagcaaaggatgcagaaataatgctgcaacagattggtcctgcgaaagctcatgtaagtatatttcgtggtccagaagaaacaattttcaaagcttatggcattcatgagcagctggaacgcgattttgcgcgaaaggtatggctgcagggcggcggatacattgtcattgatcatacggaggcattaaccgtcattgatgtgaataccgggaagtttacgggaggcagtaatctggaagaaacggtgacccggactaacattgaagcagctgaagagattgcccgcctggtacgtgtgcgtgatattggtggtatcatcatcattgattttattgacatggaacaagaggagaaccgtcgggaagtatcctctgtgctggaagcaagattgaagaaggatcggaccaaatcttatgttgttggttggacgcggttaggtttgctggaaatgacccgcaaaaaagtgcgtgaggaaaagacgctcgtgtagagcaatgcgtaaccaaaaatcattttaaaactaaaggttgaatgtgtacaaagcttgtgctacaatcatttagtatgtgtgatgcgtaagattggctgcacatgctgtaaccgctccaatcaggtactgaagtgcagtatcctaagggaatctgccacctgctattaggcgagtctgagacataaggaggtgcaagcaaatgtacgcaattatcgaaacaggtggtaagcaatacaaagttcaagagggcgacgtattgttcatcgagaagttggaagctaatgatggtgaaactgtaacgttcgatcgtgttctggcagtgtccggcgacaatggcttgacagcaggtacaccgcttctttctggagcttctgtaacagctaaagttgagaagcatggtcaaggtcaaaaggtcatcgtatacaaatacaaacctaaaaagaactaccatgtgaagcaaggtcatcgtcaaccgtacacgaaagtgacgattgaaaaaatccaagcgtaagagggtgcgataagtgattatcgtgcgtattacacgactggaggatggcagcatacaggggttttccgttaaaggacatgcaaatttcgctaaatctggcgaggatatcgtatgtgctggcgtttcggcggtaacagtaggaactgtcaattcgattggagctcttacggacgttgagatggaaacggaaatggaaaacggctttttaagcgcgtatctttctcctgaaagttatcatgatgcgaacgcacaggttcaactgttgctggagtccatggtgattatgctgacaagtattgctgaatcatacggtaagtatattcaaatagaaaataatcaaagaaggaggtagacatcatgttgaaattgacattggatcttcaattattcgcatcgaaaaaaggtgtaggttccacaaagaacggacgtgacagtaaatcgaaacgtcttggagtgaaacgtgctgacggtcaagcagttaccggcggtagcatcctggttcgtcaacgcggaacgaaaattcacccgggcacgaacgtgggcatcggtaaggacgacactctgttcgcgaaagtggacggcgttgtgaagttcgaacgttggggccgtgatcgcaaaaaggtgagcatctacccgatcgacgttgctccagtagcagctactgtagaagcttaatagcggcttagacacgctgaaaagcctccggcacttttgtcggaggcttttttgcatgatggtaatgaactggaaagttagtctgtgctatactggattaaggttctttaataatccatttaatttcgcagaacggagagaagccatgttccagcggataagagcgccttatctggcgttgggttccattctgattcctttggttttttcactgctctatcctaaagtattaacgattatcttattagcagtatggtctgtagttgctgcatgctttggtatgtggtatacgcaaagacaggttgagtatgaacggaaagctgctttgcgttcttttgaacgtacagcgatttcaatgcttaaccatcatcggcatgactggatgaatgacttgcaggtgctttatggatatattcgtatgaataagcatgataaatctgttgcttatgtggaaacaataaaagggcgcgtggcggaagacagtaaaatatctaagttgggtattccctcactggtgttctatttgcagtcttttcgcgtgaacgccggtaatttacaattgtcggtacaggttgaggagcagttaaagttagacgctgtcatgtctcccgaagacggcgagtcgcttgcctcggccgtcatagaaacggtgcgtgcgtatcaatatggcgggggccggtcgtcctggggagaagtgcgcagattgacactttttttcggtatggatcagaatgatgttatcgtccgttttgaaggaagtgacatacctgcggatttgaatatcctaaagcaggtcagatccgtacccggaagtaaacgcattcgaacagagaagcttcctacgggcgaaatgcttcaaattcggatgcagtgccagacataaggaaggtgtaaccatgtttgtagataaagcgaagatttttgttaaaggcggtgacggtggagacggattaattgcgtttcgccgtgagaaatacgttcctgaaggtggcccaggtggtggtgacggagggaacggtggagatgtaattttccgtgtggatgagggtttgcgtaccttgatggattttcggtaccaacgtcattttaaagcccagcgtggagtaaaaggtcgcaacaaaagccaacacggagccaatgcggagcacatgatcgtacgtataccaccgggaacggtcatcatagatgatgatactggtgaagtagtagcagatatgacacgtcatggtcaacaagtcgtcgtagctaaaggaggacgcggaggacgcgggaacatccgttttgctacgccgagtaatccagcgcctgagttggctgagaacggtgcagagggacaagaacgttatatcacgcttgagttaaaagtaatggctgacgtaggtttggtcgggttccctagtgttgggaagtctaccttgttgtcggttgtatcttccgcaaaaccgaaaattggggcctaccactttacaacgattactccgaatctgggtgttgtggatgtgggtgatcatcgtaattttgtgatggcggatttgcctggtttgattgaaggagctcatgaaggtattgggctgggacatgaatttctgcggcacattgagcgcacgcgtattattatccatgtcgtggatatggctggctccgaaggacgtgacccgtttgaagattggactaaaattaacgacgaattgaagcaatataatgcagcattggctgagcgtccgcaaattgtagcggccaataaaatggatatgccagaagctgaagaaaacttggctcacttcaaagagaagattgcttctatacgtcctgatcttgaagtcatgcctatttcctcactgacacgtcaaggtgtgaaggaactgctctaccgggctgctgatttgttggatcaaataccggacgagccagttgttgaggaagtagcagaagtcaatgaacgtaaggtatttaagctggatacagcagaagacgatggctttacaattgtacgtgaaaacgacacattcgtggtgcagagccctaaaattgagcgcatgatgaagcgcatgcagttgaactcgcatgatgccattttgaaattagcaagaacgttacgccacatgggtgtggatgctgagttacgcaagcgtggcgccaaagatggtacatctgtacgcattgctgatttcgagttcgaatttgttgaaggcagcagctactactaaaaatcaaataaaggtctaaaacctgaacggttactgtactataggaaactctatagaaggcagtagccgttttttgcattgttagcttgccgattttcatgagtttcgatataatgtcctctatacaaaaacataagtctttgaggagaggacgttcttgaaagagcgctattacttggtacgggaagatattttgcctgaagctattgttaagaccatacaggtgaaactgctgctggcttcaggagatgttaaaaccgtgcatgatgccgtggagcaagttgggctaagccgaagcgccttttataaatataaggatggcatacatttggttaaccagctggagcgtgagcgaattgtcaatatctctattgatttagaacatcaatccggaatgttgtccagggtacttggcagagtggctgatttcggaggcaatgtgctgacgatccagcaaagcattccactgcaaggcagagccaacgtagttatctcggtagaaatgtccagactcagtgaagagttgggtgttctactggagggcttggaggacatctctggagtcaaacgtgttcgcctgattgggcaaggttaaggcaatacagttcattagatataagtttgcgggaggggaatggatgaaaccggtcaaagtaggattgttaggtttggggacggtaggaacgggagtcgttcgaatcgtagaaggcaatcaggaagatttgagcagacaagtcggttcaccgatcatcattgaaaaaatagctgtaaaaaacatagaaaaatatcgttccattgaagtggacacggccaagcttactgaggacccatgggaagttattcgagaccctgaaattgatgtaattatcgaagtcatgggcggggttgatcagacgaaggagtacattcttgaagcgttggagcggggtaaacacatcgtaacagctaacaaggacttaatggctttgcacggttctgaagtattggcaaaggcgcaggaaaagcaatgtgatattttttatgaagctagtgtagcaggcggtatcccgattattcgtacactcattgaaggtttctcctccgaccgtattacccgcattatggggattgtgaacggtacgaccaactttattttaacaaaaatgagtcaggaaggggcctcgtacgaggaagttctcaaggaagcgcaggagcttgggtatgctgaatccgatccgacctcagacgtggaaggactggatgcagctcgtaaaatggcaattctcggcacgctcggtttccgctctaatgtagagctcaaggatgtaagtgtcagtggcatttcaaaggtaaccagtgaagatattgcttttgctaaaaaactaggatatgaaatgaaattgctcggcattgcagagcgtcagggtgatgaatttacgattaatgttcagccgaccatggtacgcaagcagcatccattggcttcggtgaacggggtattcaacgcggtgtatgtgcatggtgaagcagtgggtgaaaccatgttttatggtgcgggtgcaggtgaaatgccgacggcaacatcggttgtagctgatttagtagctgtagtgaaaaatctcaaacttggtgtcaatgggcttaaagccatcgttccttacaaccctaaaaaaattagtaacgacgaagatgtgtatttcaaaaacttcgtgcttctgcatgtggatgataaagcaggggtgttggcacggattacgcaagtatttgctgaatttaatgtcagtctggcatctgttgtgcagcaaccgaatgaggttaaccccgatgctgaaattattatcgtgactcatttagccagtaaagcgagtatgaaaaaggttttggagcattttgaaactttagacgtcattcgtcgcatcaagagcgtatatcgagtagagggatagtcaataaaagcaggaggaattgtctgtatgaccgttttaaaaacagcaagagtgcgtgtgcctgcgagtacggccaacttgggtcccggctttgatacattgggcatggcattgtccttatatgcatggattgaaatgaaggaggccgaacagacggcttttcatttatacggagatgaaatgaatggtgttccccaagataaaactaatctgattttcaaggtagcacaaatggtttttcgggaagcaggtgtatctgttcctgagctcgatatttcgatgtactcggatattccgctcactcgtggtttgggcagcagtgcttctgctattgtgggcgccttggtcgctgccaatacgttgattggctcgcctctgccgaattccaagctgttcgatatggcaagcgccattgaaaaacatccggacaatgttggggcttccctgtttggtggtattattacagcgatgtgggacggcgagcatgctaggcatttacggcttgaaccagatgccaatctggaggttatggtagttattccagattttcagctgtccacgtcgaaagccagagaggttctacccgctcatgtatcgttgaaggatgctgtatataatataagtcatgcttccatgctggtagcagcattggcgtcaggacgaaccgatttaatcgccgaagcgatgcgtgatcagcttcatcagccttaccgcgcggcacttgtgccaggtatgacagagatcttgcaggatgctcaccattatggtgctttgggtgtggctctaagtggggctggaccaacgttgctggcattgacagatcggcgggaaaatcggaaagcagagctggagcagtatttaacggataccatgaacaaagaggggatcactgcttctgttttaaaattgcgccctgagaatgaaggagttaaagtatatacagaagggaatactctcccttttatggatatgattaaaggggaacttacgatatgaaacgaattgcacttcttcctgaggggactgtttctcatgaagcgattaagtatttgttaggagatacgtcccatgaattacttttttacaaacatattgcggacgtatttcaggcagtagacaagggtcaggcagactatagtgtaattcccattgaaaatacgattgatggctctgtaagtttgcatatggattggcttgtacatgaagtagacattcaaatgcaggcggaatgggtttatccttcaattcaaaatcttattggtcatcgtagtgaatttacgaaggatttggacaagctggatttgagcaaagtggtcaaaattatgtctcatcctgtggcgcttccccagtgtaaagaattcatacaggcttccgctcctcaggccgagttggagagtgcaggaagtacggcagaagccgtcgaaattgttaaacataaccccggtaaaggctggaccgctctcggaaccaagcttgcggctgccaaacacggattggatattttggccagcaaagtgacggatcacgataacaactttacccgctttgtcttgatcggtcatcaacccataagtctcccgggtacgcctgaaggtcagcgaaccagtattttggtcacgccgccgcaggatttcccgggagcgctgcatcaggttttatccgcatttgcatggcgcaggttaaatctgtcccgtattgaatcgcgtccgaccaaaaagcaattggggaattattatttttacattgaagttttggaatctctgcattccgtgctgcttccggcagcctttgcagagatcgaggctttggggtgccatgtacgtgttcttggctcttatccaagctacaagtatgttgaagcagcgatcgaacctattttaaaggaacattaatcggaggtgtggttttaatggcagaacaatggatctatctggatgggcagcatgtgactaaggaaaacgcaaaggtttccgtatatgatcatggattcttgtacggagacggtatatttgagggcattcgtatctataacgggaatatttttaaatgtaaggagcacttggagcgtctgtatgattctgctaaatccattcagttaaacattcctttgtctcctgatgaaatgttggaagcaatggctgaaacgattcgtcttaacgaaatgcgtaacggatatatccgtctgattgtatcccgaggtgcaggaaatctaggtttagatcctcttcgttgtgcgaaggcgagtgtcatcattatcgtggagcagctcgccatttacccggaagaagcttacttgactggcctgaagacaatttctgtctctcagcgtcgcaacatcccagacgctttgaatccgaagattaaatcattgaactatctcaacaatatcctcgtgaagatccagtctaactatgctggtgtaggtgaggctattatgctcaattcccaagggtatgtgacggaaggctctgcggacaacattttcattgtcaaaaacggagtgctatatacacctccttgctatttgggggcgcttgaggggattactcgtaatgctattatcgatttgtgtgctaagcttggatacccccttaaggaacaaccttttacactgcatgatgtatatgttgcggacgaggtgttttttacaggaactgcggcagaagttattgcagcttatgaagtggatggtcgtacgatcggctccggcgttgctggcccagtgactttggagctcctgtctgagttccgaaagatcgtggatcaggatggctacaaagtgtggcaggactaaaataaaaccgaatccttttaactgaatgctcgcgtgagtattcggttgagaggatttttttgtttgtatggggtcattcgcccgggaggtgcataggatgtaataacagaagccgggcgtttatcccgcccgaacgaaagtctaggaggtttgtgacctgtgaaaatacacatcgtcaaaaaaggtgacactctgtacttgctggcacagaagtataatgtgacgctggagaaagttattgccgccaatccccaattggcagaccctaatcagttgagtatcggcgagaaaattaaaattccaacagaccctgttacgatggaaacacagccgtcaacggtatatcaacacaaggttaagcaaggagattcattgtggaagttgtccaaggcgtggaatgtaccgcttaagctaattattgatgccaattcccagcttaaaaacccgaacgcacttctggttggagaaacagttaatattccacactacaaagaagatatgtctgattttactgagaataaaaaaaataccgcagtcaaagaagaggtgacacagcctaaacctgaatccccaaccaagcaagaacttacccagcccaaggaggagttgacgcagcctaagcaggagaatatgcctagtcctaaagaagagatgacacagccgaaagaaacagtgaatcctcctaagcttcctgaattaaaactgcctgaagttcctatggcacccgtaaatcctgctccacctcaaatgcagcccatagttactccacctgctccacctcaaatgcaacctatagttacccaacccatcgcatctaagccacagcttcctacaactgttgtgaagcaacctgtagctgaaaaattttgcggctgcacaaaatcggagtcgatggtaaattccgagtggtcgatacaacagccgacatttgattatagcccacaaataaatgcaatgccgaactcgtggtatccggggattgagtctcctcaaacttgggggaatgcgcctataaatacctccttagcagaacacgcctctcctactgtagtttctgatcagggctatcatcatgattgtgagcatccatggtgctgggggcctgtgcagacaccacctataaatgcccacccaacaccttatcctgcctattcagattgctgcgcccctggatattatccgagtcatgaggcgtctgaaaatgcatcctaccctgtctatcctccatttatccatcaagggcatccgcagcagtatccagagagtacagtccagggcagtcaatggagccaggcatggggaggacctccatatggttcgcctgcgggtgggcacgtgtccgactatagccaactacaaggacaacaatctgcgaattccccttatcatccgtttgcgcatgggaatgcacctatgtatccattagagggatatacaacaccctatatgtttatgccagactgtggatgccgggaagagaacgtccagtcggtaccagcaattccagcaacgcaggagattggtaacaatctgactattgcatcccaaaatgaagttggctcttcttctaaaccaaaggatcgtagcgtacgtaaaggtaaatcaaaagacagctctggcagtacatccaaagaagagacatccaaagccaaggtttctagtaaaaatggtactaataaaaagcaaaaatcccgttcctcatcttataatgctcgttcgcgtaaaaatccgtggattaaggactgacctggctatatgtaaaaggagaggaacctcctggtagtgcccggctttattattcattaagaggaagaaatgaatgttaaagagactgttattctgcttgtgggaataatggtctctttatttaaatgcagtgattttaaagatgagaaaaaaactaaaaaaaggtgttgccttctagcgtaattttgtggtatattcttatagctgtcttttgcaagatagttagcaacacgaaaacaaagcagaattgattaaaaaattcttttgaaaaaaagtgttgcaaagacgtagaaaacatgatatattatttaagtcgccgctgagatgcggtggtgaaacaaagtaaggcattatgcaggtttgatctttgaaaactgaacaacgagtgagtaaaacgattttgttcgcaaaatcaaacaggagatatttttatctcgtca

SEQ ID NO: 25 - DNA, 97826 bp, Unknown
  Kingdom: Bacteria, Phylum: Firmicutes, Class: Bacilli, Order: Bacillales, Family: Paenibacillaceae, Genus: Paenibacillus
attataataagtcaccaacctcaatttttaatctaatatttaaaaactcttgagaatatatgcttcttctattaaaaattaagaagacattgttatataaaatataattccctctctatagaaaaacttcgacctcctcttccttgaaccatttctcttttaatacatgcattttaactagttctggattctctgaatatgctaagatagcaagacttttttctgcacggctacatgtaacataaaataatcgtcttgttcgctcaatacttgaatcttttcctacagattcattttctatatctgttttagttttttcttttaccccgaataacttttcatagctaaatagaaagccacgcgcttcgctatcatcaataattactagtacacgtgggaattcgaggccttttactccttgatgggtcatgaaattcaacttaccatttatataagaatcatatgccgaaatttggctaaagggggcatttaagcattcagcccaagcttccatagagctatattcattttcctcctttatatcttctttattcatctgatcatatttactattggtaacaaacggataaaaggtgtctggaatattaaataactttaaattttccacacattgtaagacatcaatgcaacgtggctctacatctgcattccaaagtgagagtaactgattaatcgcttcttgagtctttttgatttttaactgttgactaacttcgtcttttgctatttttagtaaaggagaatgttttctcacaacactagctatggcgaatttatctccaattttatttgcttctactataggcaatataatttgtgtaaataaaaataaatcagaaagtgtaccttccaataaccccgtccttaatctatctatctggtaaagtggccgaaaaaactccaaaaaacctagtcgattggcagccatatgatgttcaagaattagagatgtgtaatttgcatcaacactagaccattttttatcggcagtaatttctgacattctatctgcaaccattttctcagccttacctttttcagccgttgaaggaaatataaaaaaacgagcaaaccccgcttccttatctgttcttgacttttgttcctgtccatcaactgtaaaacgtattttatttaacagcttaatgattcttggtgggcaacgatggttcattttttttacaggtttcttccaatttctcggtaaatccactcctaaatctactttaccatcggaatatatcctttgcatcgtatctccaaacaaacctagtgaaaaaacaccgatatttttttgttcaacttcaaacagggcattaattagatctttattagtatcctggctttcatctataaataagatcggatattgattagttaggattttttgcattaatgtcttgttagttataaaataagctcctatgcttattacctcagtgtggcttaaagatgcttttccttgattaaggccattgggattataagtaaactttttaatatgcttaatattttgaatccggttttcctttgcctctatactttgttggcgttcaataaacgttttggtacccatacgtcctttctcttgttttaattttaaatcttcaatttgtgattgtaagttggtatgtagccagtccctaatgtctgcatcaaaccctttaatcaacccccatataaatgcatgaatagtagaaatattaaataagtggtcgtaatcaaccctgcgactaatctcattacatgcagcattagtatacgtaataactgctacttgttgtcctctatgctgcagttgatgataatatttttctcgaatttgattcagagcatatacaagcgatttagtttttcccgatccagctcctgcaaataagaaaaaactcttcaactcttttggattcaaacaactactgatttcttcatctacatgattatctatacaattgtctttattctcgtctatttcgttcatttagttcatcaccatttcttccactaaaatatcaacagaattctgatgaatagtactatctagttgtttcttttgtaactgatcctctaaccaagtcaatccttcattaatatactttggtactttgagatctttgagatcttctaaacaaattagttggagagcaaattccgcttttttcccgtttcttaaatcatcaaaaaattgcttccctaaatcagcaattgtcttttttttagtaatcgcatttttaaatttttttattaaaccagttccctcaagacttttaaataatgataagttttcgaaaactaaagcatcttcaaaagtatacggaagagcctcaacctcagattcatcatgaaccattaaaaccttaattggatattgataagcaactcttattgagaaattagcattttgatatctttttactttttcattacactttaaatcaaataattcatcgatctcagttatacacggaacccaagattttaacgtgtcatttccagtaatatatcttttgttacgaagaggagccttagctaatttacttttagaatctgttgaatctaaatcagttataattaaactcgtcaaacccaagctctctattaggggttttaaagtgtgggcatgacttcctccaatctccaataaagaaatatatttttgattcaataccttaaaatgtcttcgaataaaatgcggaatcagcattcgctcagctggcccttccactaatattgctgcatcagcgaaaagcaagtcaaaatgagttatttgaagatacctggttacaaaacgttctgttgcattattttcgccgaatacattcgagagattaacgacagtagatattgggacttcattatctgataccgaagattgtttacggaaataacgcaaacttgaaaagggtatttcatgagcaatgtgtcctgagtgtgtgcttacaattaattgagttttaaagaagtcttgtccttttaaacgattattattacataaaatctcatatacgtggcgaatgaagacttgttgaacttgtatatgaagatgtgcttcaggttcttctaccaatacaatatgtagtggaggtataaaaaaatcattcttattgctcggagtactcttggctaatttcccaaccttcatccattcatctctaaattgcatcattttaaaaataatcgatatcaaattttggtaacctagcccgttatattgttcaggaagtcttaaatgcatttctttaaattgtttattctccggcattagatcaaactgaacagcggaactatgtttaagaccatcaattggtttaaattttgttgaaatagttatcttaggatcagaaaatccagggtaacctaaactttgcaattcaataagtgcattttcaaaaccatcgcgtaacttggaatcaaagatatcttgagctgattcaatagcttgcaaagcatcaatatcagttgggtctggtgattcagttggattcaagtgagtattataatatctgcgtagttgtgtggaaagattcccaactaaagcactggtagattcatcttcttcgcttgttttagctgagtcagaaaatcctcgttgtgcaccaatatagtgtactaaaaagagtttcttaaatgggtcttcatctacagcatcactatcaaaaggcaaaatttgaggtcgtgctagaccactttcaggatcaatattcaagagtttactaggatcaagaatgtatgccctaactgtaaaatgtgtataaaattttttatttaaataatccttaagatttcttggccacaaggaaaacgagcttgcagacttcgcagctgacagcgtctctttcgcagaactaattgattcaacaaaatctttgtacagatattcattgtctttgggctccagtctcaacctaacccctagtaatcctccatcccaatctaaggatgggattaaatgagttacataatgaatttcgttttctgagacttgtaaccacacatccaatgtaggtattagtttttctaagtcctcaaaatcagtcgtttcctcacaattagacaaccagcgctctccaattctattaatctcaatccaatttgataatgtaaaatcatttatagtaagtcactttttttatctaaaaactttcttagtgcatccatggcggaagtttttccgctgttattcgctcctacaaatattgtagttttgtctgtaaattctactcgacaagattttaattttttaaaattttgaatctctacacactcaatatgcatccttgcacccccaatttcactaaaatgtttagatgaatttgccattaagaaaaaaaggactatatgcccaagcctaaggaaatgacttagcccatttttctactaaattctgcataaatcttctttatttcttacactatagcatattcatggggatatatggaacaaaaaaagcccttgaataataccaaggtcctaattcaacgcaaaattcaaagtagagctgagaacattcatttatttggataatttttggatttattttcagattcaaattcctccactgaatgaactcaaataaagccgctaacgaaagaatcacgttactacggctgattggtctgtatgtaaaacaagatccccttagtttgatcacataagggggaatttgtcccatgtctgctgaccagtaacaaacctgaatgagggctcgttaattcatatgattgcagattacctcagtttaaatgaatttatttaacatctattaactactctgtaagctttgtaaataattcagaaaacttcgtgaaactgggtaattactctcccaaaaatattggtttgcattctgctcatctttaataaaaaataattgtctttctcttgatgctgattcattcaaattatccctatgcaaacaaataaataagtcaatttgcttgtcttctttaagtttcctttgataataggattttaactcacttgaataaccatatccaaattctgaaaacagtgttctcttcgctacacgtgttttaaaagcaaataatgctaatcgtatatgcttagtctgctctctctttctaaaataattgtttttattgctcgtatcacgaatgtctgataatgctaaattacctttaacttctatcaccattaaacagtcagaaggatttacaagatataacccctccaactctcttttgtacatatttttcctacaaactaaaatatcgcattggggacttaattcaccattgcaaacaacaaaaccactaacaaactctaacatgccgaatcgttctttcagttcttttagcaatatattttcgccacaacgtcccatttcagcattgtgtttaagtcgctcagcaataaaatacttacagaacattaattgttccgaatactcttcaaaaattttggtaatgtccccttccattttagaagaaaccttgggggctacatcatcaatccgatccataactactgttggcgtatcatagtctatcttctcataaaccatttctctgtaccgattaaacgatagatcataatcattcgcttcaataaccgccttgtccagcaagaaactctgctcagtcggtaaacagttagtttcttcctcaagattatgaaagcccgtaataatatcagtaatatcattgttctgaacaagagattgcttagcatcaagtgagaacccgtctgcctgcatacggtaaaaccaaactttatctgtaccaccagcacctgtcttggtaaaaacaagtactgatgtacttaccccagcatacggcttaaacacaccgctcggcaaggaaatgaccgcctgaagctgatgattctctacaagttccttacgcaactctttatatgctttcgtcttcctaaacaaaacgccatccggtacgatacatgcagcgcgtccacctttgcgcagcatttgcagggagagggcaacaaacagcagctcagtctttttcgtattggtaatggtcttcaggttatcatggatgctctcggcatcaaccgtaccagtaaaaggcggattgaccaagataacatcatatttagaagtgatatcattttgtttggatacactgtccaaatatccaatattaggattattgatggaatgaagcatcagattcatactggacagacgcagcatcgtactgtcagtatcaaaaccgcagaacatgtcgcctgcaaaatgctcccgctgatccgcagtcatctctgactcgtatttctcacggatatattctgcggaagagattaggaagccagctgttccacaggcgggatcacatattttatcagttggtgttggcgcgagcaggcgcaccatcatatcacggatatgcttcggcgtacggaactgacctttatgtcctgctgtagatagcttgctcagcatgtactcatacagatcgccttgcatgtctagatctttgatattatgctcatacagttcatccaggtcggtgactattttctgtaaaacctgtggggttgggacgagaaaagtggcattctgcatataatgtgagaatgcagatgctttctcaccgttcatctttttaatgaaagggaatattctggtgcttactatttcgaacataatgtgggcgtcttttgtcttgaaattgctccaacgcatagactgcccgtcttcgccctgtgggaatattttagggatagaagcgccactgatagcttcaaagctctcgttttcagtttcttgtacatccagtgaacggatgaacattaagcaggtcagctgctcaattacagtaattgggttagagattccacccgtccagatatgggaccatattttatctactttgttacgtacttctccggttaacattaatcttactcctaacgtaatttaacttacttcttataatgaaatacagctacacctttacttcgaaacaagtattacaaattacttatggcaattgtaacaaacaaaaatcattagaaaaagatttaaatcactgagcttgaattcataaataaaattatcattaatcgaaaagacatactcccgatatatcaataccatcgacttcacgtacctaatgtatgtaaataatatatgttcccacactcaaccctaaagctttttttgaatgcaggaacatatccaagttaatcttaatccctcgtacatcaatgcttctgatctcgatatatcactaccacgcactccacatgcaccgtatgcgggaacatagggcacttggttaacgtttgccaaagtgggcttaaaccttgatttataagggttttctatcttctcttatggttctgtttggttgatgttgggcagctattgacggttttcgtccccaatccgtccccatatgaaaatatgattcttaaattatctaaacagtatctcgcatccagccattatgaataatctgctgattcatttttttcaatccccaaattcggggagtgcaacttcaaataagtagtggtaaataaaataacttacattaagtagtagaggtagcttagtaatctcacatcaaactctttgaacggtaccggtatcaataagtgcttcaagatgtcgttctaagtttttaggaatatgccctccctcaactaaaactccaagctccatattcctttccattgcagcagcagtaaaatttgcacttgtaataaatgatatctgcccatcagcaacagcacatttagcatgcactgaacctactgactgtcctgattttttccaaacatagacatttgctgttgagactgtttttttcatagcttccactgaatcaaaactgacagttcctccgtgttcagtagaggattcaaaaattaaattaatactcacacctctttcagctgcattacataattcatggataattgtctcaactttgtatgcaacatagctgactatgtaaagcttcttggctgaagacctaattacttgacacaacacctgctcagtatgtctaataggtactatcccagttgatggtcctgtccatactaattcaacggaactcttcatattgtgcaagctcgaagtccaagatgaactacgtagtgctatagacagttcagcaggtgtaatatgactatactcttgccaagcacgttcaaatctaagaattaatatattatcaacgttaggaccaaaactagtttttgctctagaaaaatctttgaaggatcctaaagaagcaattttctcagcaattgctcctatccgatctgggtggagtttcattcctagctctgcaacaatctgaaatatttcattcatcaattagattctctttttaagaatgcagcttcactacattctaatgtattaacaaggagagctctatcaagataacgatttccatgttcacaagaagtctcggcgacaaaagcacatgcatgacatgatgcagcatgaagagttctatcttggcttggatcatgctccgaacataatggatctgatgaacaaatctctgatcttaccaaggcttgatcaataagtcgacctaggctttcgtttttccctaactctacgagccctcctaacgtaccgtcagaatcggccgctgcagtatacaatagaactccggccattggtcgttccaaatcatcactagcatatatccgttctctaatactagctgcgttgtatccacattcaagcgcaagctcacggattaacagatgtgcgaaagtgtgtaacattgcatacctaattcccggatacccttcctctggatctaactttcttgcattacgccatcccttatgccctgattctaattttaaattccgttctttaacaaccccccagctttcccaatcccttatcttctcttcactaaactgtatgaatattccctcgccatgcacttcacttgctggcacccactttgggcgaccgcggcataatccagccatagtcggttgaacttctgtatctgaaccttcctctggggcttctacccttgtatatccaattagtgcatttacttcccttaatctttctaataataatacatttgatattttatccccgtaacttgctggaggttctgttcgccggcttaagaattgtggccaatcatttggaggtaatgatgatgtaagaacatcccactctggcaatttaatatcaagttccgtaacattctcatctgcagcctgcccgtttttcttattttgaattgcatgccatatatccttagaatcatactcacttaaaccaggcaagacccctcttcttgagagcgtcctgacgattcctcttaattcctcaagactttcaacatctacaaaatcttcccaaccatccgctacaagttgatttaacaaattgttatgaatcggtattgccagtactgataatgtaataggaaaccagctgttggtagctccaagtaatacagcccttgcgttttcatcacatgatttatcatacatatcaaggtggggatgccttccacgacaggctggtaaattttgttgagcctctttcccaaaagcatgaactaaagatcttgatgattcacattcatcgcattttacccataggttttcagtctgtaacgatgcacctgtttcgaagaaacttaatttccctctacaatcagacggaccgctatgtacataccaacgccatggaaaatcatcaagatggccatttttacacgctaataaaaagcgagctggcactgcatccgactttttacccttttcacaattttcatgaataaagtgggtttgctccgggcgataaggattaggtttaattttaaacaaccccgaatcatattctgaaagaagaccacatcttacacatctcaaccagcgtggaaaaggcctaactggcacacctatctttccttcagcagacatcggatctgcattctcgtctctaaggaatggtggaacacgtaatcgttcaacttgtggccctaacttgcgtcttacggcagccagtaatctagcctcttcaataggggaacaattttcaacattccaaagatctaatcccatagttattacagataagttaggtaagtcgatcaaagccccaggtccataagtccataatagctgagaaggtcgaacagctccaactctataagtactcatcctctattgcctccttcgctaacaccatcattttctttcaacttccaatttggaggttcaggaagattagctacatccataataagttgaacaccaggctcaacctctcttaaagacatagggacagttacattatcccatgcgaagataccgggcttcttcaacagagccactaggtcgccctgaccgcgttctgtctcatacccaagtcgccgaccaggtttagctgcttcttttgcccagatatcaattctttcggatgacatctgatttgcattattcattgcttcttcattcttaactttccatgctctattcttcacaattcgtttcacatattctacttctggcttggtaggactatcgagatattgggcaccagtatttgggtttaagacatcgtgattcatgcgtaacagacttatcattgttcctgtcagccccctatccaaggcgcgaggagcaaatggagtaactgattgtgcttcaacatgtttataaaaagtcgcatgataatgctcaaaggtttcatagtgagagagatcacgaggtcgggaccatgtgagaacagtacagactaagccagggaatgcacgacctacccgactggtagcctgaatatattcagccgtactttttggttgaccattaacaaccattaaacctagacgatttacatcgacgccaaccgagagcatattagtcgcgagcattatatctatcgcacgagtctcgcccttttcccatgaagacttgaacttcacctctaattgatcaagctttttaggaatctctttacttgctactcgtgaagtaagctcatctacattctttacagatctttgactcaaacctgatctatccacatcactcatctccacccggtaagaacgggtctggacatcgtcttcagcaagcctccgcattccacccaattctctaagagaattaaagtatccgactacagtcatataaggatcagcagcatgatcaaagtgattatacaacgtttgcgcagcggtaagcattgcgacataaatccgaatcaacactgctgggcgtgaacttccaggtgaacagattcccatataacaacgaccaggtttcttttctacagatctttggatagagaaaaaattgtcttctacatctagaccatgtggtgggaaaattgatacttgtctcagaaatacattattcatttgttctcgagcctttcttactgtagctgtggaagcgataaccttaggcctaacttttttaccattaaattcccaagtacatgattcatcaacaattgtttcataaagccctaccatagttcctaaaggtccacttataagatgaaattcatcttgaattattaagtcaggcgggcgaacggataacacattctgtgcagaagttgaagataggtaacctttcttcttatgatttccattacaatcagcatcaggccatagtaggccatgacgttgacattcctgagttactttgccaaagagggtacggacctcacctttccaggccatcattgcaaacttatctacagtagcgatcaacatagaaggtggttggtggtatatctcctcatctacaaccaagactggaagacctaatttttttgacttctcctggctgaaatcacaacgaccatacttatctccacaaaaaattaaagttcttcccatatcaagatctacgcgaatatcacgaccagaggcaatctcagatccgcaccaaggacatgtagtaagttgagcaggagtagagcctctatatttaccatcacgttctttttcaattgcttcatggctttcctttgtagtattaggggttacctttttcccaacccataaccctatggtaaaacgttgtgttccccataacttcggttcgtttttacgtagtacttccattgcacaaattaatgctgttgcacgttgaaactgctgtaaggttaatagtctgagtgtatatctcataatgacagctaatccacgaccagaatcaagaccaccaagatttccttgtagtctccgaatagccatagtaaaagcagctactccgaggtaggcctcagttttccccccaccggttggaaaccataacaaatcagcataggcctcaagcggctctgtacgatcatggtgagttgggtcagacaaagcaggaatcgataataatataaaagccaactggaatggacgccaagaacgatttttacgaatattcaattcatctaaatctgggctatcaccgcggcgctttgaaagtgcataaatgctatgtatacgttgagtggccattgcttgattagcaaaacgaaatgcctttaacgctaacggattagatttaagtacagcaatgccctcccgcaatctacccagaatatgatcacaactatccattgcatctgctccagatttctcgtatccttttaccgagttaactattcgctctctttgttcacgaatccatgtgtcataatcatttataaggatatttaaggcactctctagatcattgctttctaattcagccaagagctccatatcaagatacccggactcaaccatttcacgcattgcaggacgatcttcggattcaagaccaggagtttccgtaataggtacttcataatcaggtataacttttgtacttatttcaaccgcatgttcactatctccatctgcagtagtagcatgtactgatattccatggccaacagcaaactcaatatgatgtcggtataccatctctaatgcttcccgttcatcgtcgaaatcctcactttgaaggataggacggcgtctaaaaatagctttattttgagagtctcgtactagcaactcaggttgaaataaccaagcttgatcttgattttgatttatactaatttgattattaattaggaataacgttaccagcctgtcaccattttctagtggattacttatcattccttgaataacaacatttgggcaattcatctctatttgtacaggtttaatgttgctatcatttaattcgataattatagtcccacccgaaggtatccgtttccatgcacggagaggttttccagttttcctattaaccttattgctttctacaggctcatatcttccccaacttgcagtaagttcaacttctttaacagccccatcaacacagaaggtgaaccctattgatgaaggaaccagagactgattagttgaagcatcaatttcaccatctgaatcttctgtatcaattcgcccacttgcattgggcaagtcgtcagcctcttcgagactggtctcttgtggagcaagtcttcctaccagataacggtcacgtacgctcatcccatctatcacttcctcagggccaccagcaggaccgagtaagtcgtcatacacagccatctgtaatagatcgcgtatataggcctgttccttagatgaatttccagttaaggtaggaaatgatgaaatttctttgtcaaattctttcctaaggatcttctcaaaaatgccccaatctaaacgagtaatagctaaagatgattgaatatcccctatttcaaaggatatattactattacaacctttcagaacaccactaaaaaataatgtggtagcctgcaaagtagaacgtttttgataaattcgcgcgcaagaagccaataatacttcccctgacagttcttcaataactaacagtacgtcgcttttatttattccttgacattcggcaggactaatatccaaggtaacagaatattcgtttattctaacatcttttccaaggcgaattaaccaagcattgcacgttccgttctttggtagaattggtgattcccaattcattatcttcctgctttcctcgctcatctaaatcctccatccaaatatagtgataaatcctataatctctatcccaattattaattaggagggtaatatagaaataaagtattatatttgctactcatttagttttctaaatcaaaaaggaaaagttgattatcaggcggttccaacctttttgcacctgtaggttttgatggtttagagttatcatttttatcatctttgacttcttcttggtaaatcacttgatttagccttataaggcgtataagcacttccttagcagcattttcagcaattgtataccgaataccatgctttgtatggtaaaatccatggcaaagttttaagtcttcccatccatatgatttggcaacagttgtatccaactctgtatgaagttgtcttagttgctcaatatcctctgcattctcaaaagaattgtgaaaaagattataaacagccgtcatcccaatatttcgggatatcattatctctcttcgaaaattataatatttctctccaattaactcgagctgtagatctcctaaatgaagaaatggataagtatcaaaactatcagacggcgtatatctaatgtcgtttttcattgtagaactttcgcgtcgaacccatagctcatgaaatgaacactgaagagctgaaaaacttgcccaagatgataaatcaagtacgcatacagcatcactaaatatctgcttagccgtaactttagttatagaaatatattttgttacccttgaaataacaaaaacttctgactgaccttcgatttgtttataaagtgcaggtcgcttatccccatgctgccaccatttttttttgtgagcctctcgtcgagatttatctctaatgggttttacaaggtcacgtactctatcaagtagctcaggccatttttttttgcattcctctaaacttgaatctctaaaatcaattgcccaacgaatagattgctgctttggatgagtattgatgtcttcaccattaatgtatggtaaaataacctgttgattctctggtcgcaccttaagataactatccgcttcctcttgagtaagtataaaaccttttcctgttagcattgatccaataaagcttttttctgtattacccttcagccgtcttgcgtatccccattctccgtgattatctaagacaggggaaatgaatgctacttccgtaccatcaagccattttaagccattccactctcctttatatcctataacgagagcagctattacggatgcattacccggccaaacaaaagaagaaagggcgtaatgaatactacatttttcttgttcaataatataagaaagaccagttcgcgctgtatccccctgccctattgtcttggtgcctattagtccaaatccaccaccatggcgcagcaacgatgtagctctaagataaaagaacgcactcaaatcagcatttaaactagcatgaggccagcatagagaaaaccaactcatcatggaatccccaaggacacctctcatacgtcgcccccccataaaaggaggattaccaataatagcatcaaaacctccattttccttcacaaatacttcaggaaattctaaaggccaatgaaagagatttcttggttgcttgtctttcataaaattaatctctattgctccaaaagtctgtaactttattgacatagtaatctctgtatttccgctaattatagcctcaatcttattaattaatgcatctaatgcattatcgagcactctggtgtttcctcttgatgttaacgcctcaccgatcattgcatcggccactatatcagccacttcaagtttattcctagcttcgatatccagttgtgacatggtttctacatcccgcacatccttaatagagattttacgcaagtcttttctaagtttagttgcttcggaaataagggtatttattttctcactaaatatatttagctgtcgatgaaaatgatttggatttatagataaaagtgttaattgattaagatggtggatacccaataaactatcaccacaacgtaaattatggtctaagaaaccaaagggacgtcccttggataaggtaatcaaccaaatagaaagcttcgacagctcgacagccaagggattgacatcgacaccataaatacatctttctgctaccaatcgttttgcaatgagtagacgctcatccagattcttaggcaatgggtcttcgaagtctaagttatccaaaacttcaccactaaaagttattgccttcccactctgttcttctatggtccaactctctaaaagacgttcagctaaccagcgacatgattggacaagaaaagcacctgaacccattgctgggtcacaaattttaagatccagcaaattggatgaaggctttaacatccaatcttcacgatgcttaccttccaatgggccaatatacactaatggctctaaggtatttgcaacgatactctcagttagtgatcttggtgtatagtgagtaccagtttcacgacgatctactccgatagtaaccacaaaagcatttgctaggtacacaatgggatcattccaagaatctgttcgtatcaagtgcataaatggctgtattcgttttacaagtgtgacatcccccccacataccgcaagcagctgacttgccagagcctcatcagccgatctgttaacggcattccggatagcagcctcactacgtcctgttgtttcctttattatgtttacgagtttctgttccccttcagtcattgctatttcaagtttaagcaatgaaacattgggatttctcgcttttttggaacctattaagcccaaggtcacttcaggtactcgcacgacagtttgctcaagtaaaccttcatacacatgtcctatttgttcaacatctagtgctctataagataattgcaatgcaccgccatgctgctgcaatacttgtaatgattctaacaaaagaagtactgttctgttatcaattggtaaaggcttagcatctgaatcaagccatttggtcccttttagcctcccctctaaaaaagggaacctatctggatcaaatagagagccacctaaggcaggcattcgaagggattcgtggttaattcctccgaaaaccatacgaaaaacgcttagtagtcgtgcccaagcatcatatcgccgctctaacatttctggtccataacggtcagcttcttctactaattgactacgtaaggttgaaattgcataatgttgatcatagaagtgatcacctaataataataatcctctttcctctgcacagagtaaaaacactaatctcatcatgacagtaagtccagcctcatagagctcagacgtagtaacattacttaacaaatctcggttacggtcttgatcagctttatctagacattgtattagcacttcaacagcacgacgaacttgttctcccagggtgtccgtcacatcatcctgatgttttaaggattcttctaatagagcgtctaaagtttcatcctgaggaccaaaacaacgacgtactcctaataatgactggaatgctttaagcgtaaccggctcctgaaaccagagtcgtgaataccacgaagcatgactagatgtctcgcctattggagcatttactaatacccatcgctcaccgttagtaactagaccgagtctgactccactagttttacataacaatgtcattctctcaataaaagaacttggccaaccatcatcatgttgtaccgtctcaagattagtttctggagacagcacagagataaaaagtcttgggttctcatcttgattgcccttaacaacccaattaggtttaaaaagtcctctttgctccagagaggttatactaaaaggcaaggataattcagagttcaaaaccaaagaataactatcatattctaaaagttcagtaagtactatccatatccattcgcgatgaagatccgatagcaatggatcctgatcctcaatagcctcacaccattcatcataagctgaacgaaaacgcgctcttcttggtgtttctaacgcctccaatccttgtggaaatgccttttctaagagaggaaccgttaaaaaatggcctgatacttctattagcgacagccactctgtatgtctactcactctgtttcattccttccgagttccgattctggcacaagaaacacaaccgctgccggaaacgttctatcaactatatttttatatctattctctatagctaacgcttcattttccctctcacttggaatacgtttgagacgctccttaagtgcatcaaaatctcggcgaagctgatttctttgatcctctggccatagctgcatctcaatttgttgaggcccttgctctttcaattcattttgtatgctattttctaagtcatcaagaactgttaaaacatccttaattcccccctctttccttcgctctaaagtgttttctaaatactttaacctatcacgcgatctagcctcaagagttgctagaattgacttttcttgactttcatatctttcttttagtgactttaataatgattgggatggttctacagcaatagattgttcgattaacgattctaatctacccaattgtgttattctagagaaaccactcctcctaagctcccctcctgataatgttaattcttcatgaaggcgctcatgattaccgccaatgataactagtcgagaccagactgctacaaccggtgagacaaaatccctatcaggaactaaccgaaatgatatacgatggagttgtttaatgtcatcaattttccacaactcttcacgtaatagacgcaagctcatctggacaagtttatgatttaaatgtgcaaggacgacatcatctcttccttttgctacgttatggtcaaatgttatagggcgacgcaaacctgtatggggatggttaagcccaattgtcgctctcccccatgatccaggtaatataggaacctcaaacagacttccattaggtacccctggtagggaatatggtctaagtgctggtttttccgcaatttccaaagctatttcaacagctctttcaatatgtccaggtgaaagatgatactcctctttagcctccattagcctcgcatgaagacgagatatcttttcttccatccttttttcagcagaaacaaaacgacgagcttgtgcagccttagtctctgcaatacttgtatccattgaattgcgtcttccaagcattgcttcttcaatttgtgatgcaataacaggaccaactgtacctaggtcctcccgaatcctatcaattttaagaacagcacgcatcaggtattcgtggtcaccagtaacctcccctactctaatttttctttgtgaactatcaggtttaaaaccctttccaaccggatgccagatatatacttctttttccttctgaccgtgtcgatctattctaccgttacgttgttccataacgtttggattccacgggatctcgatatgaatcagataattacagtgattctgcaaatctatcccctctgaagcagcatcagttgccaataaaatacgaactggggatatctgcggatccgcttggaaggctgccttaacaatttcccgctcatcgggaagcatgctaccgtgtaaaaacattagctgttcccccccataaccatgactaactagaatttggtgtaaccatgtatgtgtggcccgatattcagtaaataatatcacccgcttattattcggttgcccattatgcttaagatgagtatctaaccaactaagtattgcttttgcttttgaatccaaacggttcttaaatttatcagcccagatagaaagacgatctaacatttccgtttgtattaccgttaagggaactgtaagctcactagctacttcaatcgcctcattattgaactgttcagcttgggtatcattggaatattcctcttccgtgcgcaagatcgcctttcgaagaatccgattatctaatgtatcttttgcaggactttcccacccttttctaagggtatctctatgcttctctagtgttgttgcgaacgccataggagaagaaaacaatctttttttgagtaatgtatgaatgaaatccgtcccgaactcataacgagttccacgaacactacttgatctactagttatatattcccccagtagcttatgaatgtctctctcttcattggaatagtccacttcaagacactctagctttcgaatagggaatacaggctggccattactatctactatgtcacttttaagtcggcgaaccattaccctttgaagttgcctttcatcaggcataattgtttttgcaaatcgctgatcatcaagtaattcaagtaatgaagtaaacgactcctgatatccattatgcggtgtcgcactcaaaaataagtgatgagaaaagtgaggtgaaatggtacgaattagttttgtacgttggctctcaagtgcatatttacttgaagtcgttggcgctatattatgtgcctcgtcgactaccaaaatgtcaaatttgcgtggataagttatttgacgaggtagaatatccttgaacagtcgtaaaccctcaccgcttttcatccagtccatagacgaaataagtcgcggaaaggaagcccaaggattggcatgtattccacgctcgcgtcgcagttgttttatataatcagtatcaacaattcgaaactcaaggccgaatttctcctgcatttcagtttgccattttacctgaagggaggctgggcaaacaataaagacagtccgagctctgtgacggactaaaagttcttgtattaccaatccagcttcaattgtcttgcctaaaccaacatcatctgcaattaataaattaacacgtgccatatcaacagctctcacaagaggatctagttgatactcttctatcgatatcccactacgaaaaggagcttgtagaaaagaacgatctgcattagttgctgccccccatctaactgcatccaggaaagcgtcgagcctttcgtttgtatcccatccagtaatctgagggagaccagccttctccataaccttcgcacctggttctatctgccatatgacttgaagttcttcgcctagagaatcttcttctaatgaagcgagggtcactaaatgctgttgcctatttgaatcagtagagaacgaagacccgtgaacctggctaaccacccaatgacgtcttctaacttcaacaagttgacctgggtcggggacattccgactgaaagaagggtttttatttgtttgttgctgcaacagatgcgcctcccttaccattatttatcacttcatggtgagctacgtgtgctaataagctttttccaataacttcacccagttttacgggaaccgcattacctatcatcctaccaacagcttttatactgattttttctcctggctcaacaaaactatattcttcaggaaagctttgtagaattgccccttcacgtagagagattgccctatcctgttctggatgaccaaatctcccattaccaaaaccaaaatattgtgtagttattgtaggggctggttcatcccattccatccttccataaacacttcgatatgtcttccctgatttttttttatgacattcggccacaagatccttatcccaatctagccatgtcccccccggatttgatgctttaattcgtaacaggttagtctcagaaagtgaggaagattggtgtagaagatcactattgcaaaccttaccggcatcaatatgtggcaaattaaaaatcgcatcacgcactgtcataggtttaacctccatctctgaaggacttaaaagttcaatttcaccgaactttgaggcaagcaaaactaatcttttacgttgctggggcagaccatactccgcacaattcacaatttgataactcacatgataatttacactctttaagtcttctaaaaacttcataaaaacttcttgatctattagactaggtacattctccattgtaactaattctggagaaacctcctttattaatctcgcaaattgcattagtagccaccaacgtttatcagactgatctgctttacgattgtatgttgaaaatgtttgacatggggcacatcccgccagcagcttaatcccattttttctatactttctttctaactcatccgccgtaacttcctctatatttttcaaaagaaactgagccttattattatagttatagggatggctacatgctggatcaatatcaattcctaatctgacatcaattcctacgttttccattccctttgttaatcctcctgcaccacaaaataaatcaatagcatatatttttcgttttggtattagtttttttgaagtttttttttcattaagcatttaatatcctcctaattgtaaaaatcacatcttaataattgcatgaaagagctagagttagcttgaatttatatagactgacttaaaataggttttaatttcagtataaaatttgctaatagccgacaagttctttttagttgattactacattttatcaccaaccaactggtgatccaacaagtagtaatgactcatactaataaatttgaagttttaaaattataaaatagcttttcatcatcagtactatttaaatcggtgaatatcatgattgtattagaagagggagaccgcctatcaactactggttctgtttggtagccgtatacatggaaatgacaatataaatacaaatacaaagtatcctcctaatatctcataaacattcgaatattcgatatgcagattgtaatgcgttacaatatatagatttttcattcaatttaaacaatttatcctctatatattgatgataattcattgactcaataagtattctctactatgcttgactcaagagtttgagatgtattgaaacttggagttactaagttaatgaatattgttagggatgtagtaactatcaaacatccatacatcaaggccaccattgaaagtgaggactcagagtgaaaagaataaaattgcaagtatgggtgaatgaagaagacaaagatttattctaccatctggagggtgtaaaaggaggtgaacgagcctacgaatctcgcagacttatgcgtcttggtttgcaatatgagaaaagtaaaggaatctcaatggatccgaagggattcgttaaggcagaatagcatattcgtgtaacaagtaataacatctcttcctttgatacagataacttttgttaaaataaactgatagaaatagcgcctactatttagaaatactgattaaccctatcccagttactcacttccatgaaatttataaaaaattactgaggagtactaggtatgaatcctttttcgatttaagacgtttcgtgccccacccccttacctgtggggattagctttccaaagtatttcctagtgcctgcaacagttgtgaaccacctcaccttactaacactgaataacaaacacttgattgtactggcgagtaagagtggtattcatactagttcggtaccttttccttttatacccttcgggtccatgcaaagagactaccgaacttcactaatatgaatgtcaccttacggttccatattcataaagagctaaataatatctattgaattagtttagcaatctattcatcttaatagatttcggatagttccaatcccgcacatgtatcctatgtcacgccgcataagactgccaagtgagcataagaaacctgcatccttccccttacatgataaccaagcacatatgctacagggaccctcacagccagcctcaactcggggtaatacagcaacattcctggtgactcatgaattggcgacaagaggggatgggagcaggtacccgatttagtttgtggtttatccgtgatgacttcatgtgcgttttagcacactggagcttccagtttttcagcatgtgcatttgtacagtaggattgtgcttgagttccgcttgtttgtagagtgtctccacgaacatgtctgcagtggatcgtcctcctatagctaatgcccctatgtatgtatcaatgatgcttttggggttctgcttatctatagccgctccgataactctgttgatagcagactgaggaatcttagagtatacttctttcattcttataggtgttcattgcctgctggaataggtgagcttgcttgaccatttcattgagtcctattaatgcacttcctctcttcgggtagtcttatagggggaggcttttcatttttgtctttgccgatccttcggaactgcggcctaaaatctaaacctttcgatagtgatactatgatggatctgcagctatgtccaaatcagcgtttttctttctggcttgtgcaatcttgagcttcacctggtgtttacggatcagatcatcatctcccgcttatggtagacaatacagattctgctgtattcaacctgtcattccttcgatccataagtgagtacttctgctggttcaactccgctttttgttttgccacttccgcggcttcttgagtacgcttctcaagctgctgcgcctgttgaagtgtgtccataaagtgtatatctaaaacgaagaaggctcaaggaggtgtatcttttagcaaggctggataccatgtgtttgtgcacataattgtaatcgtatgtatccccgtatatttattaacgttgccaggcttcttattgcgtttcttgtcatcacagtattagcgtaggagctgatgattaggtggacttttattcagcataagtgaatgagcctaccaatcgaaataacagtataactaatcaagttatactgtacaatagggggatactatgccgatatcaagaaaagttaaaaatggtagcttggttttgcataccaggcatagaactaagccggcctcaagaagacagtcctctcgctcaagcggtgtgatgatcgttccaccccctccaggatccagatcgcagattcaagcagagatgacggctttacgccagcagctacgagactctcttgggccagaagcttacgatgaaagaatacgtgaatctaacgagttattcaaaaaaaataacaggccaagaagttcgctaatagcgggcttctgttttgcggtcaatcggtatcaggtaggcttttttagggcagctaacgctgcctctttctttttgtctaaattcactcttggaggttatggaagatgcctatatcaattgtattcgatgatccattgaaaaaaatgaacggttactccaccctcaatcccaaaacctttgcctcttggtgtccatattttttgtctgggaacttcgacccttggacgaagcttctaatggttgaggattctttctatttgcaggagacagagtattaaccaaggttacaaagaatgagtccgggttgtaagtggattcctatcgtttcctctgaaaaattgtttatgcctaattacagaccctaacgactcttaaatcatcttgaatactaactgaggaggtaaatgaattgtcagcactaatagttgtccaattgaacaccgagaaggatatccaaaatcagctggatgtgattagcggattcgcgggtttattaaggatgttattatagacacagctgaggatttgaatgcattaaaatctacggtagattcttatgtgaagcttatgcccaaaagccagttacgtttgatgctacgtcagctattgattgattgtaagctcgaagctgatactcagcgtgaagcaaaatcaattgatcgattttgggtttaatctcgaccatgcaagaataagtgtagacccttgcttggtttggatccatctacgatggcatctattccaaagatggtgttgaacatggatattctaaaggcaagctcgcgagcaatttagatacttaattcgtcctgttgagaatcagtttgctagtgtggtgaatagatgaggagctggcgaggttaatgtcaatcaagggaccacgttcttcaagggcaggtttcgactgaagctactatttcctttcgctctctctggcttcctctcctccaaaggaactacgatgaatagtcctttatgttttgaagttgcactacaagtcagacattacaaaagccaactactcgctatcctaattccgccagtttactgtttctccatgagtccgatagtcttgagcaacttgtatcatttacatgtttttgacgatttggttaatctttttcagttttctttttatgtgaatcctctggctcctgaaaaaaagtttttagatgcttttggtttctcatgtataaaacaccctgtatatattatataccggataacttggggtaaatgaacccaattcctaaacattcaatcaagattcactccatgttcctgttattgacagataaataatcatatctatactctgatataatacggaatttgctggtgtaaaatgcataaataaatgataaataacacgtttggtgctcttaaagaatctttcgcagaatcagaggattcatcagtaaacttcaaggtgactcctcatccattcaaagtctagatcatgaagtcgtggttgcttgtttaaatcctctttcagcctaaattcgaaacgtgttaaagctgaagttggtaaagtgaattctttttcttcttgctctatctttttgtcataatggagaatcatgcacttacttcgattgttaccatagtaacagttatcattatcctctcttttgttgatcgtagtattttgaaacggtttatagaaggaacgcctcattggtgtctgaaaatcaaaagctatatctactcgcctcatcttccaagaatgcgacatgccaataaaattcactaaagtagtaggaactatcttcacttttgctggattaaataagatcattacgttgtaattcttatatgctgagatgcttgtgggattaatgttaatttcatattgtggattagttgaccgatatacgttataaaaatattttgtccccttgttaaaagtacccatgcttaatataaacttgatcttgtctctttccatacgagtaactaactgaagcttatcaatacagattgatggattcataaaatctcccttcataagtaggcatgacccatgcaagcgggccatcactgtgttattaatatttatacctgaaatttataaatctctcaccccatgctaatctcaacccttctcactcctctatcatcctactcctttaatcactggttcgtgtgccatctccttaccacaggtagttttttacgatattccgcgttttttctaaagaattaagaaaagaatttatttacttgattgatatttccttggcggcaatgcagtgattgcagatattatcgaataagatcggttatgtaaacaattattatgtagcatactgaacctagttttatggatgactatagatgaaactgattggttgaattttgttgaaaagtaagtagtactgtttgtaatcatcctgttatctgctttgactctagatatggttgattagttagtcattgtgctgtagtgctttcagtctgtattcattcacatttttcttttaatgcaacaaataccggcaacaccctcttcctatttctgaagtctcattgtatctgtttagaactgatgcagtgatatatctgccatcgtccaatccttttacttccttcgaattaaaaaacttcatctcaaaacaaaaaaacacagtattctttagagattttgagcattatttcaattccatacgcattactgcatagttcgatgttgtcttggtctgtcgtatacactcacagtcattagctacaacccacattctttgctggttttgtcggtatcacgatacaataaagtacatcaagattcacacaaatacacaagaatgaagggtgattgaaatggcagtatcagtttggattacggagatgtatccgaagcatggaattttagcaatcggtgatgtaacaatcaatgccaagagaaaaataatgggagtacagctagcaagacagctaaataggcacaattataagatgattattccgaaatcagcaggagaaattgatacagatttgcaagagagaataattgatacgatggctcataaatacgaacagagcagtaaattctatcaaggctgtcgtggaagtgaagaaactattctcaacaaacatcgtaattattcacgttttaaaacaacaattactaatagagttaaaagagagtactaggaggaatcacacatgaatacagaaaaaattattaatgtggagggctacccaattattttaaaggtaacagaggtggcggaaattctaggtatatccagaagagtagcttacgatattttggatcgtaatgggtttcccttagtccgtattggacgctgcaagcgtgtatctcgcacagcattttttaattggcttgaagaccaagttgccctcaaaactgctagcaattaaagcactccaaggtaaaattaaacaatagcactcgaaggagctaaccataatgaatactacagatctctcgaaagtatcttcaacaaattctaatcgcaatactcttacatttaatgaagcctggaatgaagtttttgatcgtgctatctcaaaagataaattgtactccgaggtacgagctggacgcatatcacatctaaaggtaggtttaaaaattctcttcaggaggaatgtgctggagtcttggtttcatgaacaagaggctattaactattctggcaagagtaacgtctaaattcatcaaataaccagcagtatccccctcgtaatcagttgatacaaggggattttttatcacataatttaatggaggtatttaaaatggcgagtatagaaaaacgtggagaaaattcatggtgactcttagttgaagccggatacgatgcaggaggcaaacgcctgaagcgttctaaaacaatcagagtagaagatctgaatttgctaaaaacaaaaaagcgcttaaaggattatttgaacgacgaacttgtaaaattcaagatagaggtggaagccggcgagtatattgctcctgaaaagatgaccttcgaagcatttgtccacgagtgggagctaaaatacgcccaaaaacacttggccgaaaagactttatatacttaccgttcaaacctaaaaaatagaatcttacctacgtttggtcatttgcgaattgaccaaattaagcctctccatatcgtgagttttatatattcacttactaaagctggttcccgaatgggttttagaaaaggagatctgtctactggtactattgagattaatcatcgtgtactcaaaaatatattctcaagagctgttgaatggaagcttatcaagcagaacccagttgctggagtaaagaagcctgcagttaaacataaagaaatagtcccgtacaatgaaactgaaattcaagagttgcttctcgctctacaaaaggagcctattcattggctttgcatggtgacactcgctctcacctccgggcttcgtcgcggtgaattgctcggtctggaatggaatcatgttaactggattactggaacaattgatgtagttcaaagcgtttctatgtctcctgcaggcatagctcatgtaaaagaacctaaaaccagacactctaagcgcaaagtagcccttcccgcatccgtgttgaaggaactgcgagagtatcatcagtataagttagtggaacgagagaaagtcggtgatcgatggctaggtggtcaatataatttcatgttttgccatccagatggtaaggcattccaccaagaacgtccatatttatggtttcgtagctttctaaagaaaaattcgctgcgttacatatcatttcacacactccgtcacactagcgcgacactgctcatcaatcaaggggttcatgctaaaattatttcagagcgtctcggtcatggtaatatacaaatcactatgaatacgtatggtttcgccatgcgctcagcagatcagtctgcagctgataagttcgagtcgatatttataaataaggaaagcgataaataaagtaatcaagttactacctgttattcattttcatacaggataaatttatatgaggatgtgttaacaatgcattagaatgagatcaacaatttatccgcagagacaatattcagttcgtgaatttagtagctttaataccagaaaatccaaaataaaagagacgtgaataacccacgtccccattccgtccccaacccaccctcacactactcacaaacccttatagatcaaggaacaaacagcctccacatgaaccgtatgcggaaacatatccacaggctgtacttccactgtactatacccgccatcctccagtatccttaaatcccgcgccagtgtgcttgggttacaggatacgtacaccacgcgttctggcttcatctccagaatggtgtcgagcaggcgtggatcacagcccttacggggcggatcgacgacgataacgtcggcggtgatgccttgctctttccacgcaggaatgacgtcctcggacgcgcctacctcaaatttcacattgcgcatttcgttcaacagcgcattgctccgtgcatcatcgatggcttctttgacgatctcaaccccatacacctgatccgcatgctgagcgaggaacaaagaaatcgtgccgatgccgcaatacgcatcaattaccgtttctttgcccgtgagcccggcatattcgacggttttgctatacagcacttccgtttgaaccggattcacctgataaaaggatctcgcggaaatcgcaaactggacgtttccaatgtaatcgtagatcacgtcacatccccacagtacacgagtctcgtcgccaaaaataacgttcgttcgcttcgtattcacgttctggcatatgcttgccacgtgtgggatatgctcacggatactgccgatccacgcatctgcatgcgggatatctcgcccattcgtcacgagcaccagcatcatttcacctgtgcgaaaagcagtcttcaccacaacatggcgcagcagcccacgtccggtttcttcattatatgcgctgatgccgagcattcggccaatctctttcacacgtgcgacaacttcgtcattgcgttcatcctgaatgagacaagtgttcatatccacaatgcgatggctgccacgtgcgtagaagccgccgacaagcccaccttcggtgacaccaatcggcacctgggctttgttgcgataccgccacggctcactcataccgagtgtaggatgcacgactacaccttgtacacgcgacatgcggtctgcatttccatccgcagatgcagccaaaacctgtccagtatgctcactggactccgtaaccacactcagcttcccgatacgctccagcacatccaccacatgctggcgtttccagctgagctgcgcttcgtagctcatatgctggatctgacaaccgccgcattgatcgtagatggcgcacggagctgcaatccggtcggggctagcctgcgcaatatccagcagcttggcatagccgtactgctttttcgttttcaacacctttactcgtaccttttcccccggtaacgcacccggaacgaaaagcgtaaaaccctcaacacgtcctacaccctcgccatcgtggttcatgccgatgatgtctatcacggcctcatcgttcttttgtacaggcagatcggtacgctctgcactggatcgaatacgattggatggagttgctgttgctgcattccggcggctttttccacgtccgctacggttattcgtcatgattgtcacttctttctgatcttctttttatgcggtattttctttcggacgtctaatttgaacgttcatctaaacatacaaacatcaactcgaaaatgccgttactccccacggagaacggcaagaaccaatatgttcacacaaaaaacaactacctactctgcattccatatactatattgcattgccgcccggaagcggaaatatttcctcatcattcctcaccggaaaacattcaaatgatgcggtaaattccggaaagtcgctggcaaggtgccccccaattcgccatccagattaagctggacatagccgggtgaggtcacttccatgtaatctgttttgaaataaacaattttcttgtcctgcaaatgctcaccacgcagcgcaagggttaccaatcggatcatttccgccagattgcatttccgtacagcgatgacgtcaagcagcccatcatctattgtcgccccgggagcaagcttttcaaacccgcccaccgaattcgtattcgcaatcaggaagagcataaactcgtcgtggatcacttcctgacccgatgccttgatgatcagctcctgtggagcaaggctgaccattttctccatacctttaaaataatacgccaactggccaatcatcgtttttagcttgctcggaacttcatacgtaagctcggttaaagttcccccgcctgcaatgttgataaagtagcggtcgttcgcttttccgatatccagtggcttcggattttgacgaataacgaggtcgcaataatcctcccagtgcttggggatgcccagtgctctggcgaaatcattcgtcgtccccagaggaaacacacctaggggcgggcggttttctctttcagccatcccgttaatgacctcatacaatgtaccgtcgccaccagcggcgataatcatgtcatacccacgctcaatggcctctattgcggcacgcgttgcgtctccttcacccgtagttgcatggcaagaggcttcaatacccccttcatccaggcgctgcaaaacatccgcaagacgacgcttcatttcctcacgcccagaggtcggattgtagattaatctagctcttttcattccgttacgccacccgtatatttaatgatatttatattcacatagcagttcatcacattcagtctgtacaaaatatcatcatactggaaaaagacctcttttacaataaaagaagccagactttgcccaaataaggaaatttaaggctaagatgacgctatagccgaaccagactacctatgactttaccttgcttgcttctgcacactttgcaataattcacgaatttgtctatccatccagcttgtgagcaaaggatgcggtaataaagggtctcctgaataacggtattcgagtccctgcaagcgtttaggaatcatacgacttgtaaaatatcccgaactcaaaaatagcggtgccacaataacatcatgaccccgctcttgattccaatacgctgccttgtcgtacacactctcgggatttagcaaagcgtggtccgtgatgataccgctcacgctttgcaccgtacgggccaacgaagaaatcccctgctcccaccgctgaaaaaagccgttgtgcacactgccgtgacctacgagtaaaataacctctctcgcaggatcggaagatagcgggcaaaccttgtcccacaccatgcgggcaacatcttctccgtcatccagcgggctgccaaaatgcacttgcgccttcagtcgaaacggctctaaatctgtttctttgtccggcgcatctttgacacccagcgcatagctaatctcatctacatgcgtactgcctgatgacacaaacaaaggtataaccaatatatctgttacacccaaggcttccagacggtcaataccattttgaatcaatcttcctttaaccgtttccaaaaatgaaacctctatcggcatttcttccgacaaatgaagcttcgcaactgcctgatccacctgttccacccaatatggctccctagagccatggctgattaccagtatcccagggctccgcattagcgtcccagacgttccagagtcattttgtacccgtcattaccatagttcagacaacgtttaacacgtgaaatggtagctgtactggcccccgtctctgcttcaatctgattatatgtgctgcctttgcctagcatacgggcaacctctagacgttgggagagggattgaatttcattaatcgtgcacagatcatcaaaaaatacatagcactcttccaaatttttaagagttaaaatagcttcgaacaattgatcaatacttttatcattaagctttttaagctgcatggattatcatctcccaaggttacgatctctcctcattgtacccgaggaatagtcggtttttcaagcattaacggtttcacgcattacagaacaacattatgaccatagaaacgtaccgtacgaatgcccaaatccgcttttatacctgattttcgggacacgcgcctaaacccactgtgcgtttgtaacatacaatagagtatcaacctgcaaaggaatgtgatctcatgcctggacactactatcatcggaggccgctacagcgttccctttccgatccgtatagttcatctccttatcccggactcgatccatacaacgaggttccgcaagccggttcttccgggctggttccttacgaggcgccagcgagtattacggattctgccgtggtcacaccagacccggttccagccaaaggaggactgcttggggggcttggcaacctcggtaatctcaacgaaatcaaaggcttcattgaccgtatgggtggcattgatggaattgttgctacggtcggcaaggtgcaaaaggttatgtctagtgtgcagcaatttgctccaatggcgaagctgattatgggctcgctcccagcattcggcaaatccgcgagcaaaaattctgccaccgatatcaccgaggaattggatgaatacacaccaccacgcccacgccggaaaaagacgcagcgcaaaagcaccactaccccgcgcagacgtccgcgcaagcgcaaaagaaagtagattatactatttgaaccagcctcggcgcataaaccagaccaccattgcaacactcaacaaaaacatgaagaacagtacgccaaaatatccatatttccaggtcaactcgggcatattcgaaaaattcataccataaattcctgcaatcagcgtcaagggcataaagacggtcgtaattacggtcagcgtcttcataattgaattcatacgattggaattgagcgatatataactgtccctcaggtcggctgtcatctcgcggtcggcctccagcatgtctgtcagcttcaataaatgatcatatatatcggtaaaataagccatatgatctccttggccctgcacatgctgcgaattcaaaactcggtacatcagatcacgcataggcacgatggtacggcgtagcttgagcagcctgccacgcaggtcaaacacctgcttcattaattcctctacggattcgcgaccgcccaagccctccagctcggccaattcatcctcaatcataaaaaggctcggaaaatagttatctaccagcttgtccatcaccgtgtaggctgcagacagcggccctcgcgaccatattttacgttcattcgcatgctggacaatccgctcccaggcttgatccagctcctctaactcatgatggtgatatgtaaccaaaaaacgactgctaataaacatatccacttcttccgcagctaacgtatctacatcaagcgcatgcacgaccagaaactgcacatcctcgtaataatccaatttgggacgttgcagaacatgcatacaatcctccacagccaatgggtgaaaatgaaaataactcgtcagcagctccgtctctcgatctgtaggctcgctaaaatctacccatatccatatgtaatcctccatgacgatctgatccaatggttttcccactgttacctgatgatcatgacctatagtcaatgtacgtatcaccgtacgtccccctcgcttacacttcgcgtctgttatgttatttatattttatataagccaattaacattataccaatctcaagtcctgtattccttttaataaagaaaaggatatctccgggccaacatgcctcccaagatatccttataaaacaatcaattcattataatttaaatcttttttacaaatcctgtgcttgtcgcttcatatcctaatcggcgataaaaatgatgagcatcctgtcgctcacttcgattaccactgttcaaagcaatggcaaccaacccgttctctttagcccaagcttccgcttcctcatttaacgccttcccgatgcctttattacgatgttttgaatccatcacaaaaacgacgatacgcgcgtaatcttcatttctttcataaaagatatcagcatgtagtccaaccatcccaacgacttccccttcatcttcagccaccagagtatggtagttagggtcagaagcgatacgatcatatctcatcttcatatcttctacagtcgtaggataaccaagctcttccatcagataagccaaagccggaatatcctcatgatgagcagtccttatcttcaaagcaatccctccacttatgaaaagaaacatcaaaaatgaaaaatcactcgcgccctcttcccctgcacccactcattcaaaagtgaggcaggctctttgcacgaaaagggactactcagcgagcagtagcgtagcggtccatttgaatctgtagaagcggcagcgttcgcctttgcctctgaattttcaccttataaggtcctatacaatccaaaaattcaggggcaacagcgatcgaaagatcaaatggatcgcggagcgtcttacaacgagatccccgcctacaaacacaaaccctgcctcacttttaatcctcttacaataccttctccaagaaactaatagtccgctcgttttttggattaccaaatacctcttgtggcgttccttcttctacgatgtaaccaccgtccataaacacaacacggtcgcttacttcgcgtgcaaaacccatctcatgcgttacgatcatcatcgtcatgccttcacgcgccagatctttcattacgcccagcacttcgcctaccatttcaggatcgagcgccgaggtaggctcgtcgaacagcataatgtctgggttcattgccagcgcacgtgcaatcgccacacgctgcttctgaccgccggaaagctgtcctggcagtgcatttgccttatcggccaaacctacacgatccagcagcttcatagccgtttcccgggcctctgccttggactgtttccccagttcagtcggcgcgaacataatgttcttgagcacggtcatatgcggaaacagattaaagtgttgaaataccatacctatattttcacggactttgttaatgtccacgtttttgtcactcaagttgtagtcatcgacaatgacctcacctgcggtaatttcttcaagcatgttcatacaacgcaaaaacgtacttttccccgaaccagaggggccaatgacacacacaacctcgccttcacgtacttgcatatcgatgccctttaatacttgattactaccatagctttttttcaggtttttaacgataattttacccacggcgaactctcccttcgagacggttggaaattttggtcagaactgtaatgacgataagatacatcaccgctactaccagccaaatatcaaaggattggaatgtccgcgcaataatgatcttacccgattgggtcaactcgaccagaccgataacagacaaaatggacgtatccttcaacgtaataaccaactgattgataaacgacgggatcatgattttcacagcttgtggcaaaatgattttaagcatagccgtccgatagggtagaccaagcgaacgagctgcttccatttgtcccggatcaatggactgaataccaccacggataatctcagttacatacgcacccgcattcagggataatgtcagtacagccgcgacaaaaagcggcattttgaaatccagtgcctgtggaataccaaagtaaataaagaaagcaagcacgatcagcggaataccgcggaatatatcgacgaatacagttgcaataccacggaacaccttgttatggcttactttcataaagccaaacaccaaccctaggataaaggctacgagtaaagatacaagtgtgtacagcaacgtatttcccatgcccttaatcagcgaaggcagcgaagcggaaatcagtccccagcggctggtctctacaggcgccacacctttgcccgattcgccaagatatttggccaaaattttatcgtattccccgctattgcgcagattaacaagccctgcattaaatttctccagcaactcctggttcttgccttggttaacagcaaacccgtaagaagcacctttttccttatctgttaccaacttaaggccgttattttggtttacaccgtatgccagtaccggatagtcatcaaagcaggcaaccgaattacctgttttaacttcatcatacatttgagaagaatcatcgaacggaactgtagtaaagccgtatttggccttaatcgattctgcgaatgtgtaaccttccgttcctgttttgacagcgacacgctgtcctttcaagtcctcatagcgtttaaccgtatcattatccttgcggaccgccatgacgacgcctgaatcaaaataaggctcggaaaaatcaaatttccgcttacgttcatcggtaatactcatcccggcaatgacaccatccacttgattcgtttcaagggcctgcactgccgcgttaaagccaagaggcttaatcgtatattcaaaattctgatccttggcaatagctgccagcaaatccatgtcgattccgacaaatttaccatttacatcttcaaactcaaaaggcgcgaacgttgtatccgtgccgatatcatactttgttttattttctgcatgtgccactacaccgaaattaccggccagggcaaccacaaaaaacaaacaaatcatgagtgctattagttttctagatttttgcataatttcctccagtcagttgaacggttcaaagttttctgtttattctacaggagttattaaaaattgactactttgatgtcaggtatttttgaaaaacgtttcatggaactatctggatgtgtaaactttgaagaaagttttgccccagaatgccaataagcccctgccgcaaaaagcggacggaagcttattgtgtattctatagtgtgtacctatttttcaagaaataataatgaactagaaaagaattttgaaaatcaatccagataacagcgcagcaatcggtatcgttataacccaagtaataataattcgaccggccagcgaccaacgcacagcggaaaaacgcttcgcagaacccacacccaaaatagccgaagtaatggcatgagtggtacttacgggcaaatgaagcaatgtagctgtgaaaataacagaggctcccgaaatgtcggctgcgaatccgttaattggctcgattttaaaaatcttggttcccatcgtcttgatgattttccagcccccgatagatgtacccagcgccatagctgttgcggctgaaatttttacccacatgggtacttccaaatggtcctgataccccgccgaaacgagtgcgaatgtaataatccccatcgccttttgagcatcattcgtaccatgcgtgaacgactgaagcgctgccgtaatgacctgcattgtacgaaaccctttgtttaccgtatgcggactacgacgagcgaagatgtattttaaaattatcatcacgatgtaaccgacaacaaaagcaatcaacggggagaaaataagtccttcgacaatcccgatgaagccgctccagttcaatttatccgatcccgcacctacatacaccgctccagccaatgcaccaattagtgcatgagaagaggatgaaggaataccgaaccaccaggttaagaggttccaaataatcgcagcgatcagcgtcgcaatgacgatatcaattccattcgtaagcttggttggatcagcgacacttccaccaatggtcttcgcaacgcctgtaaacaatattgccccgagaaagttcatgaccgcagccataataatcgcacgtcgcggggtcaatgcacgggtcgataccgaagttgcaatcgcgttcgccgtatcatgaaaaccattaataaaatcaaatgccagagcaagaaaaataacaatacccaataccagtaaacttgtatccatgtaaaaggactcccttacgagttacgcataatgatggattccagcatatttgcaacatcctcgcatgaatccgttgtcgtttcaaggcgttcgtacaattctttgcgtttaatcagttcaatagggtcagttacagttgcaaacaggtttttgatgcaaatacgcaataattcatccccctgattttccaaatcattcaggcgaatagtgtattcacgaatggccagcaattttttctgtgaaagcaaatgtacagctttctgaatttcgtaagctgattgacgcagaatatcagcgaactgcacaatatactcgtccggctccgtaatgttgtacatataaaaacgagaagccgtcgcttcaagaccgtccaacacatcatccatggttgttgtcagttccatgatgtcgtcgcgttccaacggcgtaatgaaggtcttgttcagctcagtaataatcgtgtgtgtgtaatcatcacacttattttcatacttcttcatttcatttgtaaacaaagtcacatcctgaagatttgaagtatgttgggcaaaataatcggctgcttgcacgatcgtatctgccatattttccaacgtctcgaagaatatatcctttttcttcaatctcataacgattacccctttacgaaaatatccgcaacctgtttcgactgcaatagacaacctttgctatcttatcacactcatcaatgtttttgtaatgtttgtaaaagcaaatttcatgacatacgtatacagtgcccgacatggaaggtcattatccgacaatttcttcctaaaaaggtgtatttcgttttctaatttgcttctatggttacatgttcctttagtgaagtatctgcaggtaccacatgtatataagatgtacctggcgttaacgggatttcaaccccatttttcataaaacgaatcgcatcgcctggtgtatgccgccactcagcctgtattaactgtccttgttgaaacaccatggcctctccactgccgtccagctcaacacttaatctgcctacatcatccaacgttcgatgtctagcgctcattacaataacattggctgctgagagctgttggttattattttgatccatatgtgacttttcgttcacaaaacgcttatattgttgatttgctggatcataggtataagatacccgatagcttttaagcaaaaaccgaatttgcaaagatgctgctgtctcgttcaccataactggggtttcaccggatttaaggtaagaatatactggaacgtccgtctgcttggcataccctttactatcgcttcctttgcggagtctgttcacgtctgtgtataaattatgtggaggacgacgatctttgcttcgccagaagtaagcccctccatttgaaatctcatccagatgttccttccgctgctgctgtaaaatcgcataggcatctgtgcttccccctgcgtgtataggcaacgcaccataggtttcgcccagctcaatcaaatacggtcgaatgctacggaccggtccgatctttacatctccaccatgactttggaaaaaagcgaccagacgggtaatcccgccttctgcaagaacttcatataccatgtctgcctggctaagtcctgcctgtggacgtgcagccggagcattgttaatcatgacagcgagcggccgctccaaaacaggctgctccaccggaagaccggtaagcggagctgtaaatgccggaatagactgctccttcggcggttcaagcgcctccttctctgttacttgcttggtcggttggggaacggaatcagattcacccgtattcgacatagcagtacaagacatcagcgtcatgcataacagagctgaggccatcacacgcaaccaatgatttcgttgggaaatgggcccggacaagttcatccctccacttagttatttttctcattataagctttatttcctgtttttgtcttgattgaagcgtaaccactctatagaatacttatctaaagacattaaaatttaaaaaaatattcagactttgtgatttttatcacaaataactgtaactgaacctactacaataaaggtgtagcaaagatgatcatccccaacaaaatgaatacaaccaacattatagattaagaaagaggagtggtttgaatgtttaacagctggttacgtgaaaacaaagtcgcaatgtggttgctgactgtagtacgggtttatctaggttatgaatggatgacccacggacttgaaaagctgacaggtggattcgatgcaggcggatttatctcgggggccattgctaaaacaggtggagaccatcccgctgtacaaggctggtggggatcgttcctggaagcctttgccctgccgaatgtaggtttgttcaacgtcctgatcccattgggtgagttcttggtcggggttggcctgcttctcggtacattgactacactggctgctttgatggctatggttatgaacttctcgttcctgttctcgggtacagtaagcaccaatgcaatctacctgctgtttgaaatcttccttgtagttgctggtgcaaatgccggaagaattggctttgaccgttgggtactgcccttcctgcgtggactgtttcgtaaaaataaagatacctttccagtggaccctagtcgaaaaatagcttaaacatccccaaaataaccgttatcctccgggataatggttatttttttgcgctgttatgctcacgatacacgtgccttctaattaatcgaagacgaaaatacacaaaagaacttccattcccacacaccatgtggattcggaagttctttttttacatttacgtatcactttcttgaccaaaagcccaacaattgagacttaacgagccaaggacatacgattgaaaaagcttacgcgcggagcgctcatgatccgcagcccccatcgcataaaacaaaggtgaaaaatgctctattccataagaaggtaccgcctgtttggcatatggagccttcttgtcatattggaataggtgacgcaaattccagtcttgaagctgctgtgcaatccagtcatcatattgaacggcccaatcagctggctcactcgtctgcttgagtgtccgcaagttgtggaccaatccaccgctaccgataatcaaaattccttgttttcgcaacggcgccagcatccgcccaatctcgtattgctcctggggagcgcgccgagaatcaatggataagggtacgaccggtatgtctgcatcaggatatatatgccgcaaaaccacccatgctccatgatccagtcctcggttccgaaccggctggtggaacaggttatgctgactgaacagatgctctatctcctcatacagctttggatcgcctgatgcagggtaatcaattgagtacatttcttcgggaaagccatagaaatcgtgcaacgctgcatgctgatcatccgcgccaatacattgatcggggctatcccaatgcgcggaaaaaatgacaattcctttgggtcggggcaggctcgcgcccagctttgcaagaaagctggtatatgcgttattttctacagccagtgtcggtgaaccatgcgcaacaaaaattgagggtaatgtcatcgctgccaacctccacacgccagtatagtgttactcttccattttactccggcggaggcgcaatttccaatacaatccgttacacactgaaatcagatcatccagtgctgccaatcccgttgaatattttcctgttcatccagccattcaagtgttcgatcgatcagccgttgccgctctttacctgacgagaaagtgtgatctccctggaaaataatctctttatcacagcgtccctctggacgcatccagaatatcttttgaaacagaaatgcataatccacaggaataatatcatccgaggtgccatgaacaacaagcacatctccgttaaatttaacggcctcctggaacggttgaaattgagctaacgactcaaaataagcaggcgtaaacttatagcccaaatagtcggcatgaccggttttaacagactcatcgtacacgcttcgctccgtaattttgacgatgtcgttgaacgggtagcccactgcggaccaaagaaccagattttgtactctcttgtcccgtacggctgtgagaagggcaactgcgccccccagactgtgaccgatcagcgtcaccttggtcgggtcaatgtccgcgcaattgacagcgtaatccaacacggtacgtgtctgattaatcatggactctaacccctgcttgccatattcccccgtgctttctccacaaccggcaaaatcaaagcgcaggacaaagtatcccccttcggccagttcacgcgcagtcttgacgaataatcgatctactccgatacgattgcctacaaaaccgtgacatataacaacgagaggaacccttttctgacgatctccctcatttgtacggtttggataatgaattgttgctgccagttcttcatgttcaaagcgaattccaatttgccgttccatcctgattccccctgtttcaagcttcactacacatttatgaattcaaactcatatcgtaacgtgggatatccatccaggatattcattcactttaattccgataagattaataagattttataataaagtcagtctatcatcgccctgcttccttgtcaacctgtcagttcacatcgtaaaaaaagtaaacaaatagcgctccccgatgcgattccggagaacgctatactacatttattagagtgaatccactacattaaagtagacattcgttattcgtagctgttcctaaacatttggtgggtctccgttcgtccctcccactccagcttacaagaggcgccgttatgttcatcctcatgccacaggctgcggtagttctgtgcacctagttcacccgcaaattctgtatccttagccacttcgatatcgtccagtatacggtacgttggagatgatccttgaacgctccggtgactcacatttgtagacgaggccaccccgctattcccgttcgaagcgtttgccagtcgtttttggactgaataatctgcctggttctccagtttcatgatgccacaccctcttaacgtttatattcaggttgctctatgtgctcaccctgtatccagtttgaggagaatgcagcggtaatatacattttatagataaagtcttttgccatccgacgcttcctcacgtatactgtctttgttacgaaatggcggttccatcagcccgggatacgctcataatgcaggaggaagaaatgaataaagcaaaaaattatacgcttattgcatggattgccttatctatgtttttcttgacacaggcaattatcggatggtttgtcacctttacaggtggggatatcaaaccctttgaaaaaatcagcctatccacccttatcatcatcgccgcaggagccattctactcgttgaagctctgatgaattttatggaccgccccgaagaaggcgaggagacacaacagccagaccatgcccctgtaaagccccagatgaatcttaaatccatcttgatgtatgttgtgttagttgtcgtgattcttgtcgccggactggctctgcgcagtgtactgccagtattcagaatctcaccttgggtgaatttaattctcgccgccattggatttattggactcaaaccgatttttctccgtaaaaaacgttcatagcccgcaattctcattatatggagctgcctcattttggatcgcagcagctccttttcatttcgatcaggcaaccgacttacagcatgggtgtgcgccaaaaagccgtattcctggcctgcaagaagctgcatgggggaatacggcttgatatactttagaacttatttggaaaatagttgttctgcattatccagagcaattttatgtcccgtcgcggaatagtccagccaaggctgtccgtccaacatgtagacatgcccttgcttcaccgccttgagaccttgccatactgtatttccttccagctgcttgtataccttttgggcatccgcgcctttactgatgataacaaggatcgcatcagcatcataatccggtaaaacctcttgggaaacaacctgataagccttgctgatcttttctacacctttggctggcttcaagcccaagtcctgatacaacagcggtcccaccggacgcttcatccccataacacggacctctttcgccgtcacacgtacagccataaccgttccgtccccaatttttgaatgaatcagctttttgactcgttccttctgtgtatcatagtcttttagaaatgcgtctgcctgtgcttcatgtttgaccataacggctattttttttaattgatccttccatgtgccttcatccagatcaaaaacttcggttggcgcaattttttcaaatttggccacatcggttcccgaatattttttgtccaagaaaatatgatcaggttgaagctccagtaccgcttccatatccgggtctgtgacaacacctagcttacgggtattttgaagacgatcttttacatggggcagaaaatccttcacatctccgccaatgaccgaaccagccggagtaatgcccaatgccagcaggttgttcgtcaaatgaatagacatcgaagcaatacgcgaatccgcactaatggttgcctgcgcattgccagccgctttcgtatcggtagcctgcttgtcggctgcttgtccgcaagcggacaacatgatcatgcatacaacaagagttgtgactatccatgaacgtttaaaacctgaaccctcaaatttgtgctttctcatgattactctctcctatgccacagaaactctacattataatgatcaatatagaaggcttctacttagttattaatttcagcgggttgtatcatttgtaccatatgatttcatatgtacctattccttctgtcattttgttcgggacagcaggaataaaaaatacggagctcctaccacagcaaccaccacacctgcgggaatcgcattcggctgaaacaccgaacgcccaatcgtgtcagcggtgaccagaatgacgaccccgaccaaacaagctactggcagcaaatgctggtacatcggcccaaccagacggcgagccagatgaggtgcaatcagcccaataaaaccgatgcccccggccatggatacgctggcactcgatagagccacggctacgcccagcagtaataggcgctggcgcttcacacttgtgccgattccagctgcggtctcgtcgcccaacgacaggttgttcagactacgcgtctgcgacagaacgtagggtaaaacaatgattatccagggcagcaaagccgctgcatgtatccagtcccggccccaaacgctgccagccaaccaacgtgcagtaaatgcgtacgtatcctcatccaaccgcaacgaccaatacagcgttatggcgctaagacccgaggctacaccgatgccggacaaaatcagacgcacgggcacgattcctctgttgcggctataggacaacaaaacaatcagcacggccgcaatgacacctcctgcaaaggtaaacaaggggatcagaacggcggctgatccgtccagatcgcgaaaaaagctaacgaacattaccagccccaacgctgcccctgcgtgaagtcccagaactccgggatcagcgagtgcgttccgtgacaagccttgcatgaccgccccggctgcgcctagtcccgctccagccagcaccgttacaacgatacgaggcaaacgatactcgaacagaacaatatgatcacgtccactgccaccgccaaacaacgtatccagcacgcgtagcggtggaatacgaatggttccggtattcaaacccagaacaatgacaacaaagctgattcccgccaataccaaacagacgagccaagcctttgtcgttcttgtatccccggtccctaaagagcgactcactacaaatccctcctttccttacgggcgagaaagaggaaaaagggcactccgataaaagacaccataattccgatagctagctcctccggcggattcgccattctcgctcccaaatcagccagcaccagcagcacggctcccaataacgcagacaacggtacaatctggcgataatccacaccgatcagcttgcgagcaatatgtgggataaccaaacctacaaagccgatggccccggcagccgatacggacagtcccgccagtaccaccacggtcagcagacccaaaagtcggatacgcctgagatttaacccaaggtttaacgccacctcatcgcccatcgatatcagcgaaatggagcgggccagccccatagaccaagcgatcacaataagcaaaattggtgcaagaatctcaagctgcgaccatttgattccggcaacaccacccgcataccagaaggctaaatcctgacttagatcaaaataaatcgcaatccccgaagtcatggaacctaacagggcagccgtcacagctccagacaccgttaatctcatcggtgtcaatccccccggcgcggaagctcccagaccgaataccagtaaggtactcatcagcgcccccaggaacgacaatacaattaacgtcccataaggtagatcgggaaaaaaggcaaaactcacagcgaccacaaacattgctcctgcgttaatgcctagcacacctgtatctcccagcgggttgcgtgtaataccctgaatcagagagcctgccaccgccagcgcagctccaataacagctgcacccagtacacgcggtaatctcagctcgtgaatgatctgatgtgtcattagcgaacgatcatagtgaaatactgccgaccacacggtgcttacgttcaagtccttggctccgagagaaatggcggcgaatatggccaaagccaacaatacagccgaagctgtaaacaacaacgcctgccgaatcctacccgctcgaagcactggaggtgctgttatgactactttaggaacttccctctctgtcagatctgtatgtttgtccatgctgtctttagactgcatttggtgaggtcactccctccgtacctgaaaatcatcacatctctcataacgataatgataattattatcaacttgatacataatagcatgtttctatgacattgcaagccaaaaactgttccccttaggaggaacagtttttgaatatatctatatgattttactacacaggtgactccaaacggtactctctttagtacgtaggccagcctgccgaatcccatttcaaatcactaatcagaagctttggatttccaccatcagtggcatcataggcatgacgtgcaatcacactgttgttatagacagattgtccacccggtcccttccaacggtcattccccgcatccagtatcgttccaccaccatctatcaagcttttgccgctcttgtccacatacggtccggtaatactagtagagcgaccgtaaataatcttataattactgtctacgcctttgcagcagttatcaatggaagcaaatagataataatagccgtcgcggtatgtaacatgtggcgcttccaaaccaccagccgtacgcttggcgatagaatagatctggcccgtaggcttcatcgtatttttgtccagtcgagtcactttcaagcctgaattccatgaaccaaaggaaagccacgggttaccagaagcgtcaatgacgagattcgggtcaatggcattgtaatcgttagcatccgtcgtacgcaacactagtccatcatccctccagctccccgcgccaatgctcgttgcggaggctagtccgatagccgaggtccgggcaccaaaagtagaaatggaatagtacagccatacccgtccattatacttttgagcatccggtgcccatacatcgttaggcttttgcttaggtacatacgatttccaccatgatggcggcgacaggaatatttgcggcaatctgtaaaaattacgtccgtcgtccgatctttgaacctgtatcccctgccctgtggagaaaatataccatgcgttgccttccttcgtaatggacggatcatgcactgccacatcgccagttaacgcccaatgctctgcggatgcagatggcatcactgacagcattagagcagccgaggttacggcagcaaacgccgttcgggtcaatttactctgtactgattttttccatactttcaacattccttcgcacctccgaatgagtatcttataatgaaattcaggtgacacacctattacattagtgtttatacttatgaagttacccatatattaatctatcatattcacttttgtaaacgctttatttcaaataaaaagaaatttataaactatgcattatacataaaaaggagcccgtaggctcctcttcaaattagcatattaaatagattttcgtttttgttcagttccgtatatttaagccccttgcggttcattcgttcaattaaaggaagatagtcttccttgtggaacagctcaatgccgacaagagctggtccattttccttatcattctttttcgtatattcaaacctagtaatatcgtcgtccggtccaagcacatcctgtagaaactcacgcagtgccccagctctttgtgggaaattcaccataaaataatgcttcagtccttcgtaaattagggaccgttccttaatctcctgcatacgatctatatcgttgttaccaccgctgacgatacagacaaccgttttgccttgaatctgctcgcgatacaaatcaagtgctgcaacaggcagtgaacccgcaggctccacaacaatcgcattttcattatacagttccagaatcgcggtacatgctttgccttccggtaccttcacaatatcgtccaaggtgtgtttacaaatatcgtatgtcagctgacccacacgcttcaccgcagctccgtcaacaaacttgtctatttgatccagtgtaaccaccttgtgcaaacgcatcgcttccgtcatcgacgccgcgccgaggggctccacgccaattaccttggtggacggactcacggttttaacatacgtacctacgcctgccgccaaaccgccgccgccaatcgttacgaacacatagtccataggcgtatctaggctctccatcacttccatcgcaatcgtaccattgcccgcaataattttcggctgatcgaacggatggatgaaggtcattgcctgctcgctgcacaccttcatggcctcatcataagcatcgtcaaacgtgtctccagtcagaatgacctctacactgttaccgccaaagcgacgaacctgcttcaccttctgattaggcgttgtactcggcataaatattttaccgtggataccaagtgcgttacatgaaaaagccacaccttgcgcatgattccccgcactcgcacacacgatgcctttttccatttgctcaggagtcaagctgcggatcatgttgtaagctccacggattttaaaggaccgcacgacttggagatcctctcttttcagatacacattacagttatatttggccgataggacggcatccctctgtaaaggtgtacgtacaatcacctcacgcagcatatgatgcgctcgtacaatatcctccatgccaacggctgacgccatggccgggtcagttttctgggtttctgttggttccataggttctccacgctccgcctgaatatttctgtatttgaaatctttcaaatatcataccacgtttacccatagcttgtgcagatgatagtcatgaaaatgagaatgaaaatcaatcgaatctaaaaaaaggcagaccgggacaatgcccgatcagccttttctgacgttgcacatttcttgtactccgttgctctatttaatacctttccgattatccttttactccgcctgccgtcatcccttcaataaagtaacgctggaagaacaggaacacgacgagaatcggtaaaatagccaaaacggaccccgcgatcagcacatcataattgttgccatatggcgtcagcagactggacagtccaattggcagtgtcagcatgtcgttggtacgcaatacaatcatcggccagaggaagttattccaactgttcatcgcctgcaaaatagccattgccgcaaatgcaggcgccatcagaggcatcataatccgtacgaaaatgccatattctgaacagccgtcaacccgcgcagcatccatgaagtccttgggaacaccactcaaatattgacggaagaaaaagatcgggatcggcgcaacgacaaatggtagaattacaccccataccgtattgatcagcttcatgccgatcattagcttgtagagcggcagcatgataatttctaccgggatcatcatcacaaccagcaccagtgtgaaaatcacatttttcaatctaaaacggtacatctccagaccataacctaccatcgcggacaatatcagacataacaccgtaaacaagacggtaatgacaatactgttccagtaccattgaaaataatccgtcgtcccctgaaagatgaacgcatagtttttcagggacatgatgtcccactccagcttaagattcaatccgtagcgcaatagctccgtcgatggcttgaacgaggcaagcgtcacagcaaatagcggaaacagggcaaacccggcaaacagaatgaataggacaacgagcaatgcggataacgagcctttttgtttctgagccatcgcttaatcctccttccggaacatgccgaaaaatttgagctggatcaggttcagcactagtgtaaatacgagcaatacaatgcccactgcagctccgaagcccatactgttctgctccagaccttggcgatagagatagccaacaattgttaaaccaatatcgttcggggagttatttccgttccacaacatgtagctctccgtgaacatggacaaccccgcataaatgctaatcgtaaatacgtagatcgttactggtttcagcataggaatcgtaatccgccaaaatgaatcgaaacgactggctccatcaatctgcgcagcctcatacaactcaggaggaatgttctggagtcccgacatgtagtacaacatatttacgcccaaccatctccacaaggccagcacaatcaacgctaaaaagccggtgttcgcattcattagccatttgtaaggctccagaccgaatacccccaacagggagttcatcagcgaaccatccaattccccgaacatgaggcggaagatcgttcctgctaccaccaccgaggttagtgcaggtataaacatcacggagcgaaacaaccctctgcccggcattttaggcgaattcagcaatactgccaataccagcggcagaggaatcagcacgactagtgtaagcagcgtatacagtacgctgttcaatatcgcctttccaaacgtaggattgattaagtccttataattttccagtccaacataagttgttatccctggcaggacttcctgaaagctcataatgaccgtcgagatgactggataggcaaaaaatagcgcaaaggacagtaaaaatggaaggacaaacacatacggtgccgtacggctggaatgaataaagcgactccatcggcttctggtcggacgctgaggttgtggcggctgacctgtcggtacattagcgttcgtatgaacgggcgttgccatgaatctcactccctttcctgttggggtctatctcagttcatctgccagctcatgtagcaccgtggctggatcttcgccattctgtagtgtccgataaagtattttattgcgcacagcactggcaatatcaggtgttttcggtccgatatgcaccgcattgatttcatctttgacttcgatgagcgtgtcaaaaatattcgttccgaaatactccgtaaatttattcttggctttggcttccggcatggtccacacttcactgcggatgggatcaaaaccaagctgcttccagatctccacattcccttgcttggatagcttggcaaaggctagaaagcgcatcgccagatcttggtgctctgattggttcgtgactactgttccggttccgcccatacccgctgagcgaaaaccgcctttttcccacgctggcatgggtctgatgatgattttccctttcaggtcaggcatgtaatccgtaaaacgtcccatataccacatcggcatccataccgaagcggccccacctttgttcataaacccgtagtattcctccatgtggtgcccgccgcctggtgcgggaatagcgattttgtcttttaccatctgctgaagaaactcgagtgttttaatattcgtttcgttatccagcgttaactcgcccttgtcatccagaaaatccgaattctgctgggagatcatcggccaatagttccacaggtcattcgtttccagggtcgccatcggcttgcctgttttcgccagcacttgcttgcctgcagcagcatagtctgcccaggtgacgatggaatccgggtctacccccgcctgatccaaaatttctttattgtaatacatcacttcggccccgacatggaaatcaataccgtaatacttcccgtctttaccgtaaatctgtactctggaaggcacaatgtttttgatctctgggtcaatcaccggattgagtgggaccagttgcggtatccctttgaggaaattaccgatcttgttcacctcgatatccgcaatatccggcgctcccacccctgattgcagcgcaatcgacagcttgctgtggtggttgtcataggggaatgtattcgctttcaaattaatcagttcatcagggtgctgttggttccattggtcagccatttgcagaaaaaacttctcatgcagttcattgaacgtccataatacaagttctgttcccggcccatccttttcatcggtcttgaaagaacagccttgcagcagtccagccatcaaaaccaccgccataagcatcaaagccatgctttttcttcgcagcagcatatccttcccccttcgcatgatgaaatcctaattcataaatgattgcgctttcttttattatttaacatcaatacaaattagtttacaacaacattatttataaaatatttattttcaatgcagattagcgtcccccttgcattatagggggaaaatgaattgtatgaggctatgatgatttttgcataaaaaaacgacccaattccaattgaaactcggaattgggtcgcgctttttaaattattcttgcgaatgtgctgcttcgtccttcacttcttcccgaaatgatctaatactttctttacgacgattatttttttcttcgatctgcttacgctcctcgttgctgatttcagaggaaaattcgtttagatatccttcagcttcatgcaggttctgctgtgtgttctgaatactttgttgcaaatgttcaacattgtcggctcgattatctggttttgccattcgtttgtcgcctcctaataatggggtcgctcagtagagcgctaatccgtagcttgatcgctatcggatcattttatgcattaaaatgctccccaaaccactttcctgcggcttcggcttcagtccgcgtcaattgatgaccattgcgttcccaatatgcttccacctgcgctccggcctcttccaataatgcttgcagctcctgagattccgaaatcggaacaatgggatcattctcaccggaagataaaaatacagggataccattcaaagcgggcaaatccagcccacgcaacggcaccattgcatggtgtaaaatagctccacgtaacgcttttgcatcgtgaaagagcatgctggcggctatgtttgcaccattggaatagccaagagccaccacgttattacgatcaaaatcgtattgctctgcagctgtatccacaaattcgctcaattctttggtgcgaaatacgagatcctcaatgtcgaacactccttctgccaaacggcgaaagaaacgcggcatcccattttccagcacatttcctctcacgcctaatacagaagctcccggtgctaccatctcagccaaaggtatcaggtcttgttcgttcccgcctgtaccatgcaacagcaaaataactggggcttgcggatgagttcctttacgaaatacgtgtttcatttatatttcctccttcatttttgttctaaattaagattcttatttttgtgtaatttgattatagccaacttctctaccttttacaaacacaatcagcctgatttaaatctttttttctaaaatgatgtatagttccgttgacatgtattatagctctattttaatatgatattagatatttagaatattatctaaatatctaaaggaggaaatgtattttgaacgatgccttcaaagctttggctgatccgacccggcgtacaatcttacagcttttaaaggagaaaagtatgagcgcaggcgaagtggctgaacattttcaaattagcaagcccagcatctcccaccacctcaatatcctgaagcaggctgggctggtgctggatgaacgacaggggcaaaacattatctacaccctgcatacaacggttgtggcggatgtcatcggctggatgttcagtatcgcccactctgatacccctgctaagaaaaatgtgaatcatattaaggatagggaggaatctgaatgaaattgcgaacaccttggagcttgacggatgttttgacgactttgattgccttatcacctgctataggcgctttactgctgtataaccggcttcccgatgtgctggcctctcattttagctttgacaatacagcagacgggtatatgagcaaaggtggttctattatcatgctcgtgctgttgggtctagtaccactggtcattcgattagcccgctatatggaccccaacagagcaaattatgagaaattttcaaaagcctatgaagttacgcgtataggtacttctctgatcctcgctatagctggttggggaatgctgctgtataacctgaacatacgactgcaaatgaatactataattttggggataataggcctgctgctgatggtgatgggtaattttctgactcaggtacagccgaactataccttcggtatccgcacgccgtggactctgtctaaccccgaggtgtggcgtaaaacgcaccgtttcggcggacctatgatgatgctcggtggtgcttcgggcttggtagcggcatgggtggatggagtggctggggcggtcatttttctcaccgggctggttatatccgttatctctcctgtactctattctttcttgttgtatcgtaaactaaaccagtaagcagacaaagccaaacctgaacctaaaaaaggaacctcccaatccacgataaacgtagaataggaggttctttgtacatttaatctttaatattagaacagcagcttatcaggatgcgtgcctacacgctcatcaagatgaagaccattgattcgttcaatatcctcagccgtcaattcaaagtcgaataaatcagcattttcgcgaatacgatgcggggttacagatttgggaatcgtcacaatcccccgatccagatgccaacgcaaaataacctgcgaagaggttttaccgtatttggcagcaatctcaacgatgtccgcttgctcggttaatttccccttcatcagtggactccacgattcaagctgaatctggtgctcccggcagtattgatgcagttcttgttgagtcagacgagggtgaagctccacttggttgatgacaggaaccatgttgctgtctttgaggaggtcttcgagatggtgaacttggaagttactaactccgatagcgcgtacgcttccttcttcatacagtcgttcgaatgccttccaggtttccttgtacttatccttgccaggccaatgaatgagatacagatcaatgatatccagccccagccgcttacggctttcctcaaaggcgcgcagtgttgaatcgtagccctgatcctgattccacagcttggtggttacaaacagattttctctagacgtcccactatcacgaatggcttgtccaaccagttcctcgttaccgtagatcgccgctgtatcaatgtgacggtaaccgacctcaatagctgttttgaccgcttcgtagacctcattgccttccgccttgtaagtaccaaaaccgagccaaggcatctgaactccgttattcagtacagttgtatccgcaatgttccccatgtctattcctcctgttcctgattatgaatgatccaacgggatgattacagtttagttgcatcctgaaaagcattcacttgaagcggagcagccaacaattctttagccgcggcaacaaatgcctggaaatgggcagaattattatggaaatctacagcagcagcatctttccactcttcaaccatcgtaaatgcgttgggatcattcagatcctgcattaacgtgtaccgtacattgccttcttcagcttgggatgcgctgatcagcccttgggtttgttgcaaaaaagcctctcttttttcaggtaaaactttcatatcggcatgaataataatcatattatgttcctcctcgtattatgtaactatttctattatagaccattctttcgaaagaataaaagtgcgggcgtttctgtaatacagtaaaatagatcgtatgggggagaagatcaactgatccgttcctcctatattttgtttaacggcggtgaaggcatgtgcgttttcagacaaagctaatggtatttatatcccttttagtactggtagttaccgggctgttgggattatcctttcgatatatgatcacctccgctctatatgatgaaatcggagaaagggcgctcaccgtcgccaataccctcgccgtagatgcgcaggtcagagacgctctggagcagactgagacgacgcaattgcgttcgcgtatcaacgaggtcataaagcctgtccaagccagcagcggcgctgattttattactattgctgatcgtcatctcatccggcagtggcatgtaaacccggagcgcatcggcacgcctatgatagaccccatgaatgataaggtactgcaagggcagtcctttatcactgaatcgacgggctctcttggaccgtcactacgcgccaaaactgccgtttatgatacgcaaggtaaggccatcgggctcgtctctgtaggttttttaatgacagatgtgcagcaaaatattcgtacatacacatatgcatggctctggtttatggtgggcgcgctgatgatcggcatattgggaagcctggttatagcgcaacgggtacgccgcgcactgcatggactggagccagtggagatcggacggttgtaccaggaaaagcaagccattattgagtccatcggcgaagggattatcgcggtgaatagtaacggacaaatcacacttgccaatccacaggcagctcgcttgatcggactcccgccggaaacctctatctacggatgcgaccttcgtcacttgactggtgttccggatgtactgattgatatgcttgttgccgattacacagtagagcattcaacgatggggccagatcagggacaagacatatggaatgaggaaattgaggtccagcagcgaattgtagtcgtcagccgtgtgccgatccaggatcgttccggtcgcttcatgggcacggttgccagtctgcgtgacaagaccgaactgctccacatgacacaacagttgacagaggtcaaagattacgcggaagtactgcgatcacaaacacacgaatacgccaatcggctgtatctcatatccggcctgattcagttggagtgttatgacgaagcggtggactttatcacccaggaatcagaggaatatcgtgtacacaggccgattggcacagctctcctaaccgattcaatcatcgccagcctactgatcggtaagaagaaacaggcgctggaaaaaggggttttactctattctgatattaaaggagcattctcaacccagtcccctacgttggagtggtcctttctcgcttccatagccggaaacctgctggacaatgccatggaagctgttgcgatgtcctccatctctgacggacaggtctggttccggcttgaagaaacgactgaagccatcatcgtcgaagttgcggataacggatcgggaatttcggacgatatccaagaaaagttgtttgtcagaggagcttcgaccaaagcagaagcaggacatggatatggccttgctctcgtgctggagtacactgaacgaatgggcggatctatagaagtgcacgaacgttctggtggaggaagtatttttgaggtatacattcctttaattaggacagatacgagtaatgatgcaaaaggaggttatgcccatgaatgagcgggttttatcggacattgaggttcttattattgaagacgatccgcgaattgcggagattaaccgccgatttattgaaaaggtggacgggttcaccgtatgtgcaatcgcgacgaacgaatttgaggcaaaacttcaactggacgtgctccgtcctcctctagtcgtgctggatgtttattttcctgatacggatggtctaaccctgctatcgttcatcaagcaacactatccgggtacagatgttattatgctgactgccgccaaagaagctgaaacagtggtacaagccgttcgagcaggcgtgtttgattttatcgtaaagccgcttatattcgagagattgcgtgcgaccttggaggaatatgcccggtttcggcgacaaatcacaacatggcaagaggaacaatccacagtcgagcaatctgaaattgacagtttgcttcaaagcgcgggcaccggtcggatggcggggaacggagtcggagaactatgggccaaaggcatcgataaagtaacttgcgacaaagtgctagatctcctgaatcgacggggtgaggtgactacaggtacagtgggaatcgagctgggtatgagccgttctacagccagaaggtatctggagtatttagtggaaagtggcgacgcgcaccacgatcaggtgtacggaaccgtcggcagaccggagcgtatctatcgccgacagcggagggatgcataaaccgtccaactctgatgtcctggtacttccccctcctcctattcataattttattgaatttaattcacttaatcgatcaaaacggtttaaataaccacattatttacgtcctccttcccgattgctagaatgatcaacagttagttgattgataatgattatcagtttctctgataatcatactggaacgggggataacatatggcaataccgaaacaaccactgcgcacaggtatgctgcttgcagcgatcctggcactactgacggtcattatggcgggatgtggaagccagtcacaagataacagcgcagtagcacctcaagcaacaggcgacactcgaatgattaaacatgagatgggagaaaccaaagttacaggtgcacccaaaagaatcgtaactctggaattctcttttgtcgatgccacaacccaactgggcgtaactcctgtcggtatagctcaggaaaatgacgatgatattgatgggctgctcggcaagaaaatcgacttcacaccagtaggcacacgcaaacaaccaaacctggaaacgatcagctccttgaagccggatttgattattgctgatctgaatcgtcataaaagcatatacaaagaacttagtgagattgctccgaccattgttctaaagagccgcaattcctcctatgaacaaaacttggcatccttcggtgtcatcgccgatgcgttgggtgagaaggaaaaaggcgagcaaattctcgctacgcataaagctacaatggaaaagttgaaagaaggcatcaaagctggtgagccacgcagcgtattgctaggggtattccggtctgattcactatcggctcacggcgcttcatcctttgatggacaactactggagcaagcgggtatccacaatgcccttcaaaatacaagcgagcctaccgtcaagctgacgctggaacaaatttcacaagcggatcctgatgtgatctttttggtggaagccgatgagaagctgattgcggaatggaagcaaaacccgctttggcaaaacattacggccgtcaaaaaaggggaagtttacgaagtaaaccgggcactgtggacccgataccgtggactcggctcagccgaaaaaatactggagcaagccatttcgcttctgtatcccgcgcaaagtaaaggagacggctcccggtgatcggacaagcctcacgcgaccggctgaataagccggtcttctttgcacttatcgctgcgttgctggctggattgctgcttagcgtggcgattggcccagtcaggatggacatccccaccatgctgactgcgctgttcactgagcatccgtctaaggatcagctcattgtcttgacggtacgcctaccgcgtgccgttattggcctaatcgtcggggccgggcttgccgtggctggagccctgatgcaggctatcacacgcaacccgctggcttcgccgcaggtattcggggtcagctcaggcgcttcgctggctgtcgtgctgtccatcgtgctgctaccgaatatcggatcgtccggcagcatttattttgcttttgccggggccatcgcaggtggctccttcgtatacgcgctggccggaacggcgggcatgacgccggtcaagctggcccttgccgggatggccgtgcatctgctgctggcctccatcacccaaggactgctcgtgttcaacgagcaaatatccgatgtgctgtattggctcgccggagccatcgacgggtccacttgggccgacacgcgtctggtgctgccatggttcgccgtgggtatgattcttgcgctggcgctggccccctcgctatctgtgctgagcctcgggacggaggtcgcacagggattgggacaaaacgtacgtcttgtccgtctactggcctcggcctcagtgattatgctggcaggctctgccatagcggtagccggttccatcggctttgtgggcttgatggtaccgaatatcatcaagatgtttacaggcgacaattacaaacgggtcattcccctgtctgcaatctgcggagctctgctgctgacatatgcagacgtgcttggacgatttattgcatttccttatgaatcacccgttggcattgtaaccgcgctggtgggtgcgcccttctttttatatctggcgcataagaacgggagggcttcacgatgaaaaaactgtggattttactcgcgctcatgctgggtgttgcttttatagctataggcgtgggcagcacctacattacgccctctgagctgatcaaggctctgacggaccggagtgcctcttcctggttcatcgttcatcattatcggctgccacgcggtctgctggccatcatggccggagctgggctggcagtagccggtgttctgctgcaaggcatgatccgcaacccgctagcctcgccagatgtggtaggtgtatccaagggggccggctttgcggcggttctcgtcatcgtgctgctgccctcatccccagtggcactgctgcctgtagccgcctttgtcggggctgggctagctgcactgttgctcgtacagctttcgatgaagggaggcatgcgtcccaatatgctagccttgaccggactggcggtgggcgctatttttcaggctgcgaccgattatatactggtcaagtatccactcgaagccagcgacacgctcacttggctagctggaagtctgtggggcaaaggctgggacgaagtgtatgggctactgccgtggttaatcgtattgctgcctctcgcctatacactacagcgcaagctggacattatgagcctagatgaggaaagctctgctgggctgggacttagcgtgaagcgtgtgcgtacaggactgctagccgtgtcagtcgccttggctgcctcctgtgtcgctgccatcggctccatcggatttattggactgctggcaccgcatctggcacggcggttatttggcaatcgccaccgctatttattgtccggttcggcgatgatcggcgccctgattctcgtccttgctgacgcgctgggacgaggtctgaagccgccgctcgaaattcccgctggcatcgtgacagccgtcattggcgcgccatattttttgtatctattgctgcgggaacgcaaacaaaaagacagcggataggctgaggataagaagttgcacagcgcagctaaacgcagtactataccctagcgtttagctgtgctacctctccacctgtacaccgatacgccgattaacttcttttctaaacgattcatcatgcagtagcctctttttaaaatcatttatcatttcgggaaagctggcatttgtgcttgggtccaaatcgttaaaaaagacagctagctctgtcgaatgcccttccttatctgtcgcatacatggccagtgtcaaagcataagccgtggagccacctttttgcccagtatgtttcagggattgctggttttcaggaagaaccataaatggttcctccaagacctcggacaataacttttgctcagcttttgtgaacccttgacgacgattcagcttactcattaaagaggcatactcggctgtcgttgaagctataaagcgatccgtattgatacgatcataatcctgatcataccaagtcgtaatatctgcgtttctcttgtaagaaccactcacatcacggcgcagcttgttatgaattacgcgggcatatcggcgaaattccgtatcagacatcgcctgaatggcttctttggcagaaatattattctttgtattattccaattctcaccttgtctctccttcatccattcgtagggaatcaaaatggaggatacaaacggataaatgggatcatgatttttcagccccattttggctctcgtccgattgatcgcacccacccccagtttgtccattaaatactccgcattggcgttggaactgaattgaatcatccccttggcgacgtctcgtacagatacagtttcattctgtatccgccctttagcctccatattctgtagccacgccgtatgagcacccccatccaaacccggcaaataaaacctttccagcgagatcagcttcactctcccttccgggttaatcttacccaccatcgcttgcttggcatattcgatcgcaatgattgttttgacggtgctcgccaaaggcatcatccggttttcctcttggcctgccagcttttttccatctcttagaatcgtaatcgaaactttttctgcattcgcctccacaaaatgaagtaaacggcgggcagcatcctgttccttcgtttcttccttaacgtcagctgcaatcgcagttgtgggccggacggtattcgggggattagccacttgattctgcatgaaagatagtaagcctgccgctacacccataacgatgagcactgtagccaaactagttgctaccacaataaggcgctttcgtttcactattacctccccccgtatgcacttcacacacaggtttattttcccatttttatatttcaatttctattttaaacgaaaatagagtacaaaaagtttcattacgtgtcatattttcaaataacataaaaaagagagcctcctgtatataacacaggctgactctctttcactatccttcgacacttatgctggatagggtacttcggttccattcaatatgaggtgcatccgaatttccgcttttaaggaatcggatactgcacaatatttttccttacccatctgaatcgctttccatacgcggtaatctggaatatcaccatctacgtggaatgtcagatcaatcgctgtaaagcctgtcggcatttcttccttgcgcataccttctgcgtcaatatcgatgcgagtaatgtccgacaagaaacgatccaaaatcatcgtaatatcaatgcccatacatcccgccagacccgccaacagcagttccatgggtgtcatccctttaccatcaccgccataagccgccgtagcatccatcccaacggaataaccggatggaccctccgaagtaaacgcgcgtttgccgtgccaagttgtagatactttcatgtttaaaggccttctttccatcttaataatctatgattcatcctcgatcttgctttaaaattcactgatttggcgtaaaaatttctgtgttctctcatgctggggagtgtcaaaaaacgcctgtggcgctgcctcctccaaaatgattccatctgccataaatacgaccttgtccgccacctcgcgagcaaatttcatctcatgagtaacgaccaccatcgtcattccgtcttgagccagctctcgcataacacccagcacttcccctaccagctcgggatcaagcgccgatgtcggctcgtcgaacagcataatcgccgggtccatcgccagcgcacgtgcaatggcgactcgttgctgttgtccaccggacagacgtgaaggatgtacatcctgcttgtccgataaccccacccgctccaataaccgttgtccgatggacatagccttgtcgcgcggcattttttttactgtcagcagtccttcaatgacattgccgattgcggttttgtgcggatacagattgaattgctggaacaccatccctgtctgtttgcgaatctcacgaacggctgcttggcggacacgaacgggagccgtagcatcgacctcaatcccattcacctcaaacttgccggaagacagctcttctagaccgttcaggcagcgcagcaaggtacttttacctgaaccgctcgggccgagtaatacgacgatttcacgagcggcgacctgaaaatcaatgcttttcagaacctctacctgtccgaatcgtttacctaatccgttagttgttatcatcatctatcatctccaccttaataagctcgagccagacgcttttccacccgctccagtatagcggagaatccaatgctcataatccagtacatcaggccaatttcgagcagaaacggcatgtaacgcaaatactgcgcctgtaaaagctgtgcctgccgcatcaattcactgaccccgataaccgacaccagcgacgtttctttaagcatacctacaaatgtattccccatcggtgcaattgcgatccgtaccgcctgaggaagaataatacgccacatcgtttgaccaggcgacattcccgttgcataagctgcctcggtctgcccctggggtacagctaaaatagctccacggaacgtctccgataagtacgcccctgtattaatgctaagtgccagacaagcagctgtcagcgatccgaatgatattccataatcatccagtccataataaatgaccgcaatctgcaccaaaaccggcgtcccccgaatgatcgatacatacatgcgcgccagccatcgaacaggtcgattccccttcaaccgggccacagcaacaatcaaaccaatgattaggccaaaaaacatagagacaatcgtaatatatagtgtataataagcaccctttaataaaaaagggacgttctcccacattaattcaagcattggttatattcccttctttcagacgagtggccccatgtcagcataaaagccaagactggagccagacgcctctaacaggcttacgttattcttttggctcctcgccaaaccattttttgaaaattgttttgtaagtgccgtcttccttcatttccttcaaagccttgttcaaggcttctttgagctcaggagttttctggttaatggctacacccgcttgatccgatttaatcggctcgcctacggctttaatttggaacccgtttttatcgataatgggcttgagagcatacagattgttaattgttgcgtcaatacgaccagagtttagatcctttaaggaagtaatgacatcatcatacgttttaatctcaaaatcgccaaccttcggcagtacttcattccgcagataagattcatcattcgttcccaagccgacaccaatggttttgcctttaaagtcctccagcttggtaatatcatttgttttgctgtttacgataatatttacattgtttgtgatataaggctctgtgaagtcaatagccttcttacgatcctctgtaatcgtcacctgactaatcactgcatcgaattttttcttttgcaaacttggaaccagtcccgagaattcttgtgccgtgaactctggtttcactccaatccgcttcgccaattctttggcgatatccacatcaaatccgtccaattccttgttatcgttcaggaaattgtacggcggataggtgcccatcatgcctaccttaattacaccagccttcttgattgcttcgagctggttactcgctgccacattactgctacccgctccattgctagtattagaagcttctggcttagtaccgcaagcgcttagcacaaggctgaacaatgccacagccatgagtatagttaccaagaacccttttttacgtgttttcatgtatccttctctcctatctggatgtaaatgattgagttcatatatgtgatttggctatattatttgttccaactacccattcatgcgatgttgaccctctagctttgacctaatagtccataaaactcaaaattagccgcctctgctgccaatcttttagcagttatctgcgtgatgtggtcatatgttccctctgaaccgaatagccagcgtgtaatgacaccttcgatcatactcatgagtagtgccgcccttaattcgacatccaattcagcaggcaacatgttcagctcgatcgctctttccatattgcgccggaatgccagctccatcgcggcccttgtctctcggatactctggcgcaccggttcatcgacaccactgccgatcagcagcaaacccatcagatagcggttctccaatgcaaaatcaaataaccgaacaaacagcgcctccgatgccttaaccatatcagccagcgttcccgcatcacggcgatatccctgtccaatcgctgacagtagttgttcacgaccggtagcgataatctccagcgccagtgcctctttacttctaaaatgccaataaaacgtgccttgggctactcccgcctctaccacgatatctgaaatctttgtttgatggtaaccctgctcggcgaaccgcttcaatgcaatgtgaagaagctgtgttctgcggtctgtttcttcccccgcgtgctcggaaggttggtcatttgggacggtctcggactgcttcgcctttcgtggctgcatgggttccctcctcccgattgatcagtcagtcagttttgtatttttaatcctataggataagtatacttttgtcaaagaaaaaagtgtcagaagaaaataagtattagactggcgccaacaaaaaagacagcggcagtcttagactactgctgttttattaaactaacgttttcctttagcgtaatcagccaaatgctacgaagcgtgaatgtggtgttatgccaaggcacctttcgagcgtatttccaaaattcatatatcctctccttagaaggttactatcacttttccttcggagtggccagtagaaactttatttaaagccatgttaatgtcatcaaaattataaactgaatctatagcgggcttaatatcttcatcctcaactagtttcgtcagtttttgtaattgcctgccattagcggacacgaataagaagcgatattctttattctgtttaactgctaatcgatctaaacgagcacctactaaaccaaacaatagctttttccatattggaaagttattttcagttgggtaaagccttcaatgataccaatttcccttggggtttgagaatagcaagttccgttttaatttcttttgcccccaatgtatcgataacataatcgatattagatagcaaatcaaaataattttcctctttatagttaatgaattgatcagcgccgatggacagtgttcgtgatctccctctttcactgccgctcgtaatcacatataaccccatcgatttggcaatcgggatagccatcgtaccaaagccgccggttcctccagaaataaatagttttttatcgggttgaacatgaagtacatcatgcaaggcttgatatgcagtcaaagccgtgaggggtaccgcggcggcctcaataaaagaaagatttttaggcataacggaaatcgcatcctcatggactgccgcatactcagcaaaagctccgattttatttattggcagcctcgtataaacgggatctccaaccttgaatttcacaacatcttttccaacagcctcaataacgccggatagttcgtttcctaaagttaaagggaagtcataatcggcaatcatgcgaatactaccatttaaaataagaatgtctaagggatttacacctgcagcttttactttgataagaacctcatggttattgatttccggtatttttatattgtttatttctaattggatttgttttgaatatttttgcatttgcgcagctttcaattcttcatcttctccttttctcatttatcttaattccacattcgtttattggaaaaattgatggcgtactttaacttgtacgccatcataaagcaatatccatgttattctttactgatgttgagattgaagttctttcatcgtaggataatctgtgtaaccctcgcttccgttaccagagtacaatgttttacgatctgcttcattcaaaggaaagccttctttaaggcgttcaactaagtccggattagctaatgaccataccccgactggcgccatatcagcaaggccattatcaatatctacactaagatcttctagagcccgtccagctctattgactaataatggatttggccagatgttgcgaatttcacggagcagtgtttcgttccctaaatgcataacatggaggtaagctaaattatattgagctaattcttttacaaggtgaagataaacttcaagactgtgttcgccctcatcaattccgttaagaggtgttcccggcgaaatacggaagcctgttcgttctgctccaatttcttcaacgattgctttcgttacttcaattgcaaagcgagcacggttctctatcgatccaccgtatttatccgatcgtatattagaattctccccaataaattgattaatcagataaccatttgctccatgaatttcaacgccgtcggctcctgctttaatagctgccgctgctgctttccggaagtctgcaattgtcgtctggatattttcttcacttaactctcttggaacgggtatttcctgcatccctttagccgtaaacatttctacaccgggtgcgatcgcagatggtgcaacgggttgacgatgatgtggtgtattgtcggggtgcgacacacgaccgacatgcattaattggataaatataaatccaccttcttcatgtaccgcatccgtaacctttttccaaccttcaatatgcttttccgtatagatgcccggtgaccttaagtaaccttgaccatcatcagaaggttgtgtgccttcagtaataattaaacccatcgatgctctttgagcataataatgggaagttagctctcccggcgtaccatcctcttgcgctctactacgtgtcattggtgccatcgctaaccgatgaggtaattccaggttgccaattttcgttttgctccacagtttttccattttaaaaccccctctttgaattgagtttattaactccaatgtctttcgattatcgctccactttagcctgtgcggatctgaccgcatttgtcatgagcttgcgaggcagcaaccgcggcaagaacgccatgaacttgttgcgcccccctgttatgattaaagtcttgccccgcaagaattcgcgatatcctatgtcagccacctgcccaacctccatgacgccgcttctaaacagctttgaggtggctagcccagcacgatcgacaaagccagtcgctgtcgctcccggacagagtgcggacacagtcacgcctgtgccccgcagctcattttccaaagcctcagtgaacgatagtacctacgcttttgtcgcatagtaaactgccatcagtggtccaggaaaaaaagccaccaacgaagccacatttagcacgcccccttgctgccttttgaccatatccggtaagaacaccttagtcattacagtcagagccttgatattaatgtcgatcatattcatctcttgctccaactgtgtctccaagaattccccgtacaagccgaagcccgcattattaacaagaaagtcgacggtgatccctttttctttaagctccctgtagatttcctctgccacgccaggtaatgcaacatctttggcgatgtatgtcgtttggacacggtactttttccgatattccctcgcgagatccacgagcttgtcctcgctgcgtgcgaccagcaccaaatcgtatccgtctttggcgaaacgatccgccagcttttttccaattccgcccgacgctccggtaattagtacagttttgctcatcatttaagctgtgggtaaatagcagctacaccgccagcgagagcacgctggagttgacggctcggttcatcagcaagaatttcaaagctatcggactctattccatcaattgcaatttttgcaatatcagcagggttggacttcggagcttcaacgcctgacgtcatgtctgtatccataaagcccacatgcaagccagctactctcacattttgaggatacagatttaagcgtaactcgttcgtcattgcccacgcagccgcctttgcagccgaataagcgccttcactcccgccactactgaaccatgataatgcggaaaggatattcagtatggatcccccaccattattaataagaataggtgcgaaattgcgaatcatggataatgtgccaaagaagtgcgtattaaattccaactgtatttgatcgagatcaccgtcaagcaaagtagctcctgtagccgagcctgcattgttgatcagaagcgtaacatcttgagcggccatagcagctgccgctacctcttgagggttcgtaatatcaagctttacaggaattgcaccgggaatgtcaatggactgcggatttcttgctccggcatacaccttagcccctctggatagaagttcaagggcaagatggcgaccaaaacctcggttcgcgccagtgacaaatgcaacttgttgagaaatattcattttcatgtgctccttttattgtattttgtttatgaaattgttttcttgaagctatttggtctgcgttttgatacgtagtaattacggtaagcgagttttactcgatacttgttttctaacgagaacggtcattctcaaaatcgttaaaaaaaatgctgagtgccttactctgttgtttttatgtgttgtgttgtttgttgttttaactgcgctgataaacttcattgtaaactatgctttagagcttctttcggcgtttttagaatgttcattctaaattaggcgtaagataactcgatcgcaaagagcatggattagcagaagggacacttcacatctgaactgactaccacaattacccttattcttccaggagcttcatcgaaatatgagtaatacggtgaagctttcctctggaagccgaggttcttgccattacccttaacccaatccatacattatgcaggtattccgccaattcctcagcattgtatgtggaggtgaattcaccgtcacgttgtccccaaagaataatctccctgagcaattgctctgctgtcgtgaatgctttcgtggacttgttgtccacctcgacgtcacgcgccgccaattctacggccgaattcaccattaagcagccggctggcgagtcctcatccccgtcgatcatgaagctaaaaataaactgtaatgcctccgatgcggtcttggatcgtttaacccctcctgcaagtgcggcgatgattttgtcgtcaaaccaatccatcgctttcaggaacagactatgcttatctccaaaagtatcatacaaacttcttcgatgaatacccatatgctcaaccaactcggtcatggacgttttctcgtatccctgctcccaaaagagccgcatcgccttatccaagacttctttctcttcaaactccttgcttctcgccattccaatctccctccctcaattaatataacatattgagaacgatcagtaaagaatcgttatgctctttttgaatgacataatatttccatcgagttggttatcctacaattctacatattgtaactcccctgcccgttagcttaaacaagtaccggcagtctaatgtagtgcttatgaaaagtaaataagcccataaccgtatttggaagcaaattaattttccaatttataagggtatgggctctctttgatcctaaataaggcagtgtaggttcttatcacttataaaacaccatcgtctgctaatatacattagcttgttgctcttatatggtaaaagcaatttgttgagctatcgtacccgtcgttcatgccaatcccattccgagtaaaggtgattattaggctctgttagagcctcgcgaacgtgatgtaatcgacttgggcaggctctgccgattcgatccgaagcgaccggttgatctgtccccggtgatattgaccatgtaagaggacctgcgacaggatgtcccggacggacgttcggaacggaaccccgctctggttcgcatagtcgatcatctcgtccaactcggattcctcgagcccttcgatatagacgcgatattgttcggcgttttcttcgaatatcgtccgaatcgccgtcaggtcttctgcttcctcccacaacgaatattgcgcgctacccttgccctgcaatcgggacagccagactcgttccgcgaccgcgacgtgccgaaccagcttcagaagttccttgttcttcgtctcactctcctcgagcgcgtccaagatgcgtccgtccgcccagtacaggtggtccatcatgcacttgatcgtcttcatttcggtttccccctcttcatctcatcaattacttgaacctactattaaccgttagtttaatcatttgaatgaactaaaacaaccttttttgggtgaattccttgttgctgtaaaccaagcactaagaaaacgctttattttctcagtctacaactttatttcctttgaacaaaaagagaacctccacagaggttctctttatcctttatatcgctgctacagcaatgcttttgccgcaatgtccgtacggttttgtttaccttcaaaggtaatacgatccgcctgttcgtaagctttgttccgtgccccggcaatatcacgtcccaagccgaccacacctaatacacgtccgccgttcgttacccactcaccctgttcgttgatgcccgttccagcatggaacacgatagcttcgtctacctgttccaatccgtggataggtacacctttggcgtaagctccaggataacctccagatgccagcaccacacataccgccgcttcatccttccactcgatctccacctgatccagcgtgccatttacagcagcaagaaaaatatcgagcagatcggattttaaacgaggcagaaccacttgagtttccggatcaccgaaacgtgcattaaactcaatggtctttggcttgccatccggcgaaatcatcaatccggcaaataatacacctcggaatggacgcccttcagcaaccatggccttggccgtcggcttgatgatcgtctcaattgcttcctcaataatagaattggctatgtgaggcaacggagaatacgtacccatgccacctgtattcggccctttgtcaccatcaaaaatgggcttgtggtcttgggccgcggccatcggacgaaccgtttcgccgtcgacaaaggagagaatcgacatttcctgaccagccagaaactcctcgatcacgacctgtgccccggcttcaccaaacaccttggtcaccataatgtcagagagagccttttccgcttcctccattgagtaagcgaccgttacccctttgcctgccgcgagtccgtctgccttaatgacaaccggaatcggttgttccttcaagtatgcatgtgcttcctcgtaagtataaaacttgcgataggttgctgtcggaatatgatatttatggagcaaatccttcatgaagattttgctgccttcaatttccgctgcatttttacgcggtccgaatactggaatgcctttcgcttcaaaagcatccacaataccatctgccagcggatcatcgggaccaaccacgacaagtcctacctttttggattccgccagttctgtcagcgcgtcaaagtcactcaccggaatcggcacgcactccgctaactgtccgataccagcattgcctggtgcgcaatagatttgcccggccttggggcttttcttcagcgcccacacaattgcatgttcgcggccgccccctccgataaccaaaatatccattcaggtgtttcctcccgctcccattaagattgttcaggtgaaaatgctgctgcatcctcaactcatacaagttagtgcttgaaatgacgtacgcctgtaaagaccatggcaatgccgtattcgtttgcaaccttgatggactcttcgtctttgatggagccgcccggctgaataactgctgtgatgcctgctttagctgccaactccaacgtatcgcccatcggaaaaaatgcatcggatgccagtacggcaccttttgctttgtcaccggcctgctcgatagcaatcttggccgcgccgacacggttcatttgtcctgcgcctacgccaatggtcatattatctgccgccagtacgatggcgttggatttcacatgcttaaccactttccagctaaacaaaagctgtctcagttcttcctcggatggtgcccgctccgttacaactgtaagtgcatccgagtctacagcgtgaatgtcattttgctgaactaccataccaccttcaatggaagtcacgacgaaacggctctctgcctgttcagaccgggaaagctcacccagatcaagcaaacgaatatttttctttttcgttaaagtctccaatgcttctttcgtaaagcccggtgccagtacaatttccaaaaagatctcactcagcttattcgctgtatcaccatcaataatccggttagccgctacgatgccaccgaaaatcgaggttggatcagctgcatacgccttgctgtacgcttcataaatacttccgccaatccccacaccacaaggattcatatgcttaactgctactacggtaggttcgctgaattctttgacgatttgcaaagcggcattagcatcattgatgttattgtaagacagctctttgccgtgaagttgtttcgctgttgtcagcgtaccctttgccgccaatggctcacggtaaaatgccgcctgctgatgtggattttcgccataacgcaaatcctgaattttttcataggttacagtgtaacgctcaggcaacggctcgcctgtcacattcgacaaataatcggatatcaaagcgtcgtatgacgccgtatgacggaaaacttttgcggccaaacgcttacgggtattcagttccgtatcgccatccttacgaatttcctccaacactgtgctatagtcatcagcatcgactaccacactgacaaaagcatgattttttgccgcagaacgaagcatcgttggaccgccgatgtcgatattttcaatcgcgtcctcataagttacaccgggtttggcgatcgtttccgcaaaaggatacagattcacaacgaccagatcaatataacccaatccaagttctttcatctgacgctgatgctcttcattatcccgaacagccagcaagccgctgtgtaccgcagggtggagtgtttttacacgtccatccataatttcaggaaaacccgttatctctgaaatgccgatgacgggaatgccctccttcgacaacaagctgctcgttccccctgtcgaaacgatctccacacccaatttggacaactcgcggcaaaattccacgatcccccgcttatccgatacgctgacgagcgctcttttaatactcaccctgtctcctcctttagctctttcagaattttgcaaaattctcttttatcattttatttcccgagaaatatcggaaaatgcctgtacagcatccttgatatgacaatgatatgacaaattacaatcattcttagagaagtgaaatcactttgcgaccatttaattggattttaccttgggccaatttgccaactacctctggatatagctggcgttccacggattgaatggctgcggataaggattccgctgtatcatggtcgtcaacttccacgacacgctgggcaataatggctcccgtgtccatgcccccgtccacaaaatgaacggtaacgccacttaccttgaccccataggtcaatgcctgtccaacagcatctttccctggaaatgccggaagtagtgacggatgaatattaataatttttcctgcgtaggcatcgaccatgacgctggatagcaaacgcatgtagccagctaacacgatgagatcaatcgatttctgctccagtaaagccaccaattcacgctcatagtcttctcgagaaggatattccttgggtcgaaaagtatggcacgcaattccagctttctgggctctagctacggcaggagccgcaggcttgtcacagatgagcaattctaccgaggcgccgcccagttctcctcgcgcagccgcatccaccaatgactgaaaattcgtcccttcgcctgatgcaaaaacagcaatccggtactcgttcattacacctctgctcccgtaaaggtcacgatagaactgccttccgttacttttccgatcacatatgcggcttcgccctgttccttcagaacttccagtgcagtctgtgcatgctcttcgcctacaacgattaccatcccaatacccatattaaaggttgtgaacatgtctttgttggagattacgcctttttcctgcatgagctggaagattggcaaaatcggccaagtaccgtattctatatccacattgacgtgatccggtaacactctagggatattttcaataaaaccgccacctgtgatatgcgccatgccttttacttttaccttgtccagcaatgccaaaacagatttcacgtaaattttcgtcggctccagcagtacatcgcccagtttgccgttcaagccttcgatttcatcatgcaaatcataaccctgctgttccaataacagcttgcgcaccagtgagaagccattactgtgtactccgctggaggccagtccgatcactgtatctccgggagcaatggagctaccgttgataattttgcttttatctacaatccctaccgtgaatccggcaatatcatattcaccctcgctgtacatccctggcatttctgcggtttcaccgccgaccagcgcacagcccgattgatggcatccctctgcgattccagcgactatagcttcaattttctcgggcacaaccttgtcacaagcgaggtaatccagaaaaaaaagtggctccgctcccccgacgacaatgtcgtttacacacatcgcaaccgcatcaataccaatggtgtcatgacgatccattgcgaaagcaagcttcagcttcgtgccgacaccatcggtaccggaaacgagtacaggctcctcgtacttatccttattcaggccgaacaatgcaccgaatccgcccaagtccgtcagcacttcgggacggaaggtacgtttaacgtgctttttcatccgttctactgcttcattaccggcagcgatatctacccctgcgtttttgtatgcttcggacattcatgaacactccttcaaatgattgaccctcctaagtcctccctagtagggaggattccatggggctgctccccctggacccctcaagaatcggtcagatgtgtagggttgggtgctacttggtgttggttcgtgctgtgagtcgcgtgttgtcctttgtgaattgcgggtcattcccgcaattcacaaggacacgctttggtgcgtggccgccttcacggcggcgggcacgtcccgggctgtttgcttcgcaaaggcggggacgtgccgggcaaagaagtgaactgcgcctacgagcggctcgcttctttgccctttgaggcaggcggcttcgccttgcctgctgttgagcttcgctggctcaaccttataaaagcaggatgactttttatgagtcaccgctccgttaaaaactcatggcatgaaatagttatgccatgagtttttaacgaccttacctatcctcttccccatagggaacagaagagagacaggtactgctgcaaaatgctgcacatctgaggaacggagcgggtggaaggattctggagaagcgaagcgttcgcctttgccgctggattctaaccctgtaaggggttatttcaacccaagaatccagcggcaacagcgatcgtaagaaccttccacacgcggagtggctccctcagaaccgcttcacctgcaccatgcgccacctgtatctcttttgttcccgtttctcaacaactacatccgaacttttcttcacctttgaaatctacctgagtcgggtaatcattatcgaaacaggctaggcacaagccgcctttgtaatcctgttcgttatatccacctacagcggcaatcaacccctcggcgctcataaagtagagcgagtcggcgttaatttcctcacgaatttcctcgacggttttggatgaagcaatcagctcccggcgatccggcgtatcaataccatagaagcacgggtttttgaaaggcggcgaggtaatacgtacatgtacctccaacgctcccgcatcacgcagcatattcacgattcggcgggaggtagtgccccggacgatagaatcgtcgatcataatgactcgtttaccttcaacaacacgtcgtacagcgctcagcttcattttcacaccctgctcgcgtagctcctgactcggctgaatgaaggtacgtccagtgtatttatttttaatcatacccagctcataaggaatacctgtttgctcagcataaccaatcgcagccgaaatactggaatccggcactcctgtcaccagatccgcatcgacaaaagcttccagcgccatctggctacccattcttttgcgcgcagcatgaagattggaaccattcaaatcactgtcaggacgagcaaaataaatatattccatcgcgcacagtgctttacgatgcttgccttcactgtaacggtcttcatgcagaccatttttgtccaataccaacatttcacccggctcgatatcgcgcaatagctctgctccaatcgtttccaaagcacaggtttcggaagcaaacaaatatgcatcacctaatctgcccatcgtcaacggacgcaagccattgggatcagaagcgaccagcagtttatcgttggtcataatcagaaaggcaaatccgccgacaatacgcttcaatgcatctttcgcggcctccactaaatccttggatgaccgtgcgatcaaatgcgccactacttctgtatcgctggtcgtttgaaaaatagacccgccctgctccagctcatgccggatttgcaaagcattcacaatattcccgttcgtagctaccgctagatcgccatcacgatacttgaacaccaaaggctgtgcattcgttagcttactgtctccacttgtcgagtagcgcacatgtcctatggcaatatcgcctgtcagcgaagccatcaaatctttattgaatacttcttttacaagccccattccacgatgataatggaactcgtcgccactgctcacacagatgcctgcactttcctccccgcgatgctggagtgcatgcaatccgtaatatgctagggaagccgcatcggagtgcctatacactccaaacacgccgcattcctcttttaatttatcaaacagcccctctttaccagagccttcattataataatctccagtccacaacgtccgtgctgttatttcatcagacatggaatgacatcctcccagatttgcttcaaactggcgactgcctcgttcaaagcaggttgtccgttcacctcaactgtcaattgtgatccttcaacttttcctaatacagtaactggcacttccaaaccacgcagatgtgcttccagagcagacgctttatccggcgatgcagataacaaaatacgggattggctttcgctaaacaaagcatggtcaggacgcaaagtcgtttctacgttgacctgtgctcccaatccgctgctaatcccagattccgcaagcgctacagccaatcctccctctgccaaatcatgcgcagattgtaccaatccgccctgaatcgctcccagtaccgcagtcagcagttttttctctacgttcaaatccagctcaggcgggcgtccctcggatacaccgtgtacgacagcttggaactcacttcctcccagctcagccttcgtttcccctaccagaaaaatcacatcgccttcggctttgaagccttgtgtcgtaatatgatctgtatcatgtaccagacctaccataccgacaacaggcgtcgggtagatggagcctttagcattttcattgtacaagctgacattgcccccgatgacaggtgtatccagtacacggcaagcttctgccataccgtccacggctttttccatttgccagaaaatgtccggcttttcagggttaccgaagttcaggttatccgtaattgccaacggctcgccgccggagcatacaatgttacgcgctgcttcgctgactgcaatccgtccgcctacctctggatcaagatatacataacgtccgttacaatctgtcgtcatggcaagtcccttacgagttccgcgtacagtcacaacagctgcatccgatcccggacgaacggctgtactcgtgcgtaccatgtagtcatactgctcgtatacccatttcttactggctacacttggtgatgacagcacctttttcaacgcaccgttcaaatccgtcacttctgcataacgaagtgtgtcaatagcagcattttgctcataataagcagggacttcggaaggcttgtcataaatcggacactcgtcaaccagcgcggtcactggcatatctccgaccacttcattgtgatggaacaaacgcaaacgaccgtcatccgtcactttaccgaccttggcacaaataacaccccagcgctcgaaaatttccagtgcctgtgcttcatccttaggctctactacgaacagcatccgttcttgtgattcggacagcatcatttcataaggtgtcatgccctcttcacgctgcggtacctgatccagatacagctccaggccgttgccagccttactcgccatctccgcgctggagcaggtaagtcctgcggcacccatatcctgaatacccagcacaataccgctgtcgatcagttccagacatgattccataaccagcttctccataaaaggatcgcctacttgaaccgcagtccggttcgcttcagattcctctgtcagctcaaccgatgcgaatgtcgctccgtgaatcccatctcgacctgtcggcggtcccacgtagaacaccgggttaccgacccctttagcaacaccacgctggattttatcatggtcaatcagtccgacacacattgcattgacgagcggattgccttcgtagctttcatcaaatacgacctcgccgcctacagtcggaataccgatacagttcccgtatcccgcaataccggataccacatgctcaaacaaatatttcacacggtcgctctccagcttgccaaaacgcagagagttcaacaccgcaactggtcttgcacccatggagaaaatatcacggatgataccgcctaccccagtcgctgccccttgaaaaggctccacagcggatggatggttatgactttcgatcttaaatacaaccgcttggttgtcaccgatatctacaatgcctgcgccctcgccgggtcccatcagaactcgtggaccgctcgttggaaaacgacgcagcagcggcttggagtttttgtaagcacaatgctctgaccacatgacactgaacacgcctatctccgtgtaattgggctgacgtcccatgaattcacagatcaacgcatattcactgtccgatacacccatctgctgatacagtttatgttcggcaacctgctctgccgtcggttccttagcggacacttgctgcgccatgtcgatccctccaagcgttcaaaatagatgtaaacatacgtttgccatcatccgtcccgagcaatgcgtccaccgcgcgttccgggtggggcatcatgcccagcacattaccttgctcattacaaatccctgcaatatccgtcacggaaccattaggattatctttatacttaaatacaatctgattgttcgcctgcaaacgagccagcgtctcatcatcacagtaatagttgccttcgccgtgggcgatcggaataatgatctcttcaccagcagcatagtctcttgtaaaaggtgtttggttattcgcaacctgcaacaccgtatcccggcataggaatttcatcgacagattacggcgtaaagcccctggcaacaacccggcttcggtcagaatttgaaatccgttgcaaatccctaaaatatatttgccctcggcagccgctttggcaacttccttcatcaccggagcaaaccgggaaatcgcaccgcaacgcaggtaatccccgtaggagaagcctcctggaacaagaatacaatcataaggcgacagatccgtcgcagtatgccaaacataatcgacaggttcaccgaccgtgtcctctaccgccttatagcagtcaatatcacagttggagcccggaaaaaccagaactgcaaatttcatggaatcagccctccagttcgtagcggtagtcttcaatgaccgtgttggccaacagcttttcgcacatctcaatgatgcgcttttcagcactctcgcggtctgttgtatccagattcaattccatatacttaccaattctgacgctgtccacttctccgaaacccatagaatgtagtgcgccttgcaccgcaaccccctgcgggtccaaaacgctttgcttaatcgtgacatagactgttgctttcatcatgttccttcagttcctcctccgaatgagtgaatcctattggttgaattatgattactatttactgtgccgtcagacgccgccaaatatccgtatatcttgcagttgtttcttctacgacctcagcaggcaatggatcgggcttgctattcttgtcccaaccggatgatgccaaatagcttcgtaccggctccttgtccatgctgtcaatctcaacatccagctcatacttttcctgcgcccaaaaacgggatgaatctggagtgaaaatttcgtcaatcaaaatcaccttaccgttaacaagaccaaactcaaacttgcaatcggctaaaataatcccccgcttctcgcagaaagcacgtgcaaattcgtacaacgccaagctcttttcctcaagctcacctgtgagttcaaccccgaccagttctttcatttggtgaagggaaatgtcctcgtcgtgtccaacatcattttttgcagctggtgtaaataatggcttgggaaagcgctcgtttttacgcagcccctctggcaatggaatgccgttcacctcaccgttctgctcatactgacgccagccgcctccggtaatatatccgcgcaccacacactcaatgtcgatgcgttcagccttcagcgtgaccatgatccggtccttcagcaactctttattctgttcgtcgatcacatgcccgagcttgttcacatcagtgtgcacgacatggttttccaacaagtctttcgtctgctcaaaccagaaagcgctgagcttattcagcacattccccttttcgggcacgggtggctctaacacataatcaaaagccgaaattcggtctgtcaccacaatcagaaaatgctctccgagatcatacagttcacgcaccttgcctttatacaagagcggcgcatggatcaggccttcggcagtagacaatgacatttcattacacctcttccaaaagagtattcccctcctaaatcctcccctcggggaggacccccagggctgctgccctcgggactcccgcaagggttggcttggtgagcgggatgggggcgtttattatgtggctagagtggtgtgagcgcgttttgctggatgaaggcttgttcgcacaagttttcatccagcaacgcttttacgttggtacaaaacaacgtttttacgcacatgtcgccgcaataccattcggcccgtggccgtagcacggcatgccgtgcagcgagcattctggcttcgccctgttgtgcgcatgtgctacgctgcgcacggatacggtggctcaaggcttcgcttcttgagcctgcgcgttctcgggagggcagcgggctgtttgctgcgcaaattcggcagccctcccgagaacgtggcctgcgatagaaagcagtggaacactcttttccatcgcctttgggaaggtgcggcatcttatgtgccgcacctcccctagttctgctcccacatgagggttggtgctgggtgcagcggagcggacggaatcgttctggagaagcgtcagcgcttgcctttgcctctggattccaaccaatatctggacttatacaatcacaggaatccaggggcaacagcaatcggaagaatgatccgttcgcgcagcggcctcaccacgcagcaaccttccctcctactcccctaatcccagctttttgaagatcgtatccacgttcttcagatgccaggctgggttgaacgcatcctcgatttcgtctgcgctgagcacggccgtaatttccggggtcgcctcgacgatttcgcggaactggcgttgttcttcccacgcctgcatagcacgcggctgcacggtatcgtaggctttttcacgactaaagcctttgtcgatcagcttcgtcataatacggccggagaatggtacaccatacgtacgtgccatattgcgcttcatattttcagggaagaccgtcagattttttacgatattgccaaaacggttcagcatgtagttcaacagcattgttgcatccggcaggataatacgttccacagaagaatgcgagatgtcgcgttcatgccacagggttacgttctcatacgcagataccatatgcccacgaatcacacgcgccagaccggagatgttttcactgccgatcggattgcgtttatgcggcatcgcggaagaacctttttgacctttggcaaaagcttcttccacctcacggaactcactcttttgcagagcacgaacttctgtagcaaatttgtccagcgatgtggcgatcaacgctaatgttgccatgtattcggcatgacggtcgcgctgaagcgtctgtgtagaaatgggtgcaggcttggtgcccagcttgcggcatacaaattcttctacagccgggtcaatgttggcatatgtcccaactgcaccggacattttaccgtattgtacttggtcagccgcaaaacgaaagcgttccagattgcgcttcatttcctcgtaccacaatcccatcttcagtccaaacgttgtcggctcggcatgcactccatgtgtacgtcccatcatcggtgtatgcttgtaagccaatgccttttccttcaaaatttcaataaaatccaagatatcgcgctccaggatttcattcgcctgctttaacaggtagcccagtgccgtatcaactacatctgtggaggtcaagccataatgtacccatttgcgctcgtctccaagactttcggataccgtgcgggtaaaagcaatgacatcatgtcttgtctcctgctcaatttcatagatccgttcaatatcaaaacttgcattcttacgcagagccacagtatcctcttttgggataacccctaattccgcccaagcttcacaggcacacagctctacttccagccacgctttaaatttattttcttccgtccaaatcgctctcatttccggtctgctatagcgttcgatcatgactatttattcccccaaatattggtttgttcaatccattccagcgcttgttccgcatcctggcacaatagattaatatgtcccatctttcggcctggcttggcttcactttttccatacaaatgcagcttgggtacaacatccaatctttcagcttcaacatccgattgcgcaaaccgccgaaccacatcctccaaatgctcacctagcacattgaccatcacaacggaagtcagcagcttcgtgctgcccaagggtaaaccgcaaatcgcacgtatgtgctgctcgaattgcgacgtcgcgcacccctccatcgtgtaatgaccagagttatgcggtcgtggtgctaactcattaacgtacaattgtccgtcttcggtgacaaacatctccacagcgagcagtcccaccgcacccagcgactctgccacagccagcgccaacttgcgtgcttcctcctggacaggctctggcacacgtgcaggcacaattgacgtgtgcaaaatattgttcacgtgaatgttttcggcaggtggaaaggctttggcttcaccgttcgtgctgcgagctacaatcaccgagatttcgcagcgaaaacgaatgaactgttccaataccagttccgcaccgcctcctgccagttgttcgtaggcagccctggcttgctctggttggcgaatgaccacttgtcccttgccatcataaccaccgactgctgtcttgagcacacacggtacacccagttcagctaccgcttgaaccatatccgaagaactactgatttcacgatacggagcgacagggacaccagcagcttcaatagaacgcttttctctcagacggtgctgtgttgtgtacaaaagactgctgccttgcggtacgctggattcctgttccaaaagcgcagccacacctgcgtccacattttcaaactcatacgtgatcatatcgcaccgctcagccagttctctggctgcatgctcatcatcataggcagcgcggatttgttctgacacctgtccacaagggctatccggtgcagggtccagtgtcacaaagcgatatcctagattggttccggccagtacaagcattcttcctaattgcccgcctcctaaaagtccaatcgttgtaccaggaggtcggatacggcctgcgggttcacttgccccattcatagcgagtcactgccttccagcacctcatcacgaatacggtcgcgtctcgccaaaacccgctggcttatcttttcgtcaaaagcgcctaatatttgtgctgccagcagccctgcatttgtagcgcctgccttaccaattgccacagtggcaaccggaataccacccggcatctgcacaatggagagcagggagtccagaccgttcagagccttcgactgaacaggcacaccaatgaccggcaatgctgtcttcgcagccaccattcctggcagatgcgcagccccacccgctccagcaataatgacctttagtccacgcccagcggcctcttctgcaaaacgaaacattaaatccggtgtacgatgggctgaaactacttttttctcatatccgatttcaagctcgtccagcacagcacatgcatgctgcatggtgtcccagtctgatgtgctgcccataatgacagcgacctgcactgacatgtccttcactccctgtttatcaataagcgccaaaaatccggcactcgaaaataacgttattttcaagacaccggactacgaaaaaacaaacgacagagcctcttaaaggcatgccaaaagcaagcctcttccaccgcatccaatgcggcttcagccgtatgtctcccgtagtccggaaatttaaggtttccaggtagaaacttccgggccatatccccggcattatacgagttagcattgtgcctattccatcccaatcgatattctttacaagtatgatcgtggtttgtttcggctcaaacatgtgtaccttattaaattgtaccttaagttcattttttatcgataatacacttcctagtttaacaattccctacaccttatgtcaacttgaaaacgaacattagaataatcatacaatagaatgttcgtgtttagtgaaatcagtacccttatatacctacaggtcaggactattgtattatatttagctatcgctcccctcccctgataacagcgaccgcaacgcatcccactgaaaaaaataaaagtcggcactccctatacaggcagtaaaccgacttttactttttatttagttattttacgaccagcacaggaatacgcgcatgctgcaccacattgtgacttacgctacccaatacaaattcacggataccacctaaacctcggctaccgatcacaatcgcatcgaagccattctcattggcataatccaaaatgacttcggctggagaaccttgaatcagttccaccttggcatctacaccctgctcagcaagtcgttttttaacttcatccgtagtttgttcggccaaatcgtaatattctttatttattgaagccggaattggagccaaaccttcgcccataaagattcgaggaaaatcgaatgccgttaccacctcaagcttcgaggacggtgatgccttgaccaattcggccgcctttaacaaagccttgttggatgcatccgaaccgtcataagcaagcaatacttttgaaaatatcataatatgcacctcttcctcattcagtttattgattcaaagcctgaaatatgtattcctgtggttgttcattccatgtcaccggatggctgaaatagtcttctcactcatcattaaacttccctatgagaacctaaacccccagccttaccgtaaaaaataaccaaacagcaatgcgttcatgaatagcaacgcaggaatacctagtctgaagctcatatgccgtgttttatggcgtttacggtacatggcaattagaacgcctaacgctcccccgatcagggccaggaaaaacaacgtccgttcaggtacacgatcacgatgtttacgtgctctctttttatcctccgacattaccagatagcctactgcattgataaacagcagccataccaacaagcctgtctgcaatgtctctcctccttttgcacaccgtaccaagttcaggtattaggccttatatagctctctccccctcattataaccccaccccttttacagaaacaacgcctcttctgacttggatagcgcttttgcggaaatagtaaggtggcataagggcgatccccgagtgcatctatttcgtcttaaaggaggaactgcgatggaaagcacccatgaatacgttgaaaagctgcgagaaaatgcaaaaaaggcagaacgcaaccgtaaacgaggaaaaggaactcccagcgccagcttgccgacaaaacagcattccaacaatccttgatcaacgaatctgcattaagctgtatagccgcgttattaacctaaagtattaacttaaccctgcagccttttatgcgaattgattacagggtaaactctattgtttagcttccacaataacagcaagcagactccttatgagatatctgcttgttgttttgttttgcaaatgtcttttttgaaatcgattacatttataataaacaagttctaaagtcatattttctaacataagtgttgactaaaaacaatttcacaccctataattcgtgatattaacgtaattcgacaaaatatttgtcagttaatctatcattaatatttgaggtttaagattggagaggagctttatatgactaacatgaaaaaaatgacgatgattcccctgttggctagctttattctcggtagtaccttatggagtggtggatttaccgccaacgctgcggctacggcagcagctacgaccagcacaactgcacctgcttctaccactactacgtcggacaaatccgaaaatcctcaaaccaatcatttacccaatattaaaatacttgccacaggagggaccattgcaggatcatcttccgtcaatacggatacaaccggctacaaagcaggcgcgttgggtgtagaaactctgatcaatgccgttcctgagatgaaaagtattgcaaatgtcagtggtgagcaagttgttaatgtaggtagtcccgacgttaataatgagatcctcttaaaacttgccaaacgcaccaatgaactgcttgccagaaacgatatagatggcgttgtcattacacatggtacagatacattagaagaaacagcttatttcctcaatcttgttatcaaaagcgataagccagtagttgtcgttggctctatgcgtccagctactgccatcagtgctgatggtcccttcaacctttataatgcagtgaaagtcgccggggcttcggcctctaaaggtcagggtgtactcgtcctgctgaacgaccgtatcggtgcagcaagatacatcaccaaaacgaacacaacagcagtcgatacgttcaagtctgtggagcagggataccttggagctgttgtgggcgatcaagtgtactactacaacaaatccacacacaagcatacgacttcttctgtattcgacatctctaacctgactcaactgccacaagtagatattttatacgaatatcaaaacaatggtcgctatctgtatgatgcagccgtagcagctggtgccaagggtattgtcgtagctggttccggtaatggttccttgtccaagacctcctcagaaggcgcagaggccgctggtaaaaaaggagtgatcattgcccgctccagccgcgtgggaagtggagtggtgtccccgtcaacaaaagacgcggcatcgaactttgtatcgaccgattcgcttaatccgcaaaaagcacggattttgctcatgcttgctttgacccaaacacacgatgttaaccaaattcaatccttttttaatgaatactaaaagtagttatcccaattcaaataaatcaacattctattatgaaaaagaagcagcgattacggttgaccaccgtaactgctgcttcttttttttgcgagacaggtctagcattagtaactacttcatctgacgtccaatcgtcttggttctgtacaataattcgttgtccctcccacgcagcatcaagactgctgtttgggaatcccattcaagcttggaggatatttcgcttgcttctctggatgagcagcaatttcctcctccagtatgcttgatttattttgctgattattgattttaagcggtttatgtttgggcataaatactcacctcctcggcttaccatgccaaggagtgatcgtttttataccgacgtatacctgctgattatgtgactgtagcacttttggtcatccgttatttgccctgctatttgccctgcttttgttccatcgctgctttaagcaaatcacccaaactggagccaaaagattcctgcttttcaaattgtcttactagcttttgctgttcccgtttgtttacccgttgcttgtccttatccaacgtctcggtaatgccacagggcaggcatcttacatacaatcctgctttgccctctttcatttccattttcttatgacactgcgggcaacgtcgattggacaaacgtttttcccctgaacgacggtaaccgcaatccgcactgggacatacaaggaacttgcctttcttacccttcttctccaatagctttgtaccacaatctggacaatgactattcgtcacattatggggcttgtactccgcattgctatttttcacagtggaaaccagctctttcgccatagcacgaatagaattcaaaaacggttccggttgtccttgaccacgagcaatccgttctagctccgcttcccaacgtgccgtcaattcgggcgttcgaagctgtggagccgccagttcaatcagttgcttacctttcccggttggatgcatcacgttcccctgacgctcaatcgtatccgagctgacaagcttctcaattagatctgcacgggtagcaggtgtacccagtccatgcttttccatctgagcgagcagggctgcttctgtataccgcttcggcggcatcgttcgcccagctcgtacaaggcaacgctgtaaccggacgaaatctcctttttgcagctcaggtaaaataacgcctcgtccattgttttcccgatcctctgcttcttcatcatccatatcataatggttcgcgtcatatacagcacgccatccgctatcttttaccgttgtgccttttacctgaaacgtctcctgctccaccgttactgatacggctacagcatcataacgtgcaggtggatagaatagactgataaaacgtcgtgcaatcagatcatacagcttccgttcctcagggctcaactgattaagcaataatgtctgctcagtaggaataatcgcatgatgatccgtgactttactgtcatccacaattcgctttgtgattggtaggttgttacgcaatagcggacgtgccaaggaagcatacggacctactgctacactactgagcctttccttaagtgtgtccaccatatcggatgtcaaataacggctgtctgtacgtggatacgtcaccagcttatgctgctcatacagacgctgaagcagattagacgtctgtttagccgaaaagccatagcgctgattagcatctctttgcagttccgttaaatcatacgctagcgggtgaggctcgttcttttcgctctttttaacactggcaactgtgcctttggccccctcaagtctacggcgcaaagcctctgcttgagtgcggtcaaacatgcgtgaatccccgctttctgcccgccaagttgcctgaaaatcgccaaaatccgccgtcagagtatcatattcctgagaacggaattcggtaatttccttctcacgctccataatcatccccagcgttggtgtctgcactcttccagccgaaagttgggcgttataacgacaagtcaacgcacgagttacattgagaccaatcatccagtctgcttcagctctgcagcgagccgattcatataaacgatcaaactgctgaccaggcaatagctttgcgaaacctgccttaatcgccttgtccgtctgcgaggagatccataagcgccggaagggctttttccagtttgccatttggatgatccagcgtgccaacaattctccttcgcgggcagcatcggttgccacgataagctctccaatgtcctgccgcttcatgagctgctgcacagctttgaactgatggttactttcgcgcagcacctttaactttgaactcttcggaagaataggcaagtcctccaaattccaggtcgcatacttagaatcgtaatcctctggctctgctaagccgaccaaatgtcccagtgcccacgtcaccacgtactggggtccttctatataacttttatgcttctcgcggctacccatcacacgtgcaatctctctggccacggacggtttttctgccaataccaataccttcatgttacgctcctttctctcatagtgttaattatagcatcctgccatcttacgataaattctaatgccaacggctcttattaacatgatcgtacatactagtgctattgcttctacatgggttaggataacttacaaatcaggcacactccattttaatagcagacccgcataggtgaggcctcccccaaatccatataacaacacatgttgtccataccgtaaacgtccatcatccaaaccacactgcaaagccaacgggatggatgccgccgatgtattaccatacaattctacgcttgtcagcgttttttccaaaggtactgtacttctttcacatatggactcgatcattctcaaattagcgctatgaggtacaaaccaatcaagatccgccttcttcatattagccttatccaataatcgttcgattcccgttggaacagagcgaacagcccatttataaacctcacgtccattttgagcaataaatccatggtcttgcagcttctctccatccaaatgatcagataatcccacacggtaaagatgtgctcccccttgcccataggtacctatatctgaagttaaaaatgagccttcatcctcgtcatattcaacaagtgcaactcctgcaccatctccaaaaagtatgcacgtcgtccgatccgtataatctgtaattttggacaacgtttcggctcccactaccagcaccttacgatgcagaccactcgtaataaggccatttgccaaatgaagtccataggaaaaacctgcacatgctgcactaacatctattgaccctgtgtttggaatatcaaaatgagcctgaatacgtgaagccgtgcttggaaagtagtaatcaggtgtactcgtcgctacaatgatcatctcaacatcgtttatatttacgtcatacaggttaatcatacgagtaatagcttgtatacataaatcagatacatattgatcttcagccgcaatgcgtctttcatgcatacccgttctctgtacaatccactcgttactcgtatccacaagcttctccaagtcagcgttcgtcaaaatccgttcaggtacataagtgccaaaggccgtaagcttagcttttgaattcaacaatctgatcactctcctttgtaatccttattcacattataacaccagatactaatacctggtactaaattattttaaaaccgtcttcttatttattagttaatatccacttatccagttgaacttataacaaactcactttaaataaaatcccactgtcttttaacgcaaaaaaaagagaccaagatcttcagaagatcatggtctctcttgcttgttgcttggcgacgtcctactctcccaggaccctgcggtccaagtaccatcggcgctggagggcttaacggtcgtgttcgggatgggtacgtgtggaacccctccgctatcgccaccaaacatgaatttgctgtgcaaattcttccgtacggttattcggttcatcacttatcgtgtgaatgaatagccatgcgcttgttgtatgtatttctacataccttcaaggttacaccct

SEQ ID NO: 26 - DNA, 113391 bp, Unknown
  Kingdom: Bacteria, Phylum: Firmicutes, Class: Bacilli, Order: Bacillales, Family: Paenibacillaceae, Genus: Paenibacillus
atccagttttcagggtgtaagttttgtattgtataagcacaagtggcttatgtgaaacaagcgaacacacagcatttggcgatgctgattcctgaaaaagaatttacgatgtaaattcatgtttggtggcgatagcggaggggttccacacgtacccatcccgaacacgaccgttaagccctccagcgccgatggtacttggaccgcagggtcctgggagagtaggacgtcgccaagcaaataaaagtatgacctctacataaaaaaccgcgattatcgcggtttttttgtttccaaaaagatgtgcttgtcaaaaatgaagtatgaatcccataagtcaagacaagtaagacaaaataacacagttttgtttttgaaaaaaccatgttaaacttttctcataaaaataaatgtactttctgaggtgagttgaagtgttggaacgttctatggagaatacaagggaattacacaaaggaaagggagtgatttaaaaaagaaaaggagattataaatgagcacttatcaaacagttattagtgatggatttgagctgaaatatgctataagaggtaacggaagaccgatattggtgatcggcagtagtgtatattatcctcgcttattttcagaccatttatataaagagtttcagtttatttttctggatcatagagggtttgcaaaaccgactcgagctttaaaaccagaagactatactttggataaagttattaatgatatagaaacagcaagacaatgccttcatttaaatgaatttatcatattaggacattccgggcatgcttttatggctttagaatatgctaaacaatacccggactatgttcaaaaagtggtacttttaaattcagcacctacaaacagccaagaaagacaacggcaaagcttttctttctttaatgaaacggccagttcagaaagaaaggaacgttttgaaaaggacattgttttattagaggaagatatcaaaagagaccctgatagaagatttgttcacatgtgtatacgtatgggagctcaaagcttttatgattatgcctatgatgcggcttacacgtggaatgatgtatatacgaatatgcctatcattgattatttatggggagaagtattcggaaacatgaatttgatacaatccttagcggatatccataaatccgtatttattggtttgggaaggtatgattatttggttgcgccagtttctttatgggatagggtcgatgacacctacgataacgtgaaaaaagtgatttttgaatatagtgggcataacccgatgtttgaagaacctcattgttttgatcaaacactagctaaatggattaatgaagatcactagattcttgctatatcatctcttagatgctcagtggcccgtaaaatgagatcaccttcattttacgggcattcttattgagcgttatttaccttttgcaccgatgacaaaatactatgactttgttattagtgacttgacggcttaactaggttctgtataataaccgaaaggtaataatgtattgttagttttttgttgtacttctatctggaacagctcaaagggtcaaggagactgaacaatttagtaaagcaatgatatggaggccgttatgaaatacgaaattattttgtttgatgttgatgacacgctgtttgattttaaaatggcagagagtcatgcgctacataatacgtttgcccaatttggattgccgcaaggggccacggagtataaatccagctatgatgaaatcaacagttcgttgtggcgagaggcagaggaagaacatattacctcggcacagctacgggtcgagaggtttaagcgattatttactgttcatggtctagacttcaatccagatgcctttagtgctgcttatttacgttatttgggtgaaggtgcttttttgatggacggagcgattgaattatgtaatgtactatccgactgtcgtttggcgatcattacgaatggaatcaaagaggtgcaaacctccagaattcagctttcgccgctgcgtgatgtgtttgagcaggtaattatttcagaggaagtgggttgccaaaagccacaagctggtattttcgattacgcatttaccaagttgaccatctctaataaaagtaaggttctcatggtcggcgattctttaacctctgatattcaaggagggaacaaatacggaattgatacctgttggttcaacccttccagaaaatcaaatacgtctgggattcaacctacttatgaaataacaagtttgatggagctgccgaatagtgtactttcaaagtatcccgtactgaatcatacatcggctgaaactagatgaataatgtcgaaatcagaaggccggaaattaaggacatcgaaaagttgaatgaattgtttagagttgtgattacagacacgtttgctaaagaaggcattggtcatatgctggaaaacatagaggaggaaattaatactaagaggttatatttggaaagtgacttggagagtcacggtgagcagcgatatttcttaatcgctgtagatgggaatcaaataatgggttctattgaatatggaccagtaagtcaactaataagtaaatctaccagtgatacatttaaaaagttatgcgaggtaggaactgtatttgttcaccctgactaccagaagattggggtagggaatttattgttgaaatcaatgtatttggcgctgaagaatagaggagtagaagaattttgtttagatagtggatatcgtattgcgcagaaaatatggaaaaagaaatttggagctcctgattatttattaaaagattattggggagcaggctctgatcatatgatatggagaatcaaagtcaaggatgctattaaatgatcaatggcttggcaatctcttgtgtgtctttaatctacagggaccaaagttataaaacaaggcagtccggaaaatcggactgccttgttttaattttttcatcgatattcaccgttgctaactgcatttgttattagttggagatagctttaagtcggaaggtagagctggcgaaatctccagagagatccgagacaacaagcccaattttcattaggcggtcacctccaaaaatttcgccatcaaatgctacgcagaagggggaaccgccatcttccactaaggtattacccgcatggactgctgtgttgcccgtcgctccgtgttcgattatatattttttatctgggtcaagtccttttagagttagtcgccggatgggcccattcggttcagctagtacgcggaagtaagcgacaaaagcttcggattggtcctcgctaacgaacatccaggccgtatcgcctcggccttcaaatggactaaggagtcgatacatatctccctgctgtacgagggaacgaatttccttatactgagcaatttgtttggcagcgagctccttttcttcatttgtaaaggcagttagatcaagttcgtagccaaaattcccgctcattgccacgtcgccgcgtatagcgagggaggtgattcgccccacctggtgatttggtacgttcgatacgtgtgcgcccatggtactggctggatacacgatgcttgtgccgtactggatagccaatctttcaatggcatcggtatcgtcactggtccatgtctgcggcatatagtagagcattccgggatcgaatcgtccaccgcctccggaacagctttcgaacaagatgtccgggaactgggaggtcagacgttccatcagatcgtaaagtccgagcatataacggtgtgcagtttccttttgacgtccactaggagcagtagccgaagcaatctctgtcatattacggttcatgtcccacttgacataagtaatcggagcgatcgagaatacggagctaagcgtctcatacaagtagtcacatacttccttgcgggagagatcgagcaccagttgggatcggccttccgtccgccgccggccttccgcatgcaggcaccagtcgggatggctgcggtacagttcactatccggtgataccatttccggctcaacccacaagccaaactgtaatccttgttcattaacccgttttgccaggtcagcaagcccaccaggcagcttgcgacggtcttcaaaccagtctccaagcgaactgtcatcgttgtcgcgcttaccaaaccaaccgtcatctagaacaaagagctcaattccaaggggtcctgcttccttggcaatcgcttcgattttgtcggcgtcgaagtcgaaatacgtggcttcccaattgttcacgagaatcggacgttctttgtcacggtaagcccctcggcacagacgtgtgcgatagagtcggtgataggtgcgtgacatgcctccaagaccttcttcggaaaagaccaatacggcttcaggggtctggaatgactgacccggctcaagccgccaggagaagtcaaaaggattgattccgatacttacacgagtatgattgaactgctctacttctgcctgtgcgacgaagttgctgctgtagattagactgaaaccgtacacatccccacgatcttcagtcgcatcaggacgaagtagtgccagaaaggggttcatttggtggctgctggaaccccgtcggctctcgagccgaatggagccgggtccgagatcacggcgttggatatgtctttcccgaacccaggctccagataagtagagagcttggtagttggaatcggcgaagtcgacagaggcactcatggcatgttcaatatttatggtagcgcttcccttttgttcaaaaagagcagacctagcaatagcactgtggttcgcaaatacagtatagagcagtgtagtcttaagccccgagtattgatcctcaaggatcaaaaagagggttgtggcttcatcatccgattcggtatagacggaaggaagtccctcgagctttggtttacccggttcaatacggtaaccactatatttcagctccgtagtccgagttccgtccgcaagtgcaacctggtaagctggttgacgaaagtcgcttgttccatactgggggtattcctgaggaagcgtgtccaaagaaattgtacggctggaagaaacgggagtgggagagaaggagcaacgctccctaagctccaatatacttgcgagactttggtcatgatgaagttgagctccccaatagacatgtgcgggatatccttctacaagctggataatatagctgcaatccttggactgcaaatgaaacaaaccaagcgcctcgttaacatgaatgttcatgatattcactccttaggggggtatcattattgttttacgtaaggatactgatcaatgacaacaagactctcaagtactgatgttagccttttttgcatgagctctctcgaatgacaagcttagtcccgatcacgctgtacgctggtggttcacgtccctcaaaccgttcagagagcagttgcacggccgcctttcccatctgttcagggtaggcacggacagtggttagcggaggctgcacgaaggctgccatctcaatgtcgtcgaagccgacaacagccatatcttcgggtaccttgactccatgtccatgaagggcgcggagggcaccaatagcgagcggatcgcttgcagcgaagcaggctgtcggtcgttcctgttgggttaggagttcgttcatcatgagataaccatccgcggtactccaggtacctatacggacgaattgaggattgtacaacccctgttcccgcatgaatcgttcaaaataatgcgctcttcgctcaccgtcgctcttaccgccgataaatccgatttgtcggtggccaagctcaagtagatgaccgagtgcctgatcaacagcttgccggaaatgaagtcgtacagaatcatactccagctgttcatggtactggtcgacaaggacaatggtgttcttgtcaggatgaagcttgaatacctcttcagggtcaacgccgcccacaacaatcagaccgtccgccttctgcagggtgccgatggatgagcggcctcgcaaggtctggcccaacgtcaggccaagctcttcacagcgcagttcgattccacggcggatcgaagcgtaatacggatcgtctctttcctcctcaatagaacaccacagcaggagggagaccgttttcccggcacgttccgtattctgctttaattgcctcagccgggtaggcttatacccgagttgctcggcaaccccaaaaattctgtttttagtgtctgggcttacggacagtgacagatcgttatttaaaacccttgaaacggttgcggcagacacacccgcttcgcgggcaatgtctttaatggttgccaaaagagctcacacctttttagttaataattttactaaaaatcgactttatcctaacacatctctaaagcactttcaagaagaacggttgaatttttttaactttatttttgaactactactgtagagattgtttgtgttaacatgatgaatattctcttgatgacggaggggtcctagttgaatattttgtcactagctcgtaagtggttcggtcgacttcgctttaaaagcaaggttataacggtatttcttccgctaattattatttctctgcttattcttggactattgtcaaaccaacttttcagccgttctttgatagatcgaaccaccagcaatgtggtcgatgagtctcagctcatcttgtctaggaccgattatatattcaggagtgtggaaacggcggccaatattatggtcacgaatattaaccggatgtatgattcatacggtgccaaacctaatactgccatggagcctattcagtttggaaacttgatgcagagccgcttatccattgatttgtcaatctttcgtgaggtggatgccgctgtattcattgataacgaagggacgattttcgcctcttataccgaaagcggggatgatcgcaagatctatagcatgcttaagcaggtaagggaatctgaaagttatggacaggccctctggtttgatatggagaagagggatttcctaacaccagatcggagctctcccgttttgacgctggggaagatggtcattaatatagacaccggcgaaccctatggaacgctttttctgttagtgaaggaagaaggtttgtctgattactttcgttccagcgatccagatgcacccaaatcttattattttttagataacgaaatgcgcgtggctgtggcagaagacaatgagatgttgatgaatctggtgaatccacagctgggtgaggccatccaacgttgtgcacctaatgcatcccatggaacgtgctcattcgagtatgagggcaatctggtaacggtcacggattataaccggatggattggaagttggtcaatattgtttctcttagcctgcttacggctgatgtccggcaaaatgttagactgtcgctcttaatcggcgtgttatgccttattttttcctggctgggcgctagctttctatctaaaatggtcgttagccctctcgaacaactaactagggccatgcggactgttgtaaccggtgacttgcaatcggttacaacagtccgcacagaggatgagatcggtaccattgctgaagcgtttaattttatgataagacgagttcgggagctgctggatgaggtaaggcaggaacagaaccgtaagcgtgaatatgaacttgcactaataagtgcccaaattaaaccgcattttctgtacaacactttggataccatttatgcactcaatgagttagatcgtaatgaggaggctagagatactacaaaagcgctggcagatttttatcgaatggtgctgaacaagggacgggaattaatcactttagaaaaggaagctcagattactgatgattacctgacgattctgcaaatccgttatcccgatgtgtttcgctatgaagtggatatccctccagagcttgcaggtacaccgatcccgaagctctcgcttcagccgcttgtcgaaaattcgatttatcatggtcttaagaagaaagaaacaaaaggttttatccgtatttttgcctttaaacagggagataaggtggtcgttcgagtgcaggacaacggtgtggggatggatgaattccaagttcagactatcatgtccagacatttaccgaaagaaggaatacgatcaatcggtacctacagtgttcagcaacgactgagcctctattttggcgaagagtatgggatatccgtgcaaagtgtgctcacggagggaacaactgttgacctgttgctgccgatgctgccaaaggggagtgaacaccaagatgtataaagtgatgattgtcgatgatgaaccgctgttccgagactttctgcgtattaagatagattgggaaagtcatggctttcgggtttgctgcgaagcaaggaacggccaggaagcacttcaggaagccgagcggcatcagccgcatctcgctctcgtagatatcaatatgccttttattgacggaattgaattagccgagaggttgaaagtcaagttcgaacgcatcgttattgtattcatatccggacataacgaatttgaatacctacagaaggcggttcgaaccggagtacaggattatttgttgaagccgttcaatgcagaagaaatgctctcgatgttggaacgtattaagccgaaactaccagtgtttccacaagagagcgaaagtaccgagtggggtaagcatggtagcgaagcgttgcacggcagagcaggtatgcctgatttgggccatctgcgtgatgcggtcgtgctagacctccgaatgaaagacagtgaaacgttagaggaggtccgtaaggcaatccggcagcttagtatatacaagtggggggatgaatacgcggatgcgatgcttatgggaatcgtatctctagcactttcctttgcaagtgaacgcggtattccttatgatcggctatgggatgaaggagggaacaaatctccttacgaccggctgcgggagttggattcctgggaggctgctgaaggttggatgctcgccctataccgcaagctgatccagctgatggagaatatgcgtcctacgaaggcttccaatttgtttgcggcggcgatcaattttattgaggaacattatgcagacacagagttgtctgctgagcaggtttcgtgcggagttttcgtcgatccaagctatctccggcgcgtttttcgcaaggagtctggcttctccatagtagatcatattacacacatccggatgaagaaggccaaggagcttttgctgtatggaaatcggaagctgtcagaaatcgctgaaagtgttggatacagtgaccccaattatttcggcaaatgcttcaagaaacgctttggcatgacaccgactgaatatgagcaacttaaaaaaaggtagcgactttcctaagaggcaggacaaatcgatttaagcctggcggttttcctatatatggagaaccgctactctatttgtcccgttttttactgattaagcccgttttattccttaatcaaaaaaagaagcggcagtatactgtagtcatgcaaatgaaagcgtaatcataaaacacactgcatgagggggattaaacacatgaaaaaaacttacagaagttggagtgcagctttgctagtgctcaccatgtctattggattggtcgcttgtggcgaagataactcgacctcttccaagagcgaggcaggggacggtacgatcaaattgaaggtgtatgcgcagcattttgatgacgataccataaagccgttcgattatgcggtggaagagctcaaaaagaagatgccaaacgtagagattgaactggatcctgccgtgcaggatggaggccagaagctgaaaacctatgcggcaacgggaaacatgccggacatctatttagcggattggtctgttctgcaaactttcgcaaaatcgaaaaatgttgaggtgctggacaactatgacacaacggccgaattcaagaagaatcttaacccgggtgttgaatcgcgtttggtagctccagacaatcatgtatatgcttatcccgaaaccggtatagaattccaaatgatctattataacaagtcaatttttgagaaggtcggaatcaaaacaccgcttaagacgattgaccagatggccgatgcagcgaaaaagttgaaagccgcaggttatgtacctatgtcaatctttgccaaggaaaaatggataacgaccgctttttataatggactggttacaagggagcagccacatggattcggagcacttgatcagaaaggtgtaatagcattgccgaaagcatttgtaacagcggctcagcagatgaagcaattgcagagagccggattgttcgatgccaacgccacgaataccaattatgatcaggcatcgtccttattttatcaagggaaggctgctatgttcgtgaacggacaatgggaaatttacagttcacaagaaaagctgggtgaccaggttgactggatgtactggcctgcaaaggatgaagcaacctacgagaattccaaatatttcatagacggctcgggttcaccacaaggttacgcagtatcaccgagtagcaagaacaaggaaacagctgtaaaggtagcggccttccttgccaccaagtcagccgagtacagatacacccaacttggaagtccaattgtttcgcagaaagtggataagccaatggcctctaatgtcccagcaatgatgcagcgagtcgtcaaagagttgctgccaaacgcgcaggaatatgctcaacttctgagcaatacaaaaattcagaacactattaatgacaatacacaaaatttaatggtagacaatttctctgaacaggattttgtgaacaatctgaatagcacattggaaaaagaaaactgagaattcagggattcggcaacccttggcggataagtcgctgggggatgctgttccaaagataaggggtggaagcaagacatgaataaatatttggggaacaaatcggcgctcgcactgtttctcctccctgctttgatactgtacagtgtgatactgatatatcctgttctgcaaactgttcttcgcagcttttatgattgggatggcctgagtacgctgaccttttcgggactgagtaattatcgggaactgttctccgatcctctacttgctacttcgcttaagaacggattaatctttgccattgtgctggcggtctttcagatcggactgggaacactattagcgctaatctgcgcggacccgcgcacacgcgggcgaaaaatactgaaaacgtcttattttatcccagttgtcttatcggtaaccgtggtgtgccagctgtggatcgcaatctatgacccaactaacggattgatcaaccggctgtttgatctcttgaacatcccttatcagcaaaattggctaagctccccgacagcatcgattattgccatcgccttcgttaatgcctggcagtttatggggtatcaattcgcgctgctatatgcaggagttaagtcagtacccgaagactactttgaagccgccacgattgacggctgcagcaaatggagagcgcactggcatgtcacacttcctctgatgagggaaacttacaaattctgctttattattgcgattacctctggaattggggcctttgtgcagatgctgattatgacaaatggtggccccggcactacaaactatacaatgacattcatgatttaccgctatgctttcatggaaagcaactatgggtatgcatgtgctgtatccgtgctgcttgtattaatctcactattggcaactgtagtcatcaataagctgttcgaccgcggacaaaccgcctgataaggcgtgtatcgaaaaggagaacgaaatgagtaaaaccgctttgagcaagtttagacaagctgttctgcagataccgctgtggttgtattttattgtttcggtctacccgttgttctggatggtttcctactcgttcaagaacaacgatgagatctttgtctctaatccatttggattgccgacgcattttcgttacgaaaattacattaatgcctggacgcagtttaatattccccgttactttctgaacagtctagtcgtatcaacgatttcgactctgttcatccttttactggctctgatgtttgccttcgcagtggctcgtatgagatggaggtttcgttctgccgttcggacttatatgatcataggaatgtttatgccactgcaggttatcatgataccgctggcgattctggttcgcgattttcatcttaccaatacgtatggagctcttattcttccttatattgcaattggacttcctttctcgtccatgattttttacgggtttcttatagcaattcctaaggagattgaagaggcggcttgcatggatggagctaatatttatagactgttcctgaaaatcattatgccacttgcattgcctgcaattgcgactgtagccatttttcaattcttgaacaactggaatgagttcactttggcctatattctaatttctgatgaaaatatgaagacattgccactcggcttgcttttcttccaaggctcttacagcacagattggggagccatgggggctgttatgactatggcctccttaccgatggtactcgtctatctgttcttgagtgaacaagtggagcgggcgatgacggtaggttcggctgtaaaaggatagaaaggatagactgcccggggttgagaatcagaaaaagattctcaaccccgggcagttttgttatgtacatacgttagttcaatccgacgatggtctgtaggtaatcagaaaccttacagcaaagaaatgtttttgtaagattcaactgttgttcgttatgtagaaactaattatgctggtaaatagctaggcaaggaaagaagtgagcagacttgaaagatccaaagcaaagtttcaatgaaatattaaaaaatcgtaaaaaaaccattttaacagtaatagttgtcgttactataattatattgttaatcactctggtatttggcaccatgcatattatccggggttctatatacaccaccacgaaaacctcctaaatctacaacccaaggggattagattgttgttattgcttgaatgatcaaataaaggcattatagagaaatcagttgttaaaaattcaagcactaagaaggtagaaaacataatgcaaaagatattaatagtagaggatgaccctcaaatcagctccttgctccaatcctatcttgaaaagtatggttatcaaggagttattgtttcaaattttgatcaagttttagttgcctttcaaaaggtggagcctgatttggtactacttgatgtgaatcttcctcgtttcgatggattttattggtgtagacaaatacggactcaatctacatgtcccatcctttttgtgtctgcacgcgatgataaaatggatcaggtcattgctttgcaaaatggagcagatgattacattacgaaaccattttatcccgaagtactgttagccaaagtagaaagtaatctgcgacgtgcctatggttcttatgccgttgctccaaaatcacgttccttaaaagtgtcagctttgacgctatatcccaatattatggaacttgtgttccatgacaagcaggtcgaaattagccagaaagaagcagcactgttagagctattgatgacgtatcctaaacaggttgtgggtagagttcatctcttagaggctttatgggatgatcaccaatatgtgggcgagaacacattgaatgtttatgtcactcgggtccgtaaaaagctgagcgagctgggactgggggatatcatagagacggttagaggggctggctatcggcttcacttgactgaggaggatgaacggtgaagcttttttggcgtgaccatttttcgctggtgatttttaatatcatccaactttttcttgtgttaagtatctattggttggatggttaccgtaactggtcgacggccctgtattccgtcttttttggggcttccatattgctggtttatttgctcttccgatatgtcttgtactctggtttatatcgaatattatccactgcaaacctaagagatttagatgagcttattcagatgaaggtacttaatccgttagcctcttctttgcaacatttgcttttacaatattaccgattgtatcagtctcgaattcatcagttagagcatcagcagcgtgaccatattacatttatcaatcagtgggttcaccagatgaaaactccacttgctgttattcatttaatcctcaaaggaaaaatagatcctgaatctgatcagatttacgatgaaattgatcgaatgggaaaaggactagacatgattttatatatgtcacggttggaatcctttgaacctgattttcatgtggaacctgttgtattacgaaaactggttagtgatgtgatctatgataacaaaagactattgattcgtaacgaaatttatccttccaatgaagtggacgagcagttgtgtgtgataaccgatgccaagtggctaagattcataattaaccaattggtgaccaatgcggtgaagtattcttcaggtcatgcccacagtctgaaactgatgtctcacgtaagagatcatgtcattgtgatggaagtacaggatgagggaattggtatccctaaaaaagacgtagaacgggtatttgaggcttattacacaggtgaaaatgggcggaagtatcgtgaatcaaccgggatgggtctctatttggtgtctgaaatctgcaaaaaactgaatcataacattcagttaaaatcgacggttggtgaagggacgacggttcaaatcctgtttccaattcgcaaatgagaaaccttacaacagatttaaggtttttgtaatgttaatcgatcgcttcacttgtctggatggattatgatcatgacataggaaaaagaaaggaatgaattatggagattgtacgaatggatcaagtcaccaaaatatactatggcaaggttccctaccgagcccttaacaacatccatttaacgatcaaacaaggcgagtttgttggcattatggggccgtctggtagtgggaagactacattattaaacatgatttcaactattgatatgccgacttctggcgaggtttgcattaaaggagaaaatccacatcagctcaagaaggataagctggctttatttcgtcgcaaagagctgggatttgtatttcaggactataatttgctggaaactctcactttgggagagaacatattgtttcctctgatgctgaataaaaaaggattaaaggaaatggagcacaaactggaagaggtagcgaagaaactggatattattgatattttggataaacgaccttatgaggtgtcagggggacaaaagcaaagggcagctataggcagggctattattcactctccttcactcttgctcgcagatgaacccactggaaatctcgattccatgtcttcacgtgttgtgatggaaatgctggggcttatcagtcgtgtggatcattccacaatcgtgctggtaacacacggagccgtggaagccagttattgcgatcgggttatttttataaaagatggtgagttatataatgaaatccatcgtagtcatagtcagcaattattttttcaagaaattatagatatactctcctttttggggggaagtagacatgcgcatgagctttcgtctgttagcatggaataatctcaagcacaatgtgcgtgcttatgtaccttactatgtaagcagctcattgatgatttcgatttttttcgtatatgcgatatttatttttcacccggatgtctcagatgcaatcacagcagctaatgtaaaaaagggattacaagttgctgatctgttgatttttgtgttttcctttttcttcgtattatacacaaaccatatttttgttgctgcacggaaaaaagaatttggtatactgaccattttagggacacatcacagacagatttattttttggtcgcatatgaaaatctaattataggctttttatccttaattaccgggattatcggaggatttgtttcagcgaaattctttctacttttgggctccaatgtcataagaatgtatttaacgttttattttccttggaaagcactggctttcaccgtggtgggctttatgtttttgtttatattgatctcatttgtgtctgttttcttcatacgctattttaaattgcagcagccttttagcaaggtttcacagctgaagaaggatttaaaagcttcatggagcctgtcctttcttgccatagtattaataggagcggctgtatatttgatgaggattgattttccaccatacatttatctggcaccgtatcgtttggggactctttctttttatatattacactattcagttggagacacatttaaatatacaattgtaatgggatttattggtgtttacttattttacactcaattatgtgtactattcattcaattgcttagagctaacaggaaatggtcttggagcggaatacgcttattatggttatctgagatcacatacaaaatcaggaataatgccgggctgttttcattaattaccctgatttctatcatttcctgtgtaggagcagcgtcaacgtttgactccatgcagcagcaaaaaagatttcttaaggagcaatcttattcatttgcacttacttctgatgttgtaagttctatagagcttgaaaaagggattgaccaaaatcttcatacggctggggtagattattcgaaaggtgaagtattgatctttccctttcatgaacagttcgcgccagtgatgaaacaatccaattatgaggctcttgcttccaggtttaaggagctaaaacaggcagtagcgcttcgggatcatcaaggctttttcatttttgattcaaacgggatgtctttagaagaacagaaaaccttttttgaaaaaaagctaacttacaatcaaggaaaatctcagattatgaatattcagattatggatactcagaagttggaccataacttaaagtctgatgaaaacatcatctctgaactaggacggttacttgttgttccagatcgaacttacgaccatttaattgaacaacggtatttcaatgatccattggcatacaaatctgtttactactttgtgccaaaatggaagaatggtcaactttctttagatacttcagaaactcaacaggagatatggttgtattccgtgttggcccacaaggtgaataaaggggtgcttaactctagagcagtggattatttgacatcggagatggatctgaatattagcgaatttattggcggatttatcgccattattatgttggcaagcactgtaagtctattgtatttcagattgtatgtagatcttcaacgggatgaggaaatataccgagctttatcgaaaatcggactaaactcaagagaaatgagacgagctgcatccagacaaattgctttcttatttcttctgccattagtcgtatcatccataggaatagtgctttgtttagttatgtcagaaccatctggagtatatgtagtaccctttcgcattacgcttattcagattatgctgtgcttttgggcaatccaattcttttcctttcttattgtacggttcctgtaccttcgtcaattggatttgaagatgttataaggaacgataagctgtgtataaaaaagttgcagatggggaggagcggttcctcctttctggaatctccacggattatagacgatgcagctctcaattcacgatttccttgatggggagtcatacaaagaaattgtagtgtagaggaagaattgtaattcatataacaacgtatttattagacttaataaacttagaaagagggggatatctatgaaaaaaagtgtgtttattttattgttgttggccttatcaaccagttctttttcagggtcctttgttcaagcagaggggcagcaattggcttccaatgcaagtgtgaaactaacattgagtcaagcccagcaatgggcacggtctaatagctttagtttgaaagaagcccagcaaacgatagatcgtaaccggattaacctaaaaaatgcaggtaagaatctggatttcattccagcaggtgcaggcaacggtgaagaagacgcggctagtagctcagcttggaaggggtatgcttcatcgacggtttcttatttggaatccaagaagcaaatcgaacttgctcaagatcagacagactacaccacaatgaaggactattacgacgtacttttggctgacaacaaagtgaagagtagtgaggatgcactttcgcttgccttattggaggaaaaagctgctgaggcgaaagcgaaccgtggaaaaatatctccaggtgaacaaagcaccattattcagactcgtttagaagcagaaaagaatgtagagattgcaaaatctgcgctgcaaaaagcgttagaggtgctaaacacccaaatggggcaaccgcaaggtacggtatatgagctggttgatcgacccgcttaccggaaaatggataacacgaatttggatacgcttgtgacgcgtgcaatctcgtcgagtccttcggtatggagacaggaggaggctgtcaagctggcaaaaatggaagttaaatattacacatggaactcgggaacggacgattatgaaattaaacagattgatgtagactcggcggaaggtggactcaaaaataccaaggaccaattggcagaatcactaaagagtatctactttaacttacagcaaaatgatgaacaatacgaacaaatgcaaagtaatttacagaacgctattaaagtgttggacatatctcgtaaaaaaagggaacgtggatttgccacaggtgcggaggtcgccacgaatcagttaaaagcaaagcaaattgaacggaataaggatgaactcattattcaaatgacaatgctgcaacatgctttaaacaaaccgtggagcgtataggtttagaaaaaatacattttaaggggatataacattgtcggaaacagaaaagaaagatgcattgcaagtgttaagaaggaaaaaaagattgaaagggatcataggtattcttgtcttgattattatagcgggaattggcagtactgtttatatgaatagaagtcaggaaaagcccgtggagggtcctgcgaaccagatcgtacaggtacagaaaacaaacatgaccgaatcgcttaaagtaactggaaccgttcaggcttctaaggaagtcaatatcaattttacaaatgttgagggtgccaagctcattgccgtcaatgttaaagcaggagatagtgtcaaagcgggtcaggtgttggctcgtttggatgattcggattccaagttacaaattaaaaatgctgaatccaatgtagcgattgcccgagccaaggtggaggaagccaagcgcggaccaaagtctagtgatattgagctccagaaggcaaatgtcctaaaggcgcagatggcgattaaaacagccaaggattccatggagctggaagaagtcgctgcacaaaaagtggcggccaagatgattttggataaagcccagaaggattatgatgaccagaattatctagtccagaatgatgcagctgcagaaagtgacctggcgacggccaagcaaaacctggataaggcaaaattggatatgaataatgtcgaacttcaatacaagaaggcaaagaatcgacaagttcaggcgattgaggatgcggaaatgggctataaaacagctttaatacaattaaaggcagcacagtccccgcctgatgcttccaatattcaatccgcacaggcttctttacaacaggctgaaacggaattggaacagaagaaaagtgttctgaacaaattacaggttacggcaccgtgggatggaattattttgaaggttaatggcgatgtgggtaccagtcctacagcacctttcattgttatgaacaactccaatacaggcgttatgaaggttagtgccaaggttaacgaaagtgacattgctaaaatgaggactgggctccaggctacgttacacacgaattcattcccggacaaagaatttaaaggcgaagtcctctttgtttctccagagccggttacggattccaatgtgactacatacaaaattgaattgtctttggatagtcaaaagataagactacaaccagggatgaacatggatgtatcactcctcttggctgaacataaagatgcgttgtctgttccattgttcgcattgagatccgaaggtggagtggatggagtatatgtagcgaggaacccggctaaccctgcagattatgaattcagaccagtgaagctgggggtctatacagcggatcaggccgaaatcaagtctggtgtcaaggaaggcgaaaccattgttattccgccccagggtggtagtgctggtccgaatggcagtcaagagggtcaggaccctgatggaggtcaggcacaatgaacgaagttcgtttgaataaaagcgttattgaaattaaagaacttaaaaaaatatatgaggtgggcggtcaggagattcaggctctgcgtggtgttgatttatctattagcgaaggtgagtttgttgccataatgggcccctctggttcgggtaagtccactatgatgaatgtcattggttgcctcgatcatcctgatacggggaagtattatttggatgggtattccattttggatgctcgtgagaacgagctttccgagattcgaaatcagaaactgggttttgtgtttcagaaattttatctacttccccgaactacagcattagctaatgtagagctacctatgatgtatgcaggtatacctgccaaggaacgccgggaacgagctgtggaggcgctccgaagtgtagggcttgcagaacggatgtacaacaagcctaatgagctatctggtggtcagcagcaacgtgtctccattgcgcgtgcgttggtgaataatcctgttattctgctggcggatgagccaacgggggcactagatacaaagacgagtgtcgagattatggagctgtttcaaggtttgaatgaacaggggaaaaccattgtcttagttactcatgagctggaaattgccgaatatgccaagcgcctgatcagctttcgtgatgggaatattgagcgggatgagagcattatgaatagaagaatttcatcaaggatggcaagcctatgaatttaatggaaacgatccgtgtatcaattaacagtttaacaaccaataagctacgctcctttttaacaatactcggtattattatcggcgtggcagcggttattgccattatggcgattggaaacggctctacaacccgcataaaggcggaaattaataaattagggaataacgtattgatggttgcgccagctatgacaatggtcgatggtgaaatagattatgacaacactccatcgtttacttgggctgatgtcgaggcgttggaacaaaagaattccatagatgcattgatgccaaatataacgagcaattcaaaagctacgtgggggcgatacaactataacgccactattgtagggacttccgcttcattctataaagtcaaaaagttttcctttgccgagggcagaacatttaccaacgatgagatggacaaacgcatgaatgtcgccattcttgaaagtcaggcggttcaacgtctttttggtggagatacccaaaatgtattgggacgaacgtttcaaattaaacagatccctttcaaggtaattggagtattaaatactcagccagtaacgaaattaagctacagcactaatgaacaaatttacatccctgctacaaccataatgaaccgtctgggtgagaagaacattacaggattggacgtatccgccaagtcaccagctttgatggatcaggctcgttcagacatattggaaagcttgcgtttaacgcaccagctaaaaccctcggaaccggatcaatttcaaattatgagtctgtcagaagcagcaggtgctgcttcaggtgtagataatatcatgaccagcttgctaggaggtgtagccgcgatatcgctcgtagtagggggaatcggaattatgaatattatgatggtgtcggttatagagcgtacaagagaaatcggtattcgaaaagctattggcgccaagccgagagatattatgattcaattcctatctgaagcggtcatctttggtctattaggaggtacaatcggggttgtaacaggcataggggcatccaaaatacttgaggcaactgcacatatgaccattgaatttacgatctcgcctatcatatattcgtttcttagctctgcgggcacaggcatcctatttggagtatacccggcttataaagcagcaagtttgaagcctatagatgcattgagatacgaataataagcagggatatgaatttaaaactatcaagtaacgtaccgatttaaatcaaaacagaagggataagcaataatatggatattaaagatgtggaggatctatatttatcttgcaaatcagatctctttggatatctattgaggatattgcataacaaacaggatgccgaagatttgttgcatgagtgctttattcggtttataagagcttcacctgacttgcctcaagatcgtattcgattttatcttctgagaattgccaaaaatttagctatagatttaataagaaaacgaaaaaagatggatgaatacaacttacgtaaggagctgctctactatcactgggataccgtcgattttgaaattcaggaggaggtcaatcgaattcttttgatggcaagtaataccgagcaaaggacggtacttgaattgcgtgtagtccgaggatactccataaaagaaacggctagaatcttaaacaagagtgaaaattcggtaaagtcttcgctgcacagagcttcaaaacgcattaaattaagatatatttcctgaactgatttggatgaaaaacggagtagacatagagtctgctctttttttgcttgatacagagatataacaataagatcgatattttccaccataatagataataaatatcccctttttttggattgtttctatttataatgaaagcgcacccataacaatcaaaggagctgatttgttttgacacgtaacaaacgcttaagaagattgtccaccgccatgttaacggtgcctatgctcacgatgttcgcttcaggtgcaatggcagagcaggaattgaacagacataagcctccggtttctactggaagcggcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgcccctaaatccatctccaagctaccataaatatgatgtaactgattactatcaggtggacccgcagtatgggagtctaaatgattttcgcaccttgatgaaagaagcggaccgaaagggcgtcaaggtgatcatggaccttgttatcaatcattcgagcagcgagcacccatggtttaaggaggccagtgccaacccacaaagcaaataccacaactattacgtatgggcggatgagaacacggatctggaagaaaagggatcgtggggtcagcaggtatggcataagaatccgaacggcgaaggatatttctacggtacattctggtcgggcatgccggatctgaactttgacaatcccgaagtccgcaaagaaatgatcaaagtaggcaagtattggctgcagcagggtgcagacgggttccggcttgacgcggcgatgcatatttttagaggacagacgaaggatggtgcggataagaacatcgcctggtggaatgaattccgttccgagatggagaaggtgaatccaaatgtatatctggcaggagaggtatgggacaaaccggagaccatagctccttatttcggaccactccactccctatttaattttgacctgggtggaacgattttgaactccgtgaaaaacggccgagatcagggtatcgcgacattcgccgagaaaacgctgcaactgtacaaatcgtataataaggcagcactcgatgctccgttcttgagcaaccatgaccagacccgtgtcatgagcgaactgggcggggatgtgcgaaaagccaagctggccgcttccattcttttgacgcttccgggtcagcctttcctgtattacggggaagaaatcggcatgaagggagagaagcctgatgagtatcttcgtgagcctatgcgctggtacaagggagatggccctggtcaaacgacgtgggagaaacccaaatacaacacaggcaaggtatcggtggaagcgcagctgagggacgatgattccttactggaaagctatcgcacactcatccgtctgagggaagaacatgaagctttacgtagcgacagtctgcaacctatacaagcaggttctgccagcgtgaccgcgtttaaacgtacttcaggcaaagaaacaatgtatgtatatcataacctgtctggagagtcggttaccttgcagataaaagatttcgataagggtaaatggaaagtgatcttttccacctcaaaggatgtaaaggtgaagaaaggaacagttacaattccggcttacagttctctaattaccgaagaagacagaaagagctgaatatagggcaaaattaccgttcagatgaagcaaggatatatatcgatgaatccagtttggggtgttaacagcaccccatttttctatataagttttgctgcatacgaatagaggatttaaaaccgtcaggagatcagttatatgccaaaaagacagtttttacgacagttgtgtgttgaaccgggaaattactcgtttcaactagaccacttggatgcaaagcacgccccttagagtacacacagggaaggataaatgacattctcccgtgtatattccaaggggcattatttaataccctcaatcatagtaaagatcggacgattccatataattataaagggggtataccttccggtacctttcagctcttgctcttagcaagcaattgctcatcgaacggtagattctctttgatcgcccacaggtcgtcatagctgagaatccagcgatcggctctggacagatcctgccggccggagccggggttgtgaaagccgatgcagtacattcctgcacttttggctgcctggaccccgttctgtgaatcctcaataacgatgcaatgggccggtgcaatgcctagctgctcggcggcgtataagaagatgtccggtgcaggcttaccctgcaatacctcttcaccggtgattcgaatgtcgaagtaacggccaagtcctgtcttttccataatgagatcaatcagcgcccgtggagaggaagaggccaccgcgaccggaatccctttctctttcagccagtccagccaccgctccagtccgtcaatcgccacaaggccctcgtgcgcaatcatcgtctgcatcacattttttcggtgataggacagggcctcttccaccgtattggtgagctgatgcctgttcagcacttgacgccacatggattcgagtgtcactccgacataggtgtgatgctcttcttccgtcatgggcgcaccgaaatgggcaaaggagctgcgttcgacctcaaagtaaatcggttcgctgtctactaacaccccgtccatgtcgaaaatgaccgctttgaccggaacggacgctgataggcctcctgtgcattcattattggtcggtgtaacatgatggatgctcgtcatgtccattctctcccttgttagtagctaaatttagttgccggagccattagattgcagtacaatcttgatcgcctgagacgaaggctgaagtgtccgctcgctgatattgcatccaagcgtcttaaaggcttcatggtagtcatcaagcggatacgagtgggttatgatttttttggcgggaatgatttgttgctcaatcaggtaatgcgccgtggagaacgtgcccagagaatcaatcgagccgatgattttaaggctacggtcaactacctctttcggattaaacgaacttatcccatctctcagccccaccagcatcaaatacccgccgctcgcaagctggcttagtacctcagtgccgaccactcctgtggtatccacaatcatgtccacctgattttttaacggagccagctcatgaatggccgactccagtgtggcgtgcgcggaccaccgttcgggagcaatagaatccgctatagcgagccgttcctccgagatgtcaacaaggcaaccagttatgcctttcgaagcaagagcataactgtacagaatcccgatcggacctgcgcctaaaataacggttgtgaagttcggcagcaggtgaatctggttgattccggtcagcatacagctcagcggttcggtcagcgtcgcttcttcgtagctgatatggtccttcagcttgtacaaaaaacggtcctcagtcacataataatcggtgaacgtaccgtcggcgctaactccggtctcggttacggatttgtgtgtgcaatgattctgtcttcctgtccggcacatttcgcattggccgcagtagtatgttggatcaatcaccacccggtccccaggctgcagtgaactgacggctgatcctacagcgatcacatcccccgctgattcgtggcccaagatagtggacggaacggcatgatatttgccactaatgatacctaggtccgtaccgcatacgcctgtcgcccgaattcggacgagtacatcgttatctttttttatctccgggataggtctttcctcaagtgcgacatcccaagccgatttgtataccaatgcaagcataaataattcctccttttgcctgttaggcagatcgttagtgaagggtggtcagaacagtgtcaagccgcttggcaatttcgacaatctcatcttccgtagccgtgagggaaggtctcactttgaccacattgccgtaaccgtaacgggagcctctgagaatcagctgctgttcggcaaaagcgcggtcgataatcgcattgctcttaactgcgtctggggcattatcctcgtcgacaatttccagtccccacatcaagccgacgccgcgagcctcaccaatgatacaatcgtgcttgtcggccatctccgtcagcagggttccgagcaggcttcctttggaccgaacggcttccagaaaaccgggttcagatacaacctctagcgtggctttagctgccgtaaccgagattagattactacctgaggtgaaggagtgctcgtgcttctcgaggacattaagacgagactgcatcaatactgctgctaccggtacaccaatgccgccgagacccttggcgagagtaatgatatctggctggatatcaaacagttcacttgcaaacatatagcctgtccgcccaatcccggtctgcacctcatcagcgattaggatcagcccgtactcgttgcacagctgacggagacgcttaaaatatcctgcaggtgggatgatattgcctccgttgcccaggatgggttcaataatcatacaggccacagaacctgagcttgcatactcaatagcatccgatatggcttcgacgcattgatagccacacttgtcaggcgaagaattaaacgggcagcgatagcagtagggagcaggtacatgaagggaatttgctgcagccgagttgggaaacttcctccgccggaaggcgttgccggatatgcctgttgcgaattgggtctgcccatgatgggatagatacaggctgattatatcgagcgctcccgtatatttctgggctagcttcacagcgcattcgttcgctgtagagccggtaatatctctcatccatcccgcgtcaatgccgttcggcgtatactggatcaaatgatccaggacttcctcgacatagggctcggtaaaggatgaggacatgtgggcaagattggcgacttgttcctgtactttggtgacgacatgagggtgattgtaaccgagtgagagattgaaggtgccagatacgccatctaaatattccttacctgaatcgtcaatcagagtaatgccttttccgtatctgaagcgttctttggttaaggtatgcacgatgttcccctccatatcagaatatacattctcattaagtacatccttaaaaaatgtactgccctgctactacataaagcggtgggcctcacctcccccaagaataaagaatctcatccttccttgccctgatggacaagggagtcaactacccgtctgctcctgctattccacagatacgagaaaatgactgccagcagcaaaattaggctgaaagccgccaaaatccaaagggtagccgtcaccgaccattcgctcatgctccagcctgttacatattgaagcactgctccgccaattccgcctgacgcaattagaatgctggtcgttctctcggtcattcccggaatcagcacgttcgcatagacgagggcaatacagaagagaccggacatgaataaccctgcaccaaaaatcagaaggtatgtagcccactgactggagacaaacgccattgcgaccagaaagcagaaagttccgattccgctccacagcaggaaaggaatatatcctgcggactctgcaatcttccctgagaacatgcggccgatgatcatcgcaatccatagtatactaacacccaacgaagctacggattcccgaatctgcagggtctcgatcagaatagagggcaggaagttcatgagccccagttcaagccccatgtaaacaaagaagaatacaatgaatattcccagtaacacacggtgctgtacagagtaccgggcttgttcgaccgatcgctcagaggtttggagatctgcttggataaggtgggaagaggaggaagtaggcatggtaatccagaacagccccagaataaacgtcagaagggagatggtgtagaaggtcaaataccacactccaagccagatatacaggcttaccactgcgggaatgagcagtgcgccaagtgcaaaatagacatccagcttggacatggctacggctttctgctcttcggtgaactcaatcgtgaacgctccgatggacgactcaatgatgcctgagccgaagccaacccatatggtcatcacgataacccaggtccatgagggaagtacccccaagatggcatatcctgctacgatactaaccagggcaatggacagcatagacttgcgaccgatgtgtagagccatgaagggggagaacagaacaccgacaagaaatccgaaaaactgaaggaacaataataatccgccatcgctgtaccccagtccatagtaaggcagtaggaccggcagtaatgctccaagcaccacactagtaatgccgattaacagatagaaagcacaacttaaagcgaatagtctcttcaaggtccgtccctccataagtctatattttttatatggattctgttgctttactagattatacctttttcttggaaatgtacacatgtatttatataaaaaatgtaaaaatgatcgctcgacaattttacacgtatttacttaatccagttaaggtgaaacctgtttatccggagaaaccgcatggggaagggagaaataagatcagcccaaattgttttcgggcgccaaaccgctcataattaaggcataactttgtgtttgcaaaattaggttagtaaggatacctaacagttgttttacttaatacaactatgattgatagggtaggaaaaagaatgttaaccgcttacaatttaaaagggagagggaatttattcgaaagtcgagaaggagaaaaatgaagaagagaagaaggaatgcagtgcagcataattatcaatagtcatgtgtacggcttttttgaactttacaacaaaaggagtctaccaaaatgaatttttatttagaaatcccggagcttgaccgacattttcctttccggagttttattaataaaggcgacgtgctttgctatcctcattggcataaagaaattgaaattatttatgtgacccagggaaccttggatctgggaattaacgatatttcgatacgcatgaaacaaggtgaagttcagtttataaatgggggtgatgttcattatttcttggcttctcccgacagcgaacgggtggttattcaatttgatctgagcttttttcaagagatttccacattaagtgatcagaaacgccctcttagatatatatttacggagatggagcaatcaagctggaactggccagaagaaacagcagctaaaatgcttcctctgattcaaagcatttatgatgagaacgtcaaccaccacgaaggtcatgcctatatgatcaaagcgaagttgtttgagatgttgactcttattatgcgtgaagtgccgataagcatgacgccaaggcttcctgacatctctgaaagacccttaacacaatcaaaggacaccctttataaactggaacgtatttttgaatatgtggaatgccattatcatgaaaccatttcgctaaagaatgtcgctgattatatggggttcagtccctattatttcgccaggctatttaagaagaatacggggatgacctttgtagcatttttgaatgattacagactgaataaggcaaaatggattttgttgaatgaaaacaatccgatcactgaggtcgcagaggcagcagggttcagtagtgtaaagacgtttcatcatctctttaaagaagcaacaggaacatcaccattgaaataccgcaggacaatattcgggaataaaacagcaagaaatgaggaggaaagcttttcatgagatttgtatgatagagctatccgatgaagtgaagggagagttacgaggacattaaaatttattgatctatgagcaaccacttgatatgcggtgggcttaaatcaggagtggaggaagatgaaaatgggcaatcgtatatacaatgtagtcattatcggttatggaggcatgggaagctaccatgttcaattgatcgaatctaatcagcaacttgccgttggcggtgtatatgatattgtcgattaccgaatggaactggctgcggctgccggctataaaacctatgccagcctggatgccgtccttgccgatcaggcagtggatattgttttgatagcaacacctaatgatgttcataaggaaatcgcgatccaggcactgcaagccggaaaacatgtcatttgtgaaaagccggttacgataacgagcgcggatttattggacattgttgaggtggcgaagaaagaaaatcgtgtgtttacagtacatcagaaccgtagatgggatgaagacttccgaattatcaaagatataattggcaataagaccgtgggtgatcttttccacttggaatcgcgagttcagggggctaatggcatcccaggtgactggcggcaactaaaggcgtatggaggaggaatgctactggattggggagtacatctgttggaccagctgcttcagattacggatagcaaaatagaaagcgtagctgctacccttagctatattttggggactgaagtggatgacggctttaccagctttattgagttcaaggacggtctgaccgcagtcattgaagtgggtacaaccaattacgtaaagctgccgcgctggtatattaaaggaactgaaggaaccgcaatgattagagattgggatttgagtggagagatcgtcacccgaaatccagatgtcgctcacgtggaacccaagccgattcaagcaggtcaaggattgacgaaaacgatggcgccgccgtctgaggaatccacccttaggttcccgattgagaaaatacctgctgctgcagaaagcttttatgagaattttgtctccaccatcgaaggaaaagcggagattgcgatcaaaaatgaagaagtacaccgtgtattggtgctgattgagacgatttttgaggcggcagcaaccaaaagcgtgattcgaagaactatttaaatccgctctatttttcgatctatcataagagagagatataggatcctggagagaaccaaacagtattgacctaatgaaattttgggatgcatttgagtaatcagtaaacctttgaaatggtgagcaaaataattttgcccaccataaaaccaagcgggtatcgctccacaaccgaattctattgcttgatcatttttaagttgctgagatttcgaataggtttaatttacacgtaaagagaaaagaagtttttacataaaatccgctatttcctcttataaatcaatatattccactctgaattcttccataaaaacataaaataatccatgagagtgatagaataatcatttgtacgagaaaagaggaagggagagatcatcacggggatacttgtattaacatctgtaatgttgtaacgccgatcaatgctgatcaatgcaaaaaacgttgatgcggccccttcgaacaaccgaggtggtgcgaatcatgtttcaagcggcaatgcatcccacagtgatccaatgagagtcgccaggtgcaacctaccaggatttgattaatgctgcacacgacaaagatattaaaatcatacaggatgttgtgtataactactctagctgctggggtgcaaaagatatattgtacttgatctcccggataatcctgcccccggtaagatcggtgaaaacgggcctttcttgaagccttaatttttaaatataagaagcatgaaggaatgacattcctaggagtgtcgtgatttgaggttttaaaaacacactcataaacatatgggtgtgttttttggtgttgaggatagtcgttcatgccattaacagaattttattatgattaagtaattcgccatattcctcttcattgattgaaagtatcacagataacaagaagatgtaacatttttcgcagcttattacgttaatgtagacaccttaacatacttaagagtattcttatgtgtacttaagagggaccccatcgcaaccaaaactaatgaatatgaagtatataaaggaggcccatatatatgaagtctcatacctatgaccgtattaaaatcccgctaggattgtgggcaggattatgtcagttagggtttggcgcccacgacgtagctcgcaaagcacgattgccgatcaccattagtactgaaacagtagtcactaccgctcaatatttcgcgatctggcaggcatattctgatctcattggtgacactgcacaaggaatcatcaagcttgcgaccgtctttgatacagcgaagtacccaccgactgtcttagcgacttaccacgctcgggactaccgcgacgctctaaaccgaatggctcggtacaaacaactgtgtcccccggaaaacctacatatcactgagaagggcgagcactgtacaattgatctggaatggctgtctcccgagcaatctggtctgccgatactggtgggtattacgctggcttgtcttctggagattggacgccgggggacaggtcaacctttgacagcgcagcttattgaattttcgcactccatgggcgatgtacaagcccttgaagcatacttcggctgtcgcatccgaattggtgcaaaatgtaaccgattgacgctacatcgaagagatctggaccgtccctttgtctcgtacaacaaagagttgctggaaatcctgactcctgctctggaccgatcgttggatgagcagcagcgcagccgctcaattactgagatggtcaaatggatcatgaaacgtagccttacaggagggcgtcctgacattcaggctgtggcgaaggagctcagtatgagcgatcgtaccttgcagcgccggcttactgacgaaaacacgagcttcaagcttctattggcacaagctagacatgagcaggcacgagagtacttggcagacccctcgctcgatattaaagaggtggcatttttgattggatatgaagaccagaactcgttttaccgtgccttccgcctatgggagggtgatacaccttcaaattggcggactgagcatttaggtacaaactcgatatcaggagcacgttaggactgcctaatgagttttatcatttggcgtgttaaacaagaactttggcgcaatatgctagttactggacaatccagacaagttaatataatcactatccagagctcaagactgttttaaaaaaggagaagtgtattatggatatgggattaaaatataaaacagctttagttacaggatcaacgaaaggcataggtaaagcaactgccattgaactagccaaagaaggtgttaatgtactaattaatggacgaaattatgaagaggtagaacgaactataaatgaaattaagtcaaatttcccagctacctcccctcaaaatgcgacagccgatattgtggatattggacaaagagaagctttatttgaaaaataccctagtattgatattttggttaacaatacgggcatttatgaaattatgcaatatgaggacgtagacgatgaagtatgggaaaaatacttccgtactaacgttcttgctgcaaatggattatcaaaattttatttacctaaaatgttgaaaaatgattatggccgcattatttttattgcgagtgaagaagcaattatgccttcaggacaaatgccgcagtattgtatgacaaaatctatgttgttatcattgtcaaaaagcttatctaaattaacaatagggacagaagttacagtcaatacgatcatgccaggaccaacactctctgagaatgtgcaccaaatcattgagagtatgtatcctcatgaagatatgactttttcagaaaaagagaaagattttatggttacaaacctgcctcaatctgaaatacagcgatttatcaagcctattgaaataggtagactagctacatttgtatgtagtccttatgcatctgcatttaaaggttcgccaatccgtatggatggaggaatggtaccgactatttattaacgcttgtggagaagcttgctgaaattagcgctgacattgtggaacattataataagatgaagtcaaatattattcgagggtaggatgaggatcatgaaccattttgctatgtatggaaagttgacggcacgtccagggcaaagggacgctcttgcagacatcttgctagaagcggccgatctgttgaagtcgaataatgactgctatttgtatatagtcaatgtgtcagacgacgacccgaatgcggtgtatgtaaccgaactgtggaaagatgcagatgcccatgcagccagccttaagaacgaagaggtactggcgtcgatacaacgcggccgaccgttgattattggagcggagcccattaaactacgtgctctagggggaaaaggcctgtagggccatgatgcaagtgctgctaccactgcagccgatcactcggttgtttttaagctaaccagcaggatagtcctaatgaaacgcttttgtaatatatgaaaggttggcagataaaattggccctggtataataagggtaattcactaaggagagatttttttgtctggagctgttctttactaatccaattccataaaaagaggttttcatgcacctactattcgtctgcccaatttttgtattacgggtggggatttgaaagcttcggaattagttaagaacaacggatactatcagatccttagggatacctgttataatgagtccaatccgtgctggttcagcgcggatttttttgtggctaaatagcaggtgatatgagggtaggaatgacgtatgttcattcctgcccttttctaattttagcaaagggggatagaagggaattactccaatttggtcaaatacaaccagacttcttgaatgaaagattcaatctaagtaagtagaaaggtggacaatacatgaaacttcaaacgaatcggctcctattaaaaacacttgatcttaatttaattgaagcagcagcccgacgtgatataggtgctattgaagctttgggttataaaaccagtgatgaatggccgggtcctgatttctttgaagctttaccttattttcgagaacttttgataaaaaataatggcactagaggttttgattcttggatcattgtggagaaggatacccaagaaattgttggagggattggttttttaggagatcctgatcagaacggtatgattgagatcggttttgcaacgaatgaaagtcatcgccgcaaaggctattgctatgaagccgctcaaaaattaatagagtggtccttaaatcatgaagaagtccaaatcgtaacggcaagatgcgtacctgacaataacagctctaagaatttgttattgaagttaggatttcaaattaatcacaaagatgaagaattgctttattggaaatatcaaatgaagaaagtaggagggggtcaggagaaatgatccggcgagatctagatgacgtagatttcataagagcaaatttaatggggcctagttcgattatcatgctcgaggagctatcgaaaaatttgactttgtagaaaggaatgcgagtgctggatttgggctgtgggaccggactttcttctatctatctggcgcaaaagtttgacataaccatagttgctgtcgatttatggattagtgcaactgaaaactatagaagattcagagagtttggtttggaaagccaaattatccccattcatgcagatgcctgccacttgccttttgcagagcaatacttcgatgcagttataagcgtagatgcgtatcaatattttggagcgaatgagcttcccagtcctatggggtggaattcgctaaactaactaaaaacgatagttcaacgctaccaaaaacagccgagcactcggctgttttttaactaacgggcagattacactaatgcagattcctcatcgcatgaagcggttaatcgatgctagggtcgaacgtacaggcttaggtcaaagagtaaaaagcgagaacggcccatgaaggcctccacaagttttctcaattcccgacgggtctacccgaatacggagaggctttagaacttgtatccataacattttttaaacacagattgtcgatattccaaaaaactgtttaacagtgcttttttctctctaatatcatcattttcttttgaaatgccgatataaaattgagtctagagaactattttatacataaattttacctaaaggaagtggaaagagatgtttaaaaagaaatggcttatcaccccgttggttgcgacgacactatttttcggtcaatctgcattcgcggcaaacacgtttcctgatgtggaaggaacaaaatatgaatgggctgccgaatcgattcgttccatggtcgacaagggcgttgtcaagggctatgcagatgggaccttcaagccaagcaaaaccatagcgaaagcggaatttgtacatatgtttcacaagctttttccagaaatcaatcattcttccggcgaaccttccgactttgtggatgcgcgtaaacactgggcgaataaagattttgcagcaatattcaacggggactacgtctggccgtatgctgaaagtgttggcgggaaatatccaaactatcaattctatgtcaaacctgacaaaccattgacccgatgggatgtgatgatgatcgcctctcttcggacagattataccaatcagacgcttcatcctgagattgaggaagtgatttccgcagctgcgcagtacaaggatataaaagttcgtcaggccaattacaatgacaatttctcggcctactatccggtgctgtacatcgacaagactggagaagagtacaactatgatggagattcccaggatcaaaaggcagaagcattctacaccctaaccaagatgggagtccttactgctaatgaaagataccttcacccaaaagcgctagtcacacgggctgaagctgttaccattttacagcgtttgtacgaagctacaacgaagtcagtggaggatcgacactaaccgcttgcgtattgtagccatcaaggagactgtctacataaggagataaaccgctttggagatttctacttatttagttacgtatctatgacgacgcctaaccgtcgattactgtcgaatgaaacaatgtataaaagtcgccaaattggcggcttttttgttttaacgatagatgccagtcaatagtttagaatatgaaattttcatgtaaattcattaaaaagctgaaaacaattcctttttttaagcaaaagagggtattgtttttgtttataaaatatatgtattatatatcactgtactttaattcaatttaatgtttataataaattaatagccttaatctatgttttactacactcatctatgatgctgaagtttctaagtatcaagcctgaacttccagcactctccattttttttacacttccaagtctacttacacactttttatttctaactacatcatgaaactcaaaaacgatttactttaacatgtcgattactgtttgtttgtggcaagacattttgttgtttttgctgtatctattttaaatacataggaatgtgaacatctggatcccataaaacatttgttttaccgctttttttatggtgaggaaaggggttggatatgaaccgcatgactttgcttttttcgggacaagggtctcaatatgtcgggatgggagcgacatggcatgatggtttttcagaggcaggtcacatttttgaagaggctgctgatattttggggtatgatttgaaaactttatgtatggaaggacccatctctcaattattgagaacatcctacacccagcctgcactactcacgatcagtgtaatcgcattcagacgttacatgcacgatgttgggattattccccaattttcggcagggcatagtttgggtgagtactctgcattggtaggcagcggagtcttgtcgtttggcgatgctttgcgggtggtgcaagaacgaggacgctttatggaagaagcctcagaggccggagtgggttgcatggttgctgttcgtggggctgatttaaatctactagaagagctgtgcgatcattatgccgtaaccagtcagcctattaccatcgcatgttataactcttcctatcaatacgtcgtttccggtcatcatgcctctgttgctgcggtggcgggacaattagagcaacgcgggttccaaattacccgtttgcaggtaagcggcccttttcacagcccgcttatgcagcatgctgctgaccgattagcattggaactgcaaaaatatacgtttcatgaaccactgtggcctgtcatttctaatgtcacagcactaccatatacggatgccaacagcattcgtcaaggtttgcatttgcaaatgatccgtccagtgcggtggatacaaacgatgcagtatatggagaaacatggggtgaagcaggggattgaattaggaccgcgaacggtgctgaaaaacttggcaaaggaaacaaacatcgcttttgaggtgctttccttggacagagacttggatcggattgaactggaacgtcgtttttcgatccgtgattggttggtcaaaccgctggcggtggcggtgtctacacccaatgccaattggaatgaggatgagtatcataagggggttattttacctattcgcaggttggaagagttactcaaaagcatagaatcgggcaattcttcttctgcttatgaactaagacgcgaagcgctggagtgtattcgcctgatattgcaaaccaaacaagtatctgcaggagagcaggaggtagttttagaccttttgaggagggatcaggatggaacagtttcaaactttaattgaaatcattcaggaccgagccagtagagctgaaaatgggattattttcatttcgggtgatacacaggaggagtatgtaagctacagtcagcttctggagcaagcactgcaggtgcttcatcaattgcaggaaaaaggagtacagcctggtaataagctaattatgcaaattgaagacaatcatacctttgtgaatgtgttttggggctgtctgctcggaggaatcgtccccgtacctgtaagtatcgggaataatgatgaacataaaatgaagctgtttaaaatctggagtacccttacttccccttacatgattgcggatcataaagtattagagcagctagaaaagtattctcatcagcatgagatgctggatttctttgattctgtaaaaaaagcgaccttttctagtcatgattttgattattccgatcagaacaaagggaccatacatgaatccagaccggaggatttggcgtttattcaattttcctctggttcgacaggtgatcctaagggagtcatgctgacgcatgagaatctcgtatacaatattcgggatatcgccagtcaaacgggaatgacttcaagtgatgcgtatctgggctggatgccactcacacatgatttggggttgatcgcttttcatttaacttgtgtcatcgcccatgccaagcaactcattatgccaacagctctttttataagacgtccttcattatggctaaaaaaggtgtcggagcatacggtgactcaaatctgttctcctaacttcggctataaatttttccttgatcaatataaatccaaaacagcggataactgggatttgtcaagtgttcgtatgattttaaatggggctgagcccatatcggtggagctttgccatgtatttatggaagccatgagtgtacatggattaaataaaaatatcatgtatcctgtatacggcttggcagaggccagcgtaggtgtctccactccacctttggataaagataattttgttaccattcatttaaatcggcagcagctgcatgtaggtgaacctatagaagaagtagattcatccgataagcgttgtcttacgtttgcggatttgggctaccccatggccagcacctccgttcgtatttgtgatgagcaaaatcaggtgctaaaggacaatgtaatcggatacacccaaattcgcggcaaaaatgtgactgccgggtactataacaatcctgaggctaccgcaaaggtcaagacaaaggatggctggctcattaccggagatttgggttttatgagaaacggacgactggtgattacaggcagagccaaggacattattttcgtgaacggtcagaacatttatccgcatgatatcgaaaggattgcagaggaactggacggggtggatctggggaaagtagctgtctgcggtgtacatgatgaacaaactcggcaggatcgtattgttgtttttgtgatgcacacgaaaaaaatagagttatttttaccactagtccaaaggctgaaaagccatttgaattatcggggaggatggcatattcaagatgtagttccaatccgccgtgttcccaaaactactagtggaaaggttcagcgctacaagctagctcagagctacgagcagggagaatttgatgcagtattggcatccctggcggaggccactcaaattacacaggtagcgaaccatgcccctattcatcaaggtgagatcgagcaaaaactgattgggatttgccaagctattttaaatgtacagtcaattggaacggaagacagctactttgatatcggcgtaacttccttacaactcgttcagatcgcggaccaattagaggaacaactcgggattcatattgaggtaacggacttcttctcttacccgactatcgccaagctagctggatatatatccagtcaggatttaggtcataaggtgattacagcaccgcaaccagaatccaaagaggaggtagaggacctggatattgctatcattggcatgtccggcaagtttcctcatgcggatacactggagcagttttgggcgaatgtagcttccggtacagaccatatcagtccatatagcgacgaaagaaaaaaggatgccgaagcttttatttcccgtctgaatatggaagggagaaacatgcaaatcgccgaaggtggctatctggatgaagtggacaaatttgactacaccttcttcaagctaactccacgggaagcttctctgatggacccgaatcaacgtttatttctgcaaactgcttggagcacgattgaggatgcaggctatggaggaaaacagctgtcggggaaaaaggtaggagtgtatgttggattctccaaaaccagctttgaatatgaacgattgttgtccgaagtggagccaggggcgattccaaactttggcataggcaatcttccgtccgttatctccagtcggattgcgtatttgcttgatttaaaaggcccggcactgaccattgatacggcatgctcctcgtcactcgtggcggtacatttggcgtgtaagtcgattttgaatggagactgcgagatggctttggccggtggagtgaagaccattttgctgccgttgaaagctggcattggcatggaatcctccgatgaccgggcacgagcattcgacgatcagtcggacggcacaggctggggagaaggcgttggagccgttctcttaaagccgcttcgtcaagcggaaaaagacggagatcacattctgggtgtgattaaaggaagcgcgattaatcaggacggcagtacgattggaatttccgcgcccaatgcgctggctcaatcagaagtcatttcgcaggcgtggcgtgatgcacggattgatcccgagacagtgagttatattgaagctcacggtaccggcaccaagctaggcgatcccgttgagattaagggcattacccaggcattccgcaaatttacacagcgcaagcagtttgtggcgataagcacagtcaaaacgaatattgggcatttatacgaagctgctgggattgcgggattgatcaaatgcgtgctgtcaatgaaacatcagcagattgcaccgctcgttcattttcgcacaccgaacaggaacatccattttgaagaatctccggtgtatgccaacactagactgagggaatggaagacagacggattcccgagaagatgcggggtgagttcctttggcttcagcgggacaaactgtcacgtggtgctggaagaatatatagcgaaaaagggtgcggaccaagaaaccaccgaccgaaaaaatggatcatcgccattgctgctgacactatcggcgcgaactgaaggagctttaagcgagttgattgcacggtacgtggatcgctttgaacgtgaggaagaattgccgatggaggatgtctgctatacagctaacacaggcagaagtcacttaacatatcgagtggctgtgatagccgaaggagcgaaggccctgaaagcgaaattacatcagcttcatgagcagggcaaggccattgaaggtgtatacattgggaaagtagatagtagtggtggtacagaaacagccgtcggaagctcggacactttgcaagcactggagcaagtagcagtgaagtacgttcagggggcacaaatagattgggacacgctatacgcaggtcacccgtacaaaaggatttcgctgcctacgtatccgtttgaaaggaaaaggtgctggattcatgttccagaacaggtgcgagcggagcagactacacccgtttataaaaatactatagtaagggagtctgaaattatggggaatgagtattcgacgtcagtgtcgtttactgaacagcataaatcttccattcaacaaaaattagcgaaaatgatcggtaatgtgtcacaacttagtcttgaggaactggaaccgcaaacacattttctagaactagggctggactccattaatttgtcccaggtccgccacagcatcaaggatacattcgacctggatgtcccaatgaatgaattttttgaatcgctgaccacgctcgaattgttgactagctacgttgcagatcaggtgagttccgtttctgacgaggcagcagttggtgctcctgaaagccaaccgaaaataccccttaatcgggtagatgctactacagtatcaacctggacagggcaggattccagcgaaattggtacatcgactcatggaatagttacgtccgggcaagagccatttcaaagcacaacagttatagcgacttctgctggtatcgagcagattttgcagcagcagctgcacgtgatgtcacagcagcttgatgtgctccgaactcaaccgactcctccgacatccgtttctcaatcatttcaaccggaaagggatttgtcgtcagcaaatagaggaagcgcagagatcattgaaaccaaacaggaagtcgcaactgcattagctactgtttcaccggtactagctgttccgaagaagacaggccatgaagcaaaactgtttacgccttataaaaagctggaggtcaaagcccatgaattgctttcacaccgacaagaacaacatctgcaagagctgattgagcgctttactgctcggacgcgaagcaccaagcagtacactcagcagtatcggtctgtctacgcgaataaccgtaatgtagctggcttccggcctattttaaaggaaatggtctatcaaattgtatctcaacgtgcagacgggtccaaaatttgggatttggatgggaatgaatatgtagatttgaccatgggctttggtgttaatctgtttggacacaatccagcctttatccgtgaaaaaattgaggcagagctaaagaacggcatgtgtgtcggacctatgtccaacatggcaggacaagtcgccgagaagatttgcaagctgaccggtgtagaaaggatcgctttgtacaattccggcactgaggcggttatggttgctcttcgtttggcgcgtgctgccaccgggcgagccaaagtagccatttttgccggctcctatcacggtacattcgatggggtgcttgcgttgggtagcgctggcaacaataaggagcattccacacctcttgcgcctggcattttgcagcacatggtggacgatatcgttgtacttaactatggaacggatgaatcgctggattatatacgcacacatgggcatgagctggctgctgtgcttgtggaaccagtgcaaagccgtcgtcccgattttcagccgaaagtctttttgcaggaggttcgccaattcacggagcaatccggtacagcttttatttttgatgaagtgattacaggcttccgaattcaaccgggaggcgctcaagcgtggtttgatgtacaagctgaccttgtgacctacggtaaagttattggcggagggatgccgatcggtatcgtagcagggaaagccgcctttatggatgggattgacggaggcacctggagcttcggagataattcctatcctcagaatgagcaccggcgaacctttgtagctggtacgttctgtcatcacccgctggcgatggcggcatccctagcagtgttgaattatttggaaaaccacggcgaacagctgcaaaatcagttgaacagccgtacttcggcgttggcagcagagttaaatagttactttacccatgagcagatacccatgaagattgttcactttggttcactatttcgcttcgtactcaagggtgatctggagcttttcttctatcacatgctggaaaagggtatttacatctgggaagggcggaattgcttcttgtcgaccgctcatacggaggaagatattgcgcggatcatacaagctgtcaaggacagtgtagatgagctgcgtaaagggggcttcttgcctgatctgaccccgatcgggaaaggcctaggtccaggtaagcgaagtgtgtatatagctgacccttcagaagtatcgacagtggatgtggatgaaacggtcattccactaaccccggatcaaaggcagttctggttcgcttaatgtcaagaaacgaagtgacttcttaacatgcgaacttatattaatgtgagacgttaagtgaattggccaatcccgtattattttgccgaaaaattaagtaaagtgcacctcggcgtctttacgctccaaatttgataaaatgtcaggttctattcttaggacttggcatttttagtagtgcaggtaccaattataaaaaagccagtggaagaaaatcgcaattgggctgtgaggctgcgctgaatcgacaacaaaggtcatattttgcaagtggttgtaatcgcacgtaaagggcagagcaaccatattaaagcctttgagtctttaatttgagctttgagtgtcgtgaattttaaagtttatgaggacgcatgtcagcgggtaaaagaaaagatttgagtttttaagaatcaatactggaaaaaaactatatcctgcataataagttgaataaaagaatttagccattaatggtttaataaaacaaattagatcctcgctttaacagatggataattatattttattagtatgaagatggttttcttatacagtggaccgttcatatttaccttcctatgagagaactctatctctacccctagctaggttgtatcgtactttttaggctagcgtcacagctgaaaaggataaaattattccttgaatcccccatagtaaaggagtctgaaaagatggtgaatgagtatttctcgacggaatctgcttccaatccgcaaaaatctacgattgctaataaactgtcaaaaataatcgaaagtgtatcccaactcagtccagacgaattagagccgcaaaaacattttttagaactgggtttagactctattcttctatctcaggttagacacagcattaaaagtacgtttggcttggatatcccgatgaacgagttttttgaatcactgactacgctggagttgctgacaaactatattgctgatagggtaacctcgacctctgaagaattgacccggaattcggaggagcttcagttgactgcgtcgtccagtgtcacctcttcggtgccttccgtcttgccggactggagtcaaaaatccactatccctatagaagatcctgcatcccatgaaagcaagctatcaaataaggatatatttgcggggagagaacgaattttagaaatgcaacttcaactcatgtcgcagcagatggaaatactgtgtcaatctcggcttgcaccagtggcaatgcctgaatcgcattcactacaaactgctgtcgagcctcagacatccgcgatgaaggaggtagctgccacagttacttctgtttcccccgtacaagcttccatgtcagctgttttgccagacagaaaaaaaacgaaagcatttgttccctatcaaaaaataaatgtacaaacccataattcactttcacttaggcaggaaaagcatctgcaaaagctgattgaacattacacgatgcgcacacgaaaaaccaaagaatatactcagcaatacagatctgtatacgccaataaccggaatgtggccggatttaggtttgctctcaaggaaatggtgtatcagattatatcccaacgtgcagagggttctaaaatttgggatttggatggtaatgaatatattgatttgacgatggggtttggggtcaatttgtttggtcacaacccatcctttattcgtgaatcgatagtaaaggaaatacataacgggatgtgccttggaccgatgtctaatatggccgggcagattgctgaaaaaatttgcaaaatgacaggcatggaacgaattgcgctatataactcggggacagaggcgattatggtcgctcttcggttagcacgggctgccaccgggcgggataaagtggtgattttttctggttcctatcacggtacctttgatggaatattggcattggggggagcaacggatgacagggaacaacattccactcctctggcacctggtgtactacagcacatggtggacgatgtcgttgtgctcagctatggaacggacgagtcactccaatatatccgctcccatgcccatgcactggctgctgttctcatagagccagtgcagagtcgccgccctgatttccagcccgcagcttttctgaaggaagtacgccagattacggagcaatccgggaccgcgttcatttttgatgaggtaattacgggcttccgtattcagccggggggtgcgcaggcgtggtacggcattgaagccgaccttgtaacttacggtaaaatcattggcggcggtcttccgatcggtatcgtggcagggaaagcatcgttcatggatggaattgatggaggaatgtggagcttcggagatgactcttatccaccgcatgagcaacagcgaacgtttgtagcaggaactttttgccatcaccccttggctatggcagcttcgctggccgtactagagcggttggagaaggacagggggcaactgcataacgagctgaatagtcgtacgaaggcgctcgcagcagaactgaaccactattttacggaggaacagatacctataaaggtcgtttacttcggttccttgttccgcttcgtccttaaaggtgacttggaactattcttctatcacatgctggataaaggaatttatatatgggaaggccgtaactgttttttgtcaacggctcatacttcggaagatatggagcgaattgtacaggcaattaaagagagcgttaatgagctgcgcaaaggaggatttctgccggatctgcaccctcatgaaagcgatctaaacaaggctttttttcctgaaactgcaactgcagaccttaaggaatcgacgattaagctgactccggatcagaagcagttatggttcgcctcagtctcggattcaaaggggtcggagtcgcttcatgagactgttttactgcgtttccggggcccgctacatgttaaggaatttaatgaggctgtccatcacatcgttgagcgccacgaagccttacgcacctttatgggggaggacggagaaacgcagatcatcgcccgggcaatgactgtcagcattccgctacatgatatcagcagtctttctggagaggagcagaaacacgatatccgtgcttggatggagaaggacagggagaccgtattcccaataagtgcgggggaacctttattccgtatccagcttttaaaaacgtcgaatgagaagcacatcgctgcatttacatttcatcatctgattgcagatggctggtccatcggtgtgtttttccatgaactggaacaactttattccgcttgtgtacggggcgaacgctgcacgcttcccgatcctgttccgttccgagttttcgcagcatggcagcaaaaccagttagaggcaggtggagcagctgcccttgctttttggtcggatgtacttgcgaagccattgccagttcttgacttgccgtctctccaacgcaacatcagctctccttcttcgcgcggagcacggcacaccattgtggtggatgcgcctctggtgaagcaactgaaatcagtcagtattcggctgggcaacagcttatttgtgactttattgtctgcttttcagcttttcttgcacagactgacaggccaaaatcaaatcatagtaggtattccaaccgcagggcaatctcatatgggtgtgtccccgctaattggccactgcgttaacttacttccagtgatttgtgaggtagactctggagcaacgttcacggaattcacgcagacggtcaagcgagtaatgcatacgctggatgcttatcagaaatacagctttgccggacttgcccagctaggattaagccatttgcccattcttaaggtgttgttcaatatggataggcccattccggagtttcactattacggactggaaacagaattgttggaacatgaaatattgtcctgtcagtatgagttgttcctgaatgttacggagtctggtcagcaattgcggcttgattttgactatgctgcgagtctttttcaacaagacactatagaggtatgggcgcaatactttttacatctgctgagctcgattgtgcaggaagacggaatgcgtgtatctgcgctgtctttgcttcgaagtacgcaaagggagcggcttctggaagtgtgggcgacacactcggattctaaagggaattatccttgtgtcttggataaatataaacatccgtctcctacgggtaccatcggacaagtatatttggccacatccgctggtttactgggaacgacgctggaatgggcttatgttgaggttggagggagaattcgacatattggtgcagttaaccgagatgttcttattcgcgggcatcaagtgaatcttgagcagatagagaaacatcttttgcgagcactggatttggatgcctgtgttttgacggcacggaaagacggcgagagcagtaactcatcgtatctagtggcttatatagtggacaataattctaattcgtgggatatagcgaagctgaaagagagtgtaagctcaatacttcctgattatgggcaacctcgcttttgggttttgatggatagcatccctcttttggctgatgggaagccggattttcaatcattaccgaaaccagaagatatcaggatagaggactcgcagaagcaggtttctgacggtaatatgattgaggacaaactgatatccatatgtaaggaagttttgaatgtatctaatatcggatacaacgataatttttttcaaatgggtggagactccttaaaagcgactgttattttaagcagaattaacaaggaattcgaagtatatattccgctggtacaaattttacatttgcaaacgattgcacaactggcggcacatgtaaaaggaggacaaaagcgaaagtttgagccgcttgttccggcagatttacagcccttttatccggtatctcccgctcaaaaaagaatgtatgtgctggatcaactgggtggaggtgcagcgtatcatgtatcgggtcaactgcatatagagggagagttacacgtttccaggttcattgatgcagtgaaggaggttttttcacggcatgaatcctttcggacgtattttgagatagtagacggggaaaccgtgcagaaggtacaggatgtgctttcactgaacattcctgttactccaatttccgaagaggatgctagtcacgcccatgaactgtttattcagccttttgacctgagtaaggctcctttaattcgtgctgaactgttcgcaatccatcgtgaccagtttatgttgctgatcgatatgcaccatatcatttcagacggcttctcaatggcagtattaatggatgagatcagcacgcggtatcagggtatgccacttgcccccattgacgtgcactacaaagactatgtcgtttggcaaaaacaacattatgccggagacagccaagcaaaggatgaagcattttggttagacacgttggacggcgagctccctgtattggacctgccaactgactttgctcgtccgccaagtcagagcttcgcaggggacagccttaccgtcaatgtgcaatccgagctgacggaaagacttaatcaattgtcaagagacacgggaccaacgctctttatggtgcttttagcagcttataatgtgctgttaagcaaatactccgggcaagaggacatccttgtaggtacgccggcagcgggtagagggcatgcggatacggaagcgatgatcggcatgtttgtgaatactttagttctccgtaatcgaccgctagcgtcccagccattcagtgctttcctggaggacgtcaaacataacactctgcttgcgttggagcaccaggaatatccatttgaacaactggtcgacaaactggatcgagtacgcgatgtaagccgcaatcccatctttgatacgatgttcagtctgcaaaataagggaacagaggtcattgaattcgagggacttcgtttgcaaccgaatgagtttaatgcaggggtatcgaagttcgatctttcattacatgtaacggaaactcaagaccatttaactttcacctgggagtattcgaccagcctgtttaagttggagacgattgagcgatttgccctccattatataaaagtgttggaaatcgcaactcaagatgtcggaattcgcttggctgacatggatatgctgacagaagaagataagcacttattactatatgagttcaacaacacctctgcctattttccgcgggatgcaacgattcatggaaggtttgagcagcaggttagcaggactccagatgacatggcaatcatatttggaggtaagtgtatgacttaccaagagttgaatgagctggcgaatcgtttagcgcgaacgttgcgggcggaaggagtgggaccggatcagccggtggggattatcgctcagcgttcacctgagatgatgatcggcatctatgcaattctaaaagcgggtggagcttatgtacccattgacccgggatacccacaagaaagaattcaatatatgcttgaagattcaagaacacaactggtgctgacacaaccacagtttgcagaacagctgaagcaatatgcggactgcaaggtaatggtgttggattatgcttccacgatcatggctttgcaagcgtccaggtcgacggagcctatgacagactgcatgagtagctggcatgaagatgcctccaaccttacgcctctagcagaacccaaccatgcggcctatatcatctatacttccggttccacagggaaaccgaaaggggttattgttgagcaccgctccgtcgtgaatcggctctgctggatgcacaatagatatgggctgaacgtagaagatacgattttgcaaaaaactgcctttacttttgacgtatccgtatgggagttgttctggtggtcgatggtgggctctaaagtaagcttgttgccaatcggcggagaaaagtctcccgaacagatcctgatcacgattaatgaagacaaggtaagcacccttcattttgtacccgcgatgctgcatatttttctggaatatctggagcagcaaccaagggaagtcgtgcaagccaaattgaaaacgctaaaacatgtatttgccagcggcgaagcattgcctcctcagcaggtggcgcgtttctatcgaatcatgtcagggattggaagcgcaaaactaattaacttgtatggtccaacagaagctactgtagacgtttcattctttgagtgcgagcctgtggaagagcactcggtgatcccgatcggtaaaccgattgataatattcatttgtatgttgtacaggaaggcacggagcgattgcaaccgattggagcggtgggagaactttgtatcagtggtataggagtagcccggggctatcttaatcgaccggaattgacaaaggagaagttcgctaccaatccgtttaacagcggagcggagggttatgagcggatgtaccgcacaggagatttggcgcgttggatgcctgacggcaacattgaatatctgggacggatcgatcaacaggttaaagtaagaggataccgcattgaactgggtgagattgaagcgcagttgctgtctgtagacggaatccagtcagcagtggtcgtagcgcgggaaaacaaagacggctacaaggacttgtgtgcatactttgtggcttctgagccattaagtccgctggacgtgcagaatgcgctcaagcagaagctgccgttttatatgattccagcatatgtggtgcctctgccgcagcttcctcttacggtcaatggaaaaacggaccgaaaagcgttacctgagccggaccgacatgactctttacaaacggattatgttgctccgagaaatgatgtcgaaagggcgctggtcgtggtatggcaagacgttttgggatgtggccatataggcgttcgagatcatttttttctgcttggcggcgattctattaaagccgttcaggttgcctcacgtctgcgtcagcatggttattcccttgacatttcatttttgatggagcacccgttcattgaggatatcagcaagcttgtgacaactttgttccgctacagagaccagaattcgatacatggagagattccaataacatcgattcagcggcagttgaatgaactgggtacattttacaccttgcggacggcgacatccatgctatttacagctaacccggacttcgatgaggatctattgcgatctgtgctgcaaacattaactactcatcacgagggactgcggcttggtctggcgtcgatcgacgaaccgtctacccttatataccgagatgaaaatgaagaactgttcacacttgatgtgttctctcttgcagatgatgaccatgaagctagcaagcaattacagagcgaatgcttccggattcaaaacagttatggaatgtttgagggacccagagtacgcgcaggcttattccggatgtcgggctctgaccagttcttcctttctgtagatccgctagtggctgatcccacatcttggcgtatcctgcttgaggatttcacaactgcctatgaacaagctcttaacggggaaccgatggtgcttcctgacaaaacagattcttaccactcctggatgcggtggctagaagactatgcagacagcaaaaagctggccaaagagaaactctactggctggataaggttaatttcgatggagaatttataccgaaggaccatgagacatctgcacatttcgaaacacttcgtccagtagaaaattgcatcatacagctttcggacgagaaaacaagccaactgttgacacgggctaaccaaacctataatacggtgagcgctgagttactgcttgctgcactgggactgactatagtggaatggtccggacagtctaaaattgccattggatttgaacattatgatcgggagcaacaaacggtgacttcggacaaaccggacctttcaagaaccgtaggtcaattcggttccatatatccgcttgttctggatatagagcctggggaaggcagttctctgttgctcagaaacgtaaaggagacgatccggcaagtacccaaccagggtttaggatatggattactaaaatatggttctgcaacctccggcagatcggaatttaatgctaagtattacccggaaattggcttccgcttgattcattctgaatcggtcagttcctctcactttcatacatcgcctatggatgttgaattatggtccggacagaattgtagcatttcagatttagcctatcccctctatctggatgggtggatgaaagacggtaagctttccatctgcatgctttataaccgtcacgcgtatgaagcagatactatccgaatgcttctgttgcgttttgaacatcatttgtcgggcattattcagcattgtctggaccaatccggacggcaactaacaccatcggatgtgggagcacgtggtttggatctggatgagtttgaagacatgaagcagttttatgagaatctataacgattcgtacgaggaggatatccatgatcaaaggacttgaaattgaaaaagtggtcaacttgactcccttacaggaaggaatgctcgtccatgcgctgatggaaccagaatcacaggcttattacgagcaattacgtatttctattcgaggagatctggattggaatgccctacaaaaaagctttcagttactggttcagcgtcatgaaacgctgcgctcgaacatttatcataaatccgcttctcgttctcggctgattgtctttaaaaagcgaaacacggcgattacttacgaaaatatgacagagctgaccggaaaggagcaagccgacgctattcgtagatttatggatgtggaccgtaacagccattacgatttgagcagggatatgctcatccggatggctgtacttcagacggataaagatgcttatacgttgcttttaagttttcaccatattattatggacggctggtgtattggcatcataatggacgagttgttaacggcctatgaggcctatcgtacaggccgttccgttcaattgcctgaaccacgaccttacaccgggtatgccgactggcttgaagaacaggatcaggaggcggccaaggactactggagttctgaattacaagattacgaacaaacggctggacttccgatgctaaaaactccagctacaactcctgaaaaaggcggctatctgctgcaggaatatagaacgacgctgacggaaacagagaccagcactttgcgtacgattgctgaatgcaatgggaccacgcttagcagtctttttctggccgcctggggaattgtacttggtcgttacaacggaagcaaggacgtagtttttggcacggtggtatctggccgcccgtcggaattggatgaagtagagcgaattgtgggattgttcattaataccattccattacgaattagattaaatgaagaaaagagttttgttgaattattgcgcgatgtccagagagcctctgtccaaggaaggatgaatggatactgttcacttgctgaaatccagtcgcaatctgcactgaagcaacgcttgctcgatcatatccttgtattcgagaactatccgctggaaaacatggtcgggagacgggactggcaagacaaactcggattcattattgaagacgcccggttattcgaagaaataccgtatgactttaatattgaagttgaagacaagaaggcaatgagtttcatattgtcctataacggcaaggtctatagcagtgaagcgatgaagcatctggcccatcatttgaagcatgtcttcctccaaatcgccagcaatccggatgtttgcctccgtgatgttcggctgttaacaaccgaagaagaggctaatatgacgaaaatatggagcggacccgttgtccagtttcctgcacttacttttcacgggatattcgaagcgcagacggagcgtacaccagaacgagcggccgtcatatataaagatacaatgctcacttacagacaacttaatgatagggcagacgctcttgcccatcttttgcagaagcgtgggattacacgtgagagtctggtcgctgtcatggttgacaggtctgttgagatgatagtggcggtgctgggaattatgaaagcaggagctgcctatgtaccagtagatcccgtgtatccagaagaacgtattgaatatatgctgcgtgactgcggaacgacgattgtgcttacgcaatctcacctgacgggctggctgaaaacaatagatttcatgggcgaggtagtcgatctcgctacgttgccactccagcccgagaaggatttggacaagcagtatatctccacatatgagcctggctctttggcgtatgtcatttatacatcgggtaccacaggtaagcccaaaggcgttatggttgaacatcaacaatatgttaacactgcactcggctacagacacagccaaggattcaaagatttcccagttaagctactgcaaattgccagcatgtcgtttgatgtgtttgcatgcgatttggccaaggcatttgtcaatggaggtaccttagtcatttgtcctgaaaacgtgagaaatgatccagctgccctggctacactgttggagcagcagaagattactacgtttgagacgcctcctgtgcttttagctctgctattgaattacatctatgagcacggtacaaatatcagttcactaaagctgcttactactggagcagatagcttggctgttgcagattaccgtaagatgttgacccgttttggcagcaagatgcgaattattaatacgtatggagttaccgaagccgcaatcgagtctagcttttatgagaacgagctggaaaaattgccgctgtccggtattgtgcctatcggcagagctctaccgaatcataagttatacattgttgatgacaggatgcgtccggtccctgtcggtgtaacgggcgagctgtgtattggtggggcttctgtagcgcggggatatctgaacagaccggagcttacagcggagaaattcgtgtctgatcctttctcgcccggtggacgcttgtatcgtacgggggatctggcacgctggcagccagatggaaatatagattttatcgggcgagctgactaccaatataaaattcgcggataccggattgagcctggagaaattgaatctattttgctcgaaacggaaggagtacgccaggcggttgttgttgatcgactggacacggcgggacaaaagtacttatgtgcctatgttgcaggtgcagctgagaaagacatgctgcgagataaactggctcagcagttaccagtctacatggttccagctcaaatcattgtattggaacagttgccattgacccataacgggaaaatagaccgatccaatctgcccgaaccggatgaaatagcatcggtggatagcatatatgaggcaccacaggatgaattggaaaaaacaatcgctttgatctgggaagaagtgattggcgttaaaccaattggattacacaacaactttttcgagcttggcggggactcgattaaagcattgcaaattgcaatccgcttaaatgccaaaggcctgaaaatggaagtaaaggacttattccgttaccctgaaattcacttgatagcaccgtttataaaaaaaatcacccgtatcattccccaggggattgtagaaggtgaggtagaattgacacctattcaactcgatttttttcagcatcatcggagagatcgtcaccattataatcaggcagtcatgctgcaaaatgatagaggatggaatgaattatggctgaaaaacgctatggacaagctggtagctcatcacgatgtattacgcatcatttttgtggaagaggaaaagggaaccaccgcctataacaggggagtgaacgaaggtgagttctttacattaacgagctatgatttgacacaatcaagccagcctgaagaagaaatccgacacattggtgatgagctgcaaagcagtttggatctgcaacgaggtcctctcatacgtttggctttattccatttatccggtgaagatcatctgatgatcgttatccaccatcttattgtagacggtgtgtcttggagaattttgctggaagatttgggcatcgcctatgatcaggtagctcggggtgagatgccgaatctgcccgccaagactgatgcttacaaagagtgggcttcaggactgaccacttacgccgaaagtgtacaggtacgccaagaaatcagctactggaacaatgtagattcacgcaggatacgtcggttgccaagagatcatgaaatcgcggttagcctgatgcaagaccgacgccaagcggaggtggtactcagcagggatgagacggaaaagctattgaagcatgtacatcatgcctatcatacggaaatgaatgatctgttgcttacagccttgggcctggctttttatgaatggagcggttacaacgaaattccgattttgctggagggacacggcagggaggagatcattaaagatttggacatctctcgtacagtcggctggtttacctccctgtatccctttgtaatcgaggtcaacagacctgagaacttggcctatcagatcaaaatggttaaagataagctgcggcgggtgcctaataagggcgtcggttatggtattttacgttatttgaccaaggaccagactaaagccgcttctctagtcgctgcaccattcccggaaatcagcttcaattatttgggacaattcgacgaagaaaacaagacagacatgccttggcgtatttcccgattagcaaacttagccaatggtgagagaagcccgcgtgcggaaaagacgaatacatttgacattaacggcatgatcacgaacggaatccttcggtttgaatttgaatataacgggcttgaatatggtgtagcgacggtagagcgattaacgaacggctttaaaaaacatctattgaatattatccatcattgttgcactaaagatcaggcggagcgcagccctacggattttacatataatcaattgtctatggggcaatttgaacaaatatcaagccgattatcggataagctgggaaatctgttgaaataaaggatatcagcaagttgaaactcaaattctgcatggataaaggaaaggtgaatgatttggcacaggtaaatattaaagatatctatccgctatccccgatgcaggagggaatgttgtttcattccatcctcgacgcaaaatcagaagcttactttgagcagaccgttattacctttaatgaagtgctagatgttcatttggttcagcaaagcttgcagcagctcatgaatcgatatgacatattccgtaccatttttatgtataaagaaacagaacgtccgcttcaaattgtcttggaggaacgtgatgcgttgcctgttcatttcgaaaatatccgtgcttttcccgaagctgagaaaagggagcattttacggcctttttaaaggcagagcgccaagcgggttttgacttggaaaaagatgttccgattcggcttgctctgtttcaatgggatgatgagtcttccaggcttgtttggagtgttcatcacattataatggatggttggtgcatgggaacggtagcccaggaattttttactatgtatacttcccttcggtctggagtgcctgcgcaattggatacggtatatccgtacagcagttttattcagtggctagagcaacaggacaaggaagaagcgacagcctattggcggggatatttaaatgggcttgaaaatgaaacaattttgccgggttataaccgtccattgaatccaatcttcgaagcagaacgttacacatgcaagctggggaaagaactgactcaaggaatggagagaatagctaaacactaccacacgacagtcagcactgtatttcagacggtatggggattattgcttcaaatgtacaaccacagccgggatgttgtgttcgggtccgtagtatccggcagaccagatgaagttccgggaattgaaagtatggttggattattcattaacacaataccaacacgcataaccagtgatgcggatcagagattctcagatctgctgatatctgtgcaaaactccaacatcgagtctactcagtactcttattcttccttggcagatattcagaatcacacggatttgaaacaaaatttagtccgtcatattgttgtttttgagaactatccttattcagaggagcttattcatgcggaaaaagggcgtgatacgcttcaggttaccgacgtagaggatattgtacagaccaactatgattttaatgtgattgtcgttcctggatcacagtatgaagttacatttagttataatcggctggtttacgatgaaaattggattaagctaattgcagctcatcttaaacagggactggagcagattgttcaacagccggatctaccgatttccgctttggaatttctgacaacagaagagaaaagtcaggttttatccgaatttagcggagtacagatctcatatccttctagtgataccatccatctttgttttgaaaaacaagtagaaaagacaccgaaggcaacagcaattgtctgtgagaactccagtctgacttatgctgagctgaatgaacgtgctaaccgactggctcgtaccctgcgtagttacggcacaacaaccgatcggctagttggactcatgactgatcgttctatagatatggtggttggcattcttgctattcttaaagcaggaggggcatatgtacccatcgatccgtcatatccagaggaacgtatccgttatatatttgacgattccggtgcagacctgcttttaacacaaacccatcttgtggaaaaggtcaaagaagccgcctttggaggaaaagttctggtattggatggagatccaactgtatatcacatggaaggatcaaatctggaggccgtatcaggagcaaacgatctagcttacgtcatatatacttcaggtactacaggacagcctaaaggtgtaatgctggagcaccatggattgtgtaacctgaaaacgtattttgatgaaacattgcagataagtccgtcagatcatgccctactgtttgcgagctacgcatttgatgctgcatgctgggaaatatttcaggcgctattttgtggtgcgacactttacgtgcctacttcggaaatcattctgaactacaaccagtttgaacagtatatggcggaacatgaaattacggtagcggcattacctcctacctacgccgtgtatctaaacccagaacgaatgccggatctgcgtattctgttcaccgctggttccgcttcctcgatggagcttgtaaacaagtggaaggatcaggttgcctattttaatggctatggcccgacagaaaactcggtagcaacgtccatttggccggtgtcggaacaccccggagcaatcgataccatttctataggacgtccagtacccaaccaccgggtgtacatgatcgatgctcttggtcatcttttacctgctggagtagcaggagagttatgtgtatccggtccaggattggcacgcggttacttgcaccgcccagaattaacggctgagcaatttgtggctaatccgtttgcagatggggaagcgggctatgaacgcatgtatcggacaggcgacctggcaagatggatgccgaacggcaacattgagtatctgggccggatcgatcagcaggtcaaaattcgcggttaccggattgaactgggcgaagttgaagcggcaatgctgaaggcagatcgcatgcaagaggtcatcgtactggcacatgcaaacagccaaaaccaacacgaactggttgcctactacgtggcggaacgggaagtaacggggggcgagcttcgcaagcagctgagtgaagagcttccaaattatatggttccctcgcactttgttcagatggagcaaatgccgctcacacctaacggcaaaatcgaccgtaaggcattgccggcaccggagcagatttcccgttccacgcaggaatatagggctccgcagacagcagaggagcaggcgctggcccatgtgtgggaagctgtactgggcggcggtcctgtcggattgacagatcaattttttgatcggggcggggattcgatcaaggcgattcaggtatcctcacgcctgctgcaggcagggtataagctggatattaaagacctgtttaagtaccctgaggttgctgagctagccacgcatctgcgtgtgtcggatacccaattagctgatcaggaagagatcgagggagccgttctactgacgccgattcagcagtggtttgtggagcaagggcagcctatgccggaccactttaatcaggcggttatgcttcatcgggagcagggattcgaggaagagctgctacgtcaggcattgacgcagttggcggtgcaccatgatgcgttacggatggtgttccgtaaggcggagcaaggctgggaagcgtggaaccgcagagtgaaggaagggaagctgtatgatctggaagtggccgatttcaaagacgtgccgatcggtcccgtattgggtcaagctatagaagcccgtgcgagcactattcagagtagcatccgactgaatgaggggcctttgctgaaagcgggcctgttccactgcgctgatggggaccatctgctactggttattcatcatatggtggtagacggcgtatcgtggcggatactgttggaggatttgtcgaatgcctatgagcaggctgtacgtggagaagccatacagctcccggccaaaacagactctttccgggtctggtcggagcggttatcagcctatgctgacagtcctgagatggaaagtgagcacgcatactgggagcaagtgaataaattggcagcatccgagtctttaagacttacagaattgttggattctaaaaaaacattgaccataaataacacagctactttgagcttgaaattcacgaaagaagagactgatcaactgctaaagcaggctcatcgcgcgtacaacacagaagtgaacgatctgttgctgacggcgctcggcatgacgttaagcacttggactggcagtgatcaggttgcaattcttctggaaggccatggccgggaagatatcatgaaggatacggatatatcacgaacggttggctggttcacgagccagtacccgatactgctgcggattaacggggaagatcatatctccgggaacatcaaacggatgaaggagatgctacgcggcatcccgcataaagggattggatacggcatctggagatatctcagccagaacggaccgtccggggcaacatacgccgagccacagatcagctttaattatttgggtgaatttgatcagacgctgcggcacagcgaaacgcgcatgtcaccgtactccagtggagcagatgttaacgaacagaccagaatgccgtgttccctggatgtggggggcattgtaacggatggaatgcttgagttggatattcgttataacacaaaagtattacaggaagataatgtaatgaaactagccagggaactcaagcagaatgtgctggaagtgatccgccactgtatatcacgggagcgttctgaattgacgccgagtgatgtgctgcttccggggctaagcctggaagcattggaccagatggtggagcagattcagcctgatggagagcttgagaatatataccccatgacgccgatgcaaaaaggaatgctgttctacaacatgctggattcccaatcgaacgcgtatgtggagcagtccacctttgaattgaagggaaagctggatctcgtggcattcgccgccagtctggatttgttggtacagcgccattcagcactgcggaccaacttccggagcgatttgcaggacgagcccttgcaagtggtgtaccggaataaacgcggagaactgtacgtagaggacatacgtgagaaggagaaggtggcgcaagagcaatatatcgaggaattcgcgcgtcgggatcagcagaaggggtttgatctggcaaaggatacactaatgcgggtatccatcttacgtacatcagacgatgcataccattttgtatggagcttccaccatatcataatggatggctggtgtttgtcgctggttaccaatgaggtctttggaggatataccgcccttacagaagggaaggcaccgcaattacctgtggtgacaccatacagccgatacatcgaatggctggaagagcagaaccgtcaggaagcagcggagtattggaacggttacctgcggggctatgaggagacggcggtcttgccgcaggccaaaacagggaagtccaagggatatgaggctgaatatctggaatttgatttaggtatggacctgacggcgcaacttcagcagctggcaaagcaagaacaggtgacgataaatacgctgatgcaaacagcctggggtgtattgctgcaaaagtataatcgcacagaggatgtcgttttcggtagtgtggtgtcgggacgtccagcagacattgccggagtagagcaaatgatcggacttttcattaatacaatcccagtccgtgttcaaggtaaaccaacaactgcatttactgaattaatgaagaaaactcagcgacaggcgctttctgccaatgcctatgacacgttcccgctgtatgaaattcaggcactgaccgagcagaagcaggatctaatcaagcacattatgatattcgaaaattatccggtggagcagcaggtagagcagctgggaagtgatgggcagaatgcattcacaattttaaacgcggtggctacagaacaaaccaactacgatctgaatgtcgtcgtgattccggaagaaggcattaagattcgttttatgtataacgcattgagctttgatcaaaccggcattgagcgtctgcatggtcattttgctcgtctgctggagcaaatttcgttcaacccgcatgttcgcgttgaagaactggaattggtgacaacggcggaaagacaacagattacaggcgagtttaacgacacggcttctgtatatccgcgcaatcagacgatccaaaagctgtttgaggagcaggctgcgcgtacgcctgatcatattgctgtagctttggggcatcaatctctaacctatcgggaactgaatgagaaggctaaccgaatagcacatacactacagactgctggaatgaaggccaatgagactgtcggcattctaacggagcgttcgttggatatgattagcggaacgttggctattttgaaggctggaggcgcgtatgtgccgatagatcctcaatatccggaggaccgtatccgctatatgctggaggactcgggagccaaactgctgctgactcaacaagatttactggaacgttgctattttgatggacagattgtcaatctgaatgaggatacgtcctacagtccagatacttccaatttaggaatagatggatcaggcgaacatgctgcttatgtcatctatacctcgggatcaacaggcaagcctaagggcgtcgttgttgagcatcaaagtgtcgtgcgcttggtgcgtaatacggattatgtgccgttcgatgaatcgatccgaatgttgcagacttgcgcgtttgtatttgatgtgtctacgtttgaaatttggggggcgttactgaacggcggtgagcttgtactcgtgcataaggatgatcttttggacgtagctaagctcaaggagaccatacgagaccatcgcattactatgatgtggctgactacaccgctatttaatcagctttcgcagcaggacagtaaattgttcggagatgtgaagtatttgctggtcggaggcgatgtgctgtctgcaccgcatatcaatcgggtgctgcgtgataatccggacatgaatatcattaacggctatggaccaacggaaaatactactttttcgacgacttatcatattaaagaagaacagcttgattctgtgccgatcgggcgtcctatccgcaattcgacggcgtatgtggtcgattcggcgtttaacctgcagccgattggagcatggggtgagctggttgttggcggagacggagttgcacgcggttacctgaaccgtcctgatttgacggctgagagattccttgccaatccgtgggtggacggagatcgcctgtactgcacgggagaccttgttcgctggcgtgaagacggtacattagaatacgctggacggatggatcaacaagttaaaattcgcggctaccgaattgagctgggcgaggtcgagtcggctatgctgaaaatagatcgtatccaagaggtcagcgtactggcccatgcaaacagccaaaaccaacacgaactggttgcctactacgtggcggaacgggaagtaacggggggcgagcttcgcaagcagctgagtgaagagcttccaaattatatggttccctcgtactttgttcagttggagcaaatgccgctcacacctaacggcaaaatcgaccgtaaggcattgccggcaccggagcagatttcccgttccacgcaggaatatagggctccgcagacagcagaggagcaggcgctggcccatgtgtgggaagctgtactgggcggcggtcctgtcggattgacagatcaattttttgatcggggcggggattcgatcaaggcgattcaggtatcctcacgcctgctgcaggcagggtataagctggatattaaagacctgtttaagtaccctgaggttgatgagctagccacgcatctgcgtgtgtcggatacccaattagctgatcaggaagagatcgagggagccgttctactgacgccgattcagcagtggtttgtggagcaagggcagcctatgccggaccattttaatcaggcggttatgcttcatcgggagcagggattcgaggaagagctgctacgtcaggcattgacgcagttagcggtgcaccatgatgcgttacggatggtgttccgtaaggcggagcaaggctgggaagcgtggaaccgcagagtgaaggaagggaagctgtatgatctggaagtggccgatttcaaagacgtgccgatcggtcccgtattgggtcaagctatagaagcccgtgcgagcactattcagagtagcatccgactgaatgaggggcctttgctgaaagcgggcctgttccagtgcgctgatggggaccatctgctactggctattcatcatatggtggtagacggcgtatcgtggcggatactgttggaggatttgtcgaatgcctatgagcaggctgtacgtggagaagccatacagctcccggccaaaacagactccttccgggtctggtcggagcggttatcagcctatgccgatagtcctgagatggaaagtgagcacgcatactgggagcaagtgaatgaactggcggcatcggagtcgccccaacttctagtgtcccaagagcatagcgataggtttatgcagcaagacatggatatcgtaaatgtgaggcttacgcaggaagagactgatcaactactgaagcaagcccaccgcgcgtacaacacagaagtgaatgatctgttgttgacggcactcggcaagacgttaagcgcttggactggcagtgaaaaggttgcgattcttctcgaaggccatggccgggaagaaatcatgaaggatacggatatttcacgaacagtcggctggtttacgagtcaatacccggtactgctgcggattaaccgggaagatgatatctccgggcacatcaaacggatgaaggagatgctgcgcagcattccacataaaggaattgggtatggcatctggagatatctcagccagaatggaccgtccggggcaacatatgccgagccacagataagttttaattatttgggcgaatttgatcagacactgcagcatagcggcatgcatttttctccatattccagcggagctaatactcatgaactgacccaaatgtcctgtgttatggacgtgggaggacttgttacagatggcatgctggaactaagcattcaatacaacattaaggcactccaacaaaatgctgctgagcaactagcagagcaattcaagcagaatgtgctggaagtgattcagcattgtatatctcgggagcactccgaattgacgccgagtgatgtgttgctttcggacttaagccttgaagaactggaccggatggtggagcaacttcagcctgacggagagcttgagaatatatatcccatgacgccgatgcaaaaaggaatgctgttccacaacatgctggattcccagtcgagcgcctatgtagagcagtccacctttgaactgaagggaacgctggatctcgctgcattctctgccagtctgaacttgttggtacagcgtcattcagcactgcgtaccaacttccggagcgatttgcaagacgagccgttgcaagtggtgtaccggaataaacgcggagaactgtacgtagaggatatacgtgagaaggagaagtcggcgcaagagcagtacatcgaggagttcacgcgtcgagatcagcagaggggctttgatctggcaaaggatgcactgatgcgggtatctatcttgcgtacatcagatgaatcataccattttgtatggagcttccaccacatcataatggatggctggtgtttgtcactggttaccaacgaagtctttggaggatataccgcccttacagaagggaaggcaccgcaattgcctgtggtaacaccatatagccgatacatcgaatggctggaggggcagaatcgtcaggaagcagcggagtattggaacggttacctgcggggctatgaggagacggcggtcttgccgcaggccaaaacagggaagtccaaggaatatgaggccgaatatctggaatttgatttgggtatagacctgacaacggccctgctgcaactggcaaagcaagaacaggtaacaataaatacgctgatgcaaacggcctggggcgttttgttgcaaaagtataatcgcacagaggatgtcgttttcgggagcgtggtatcgggacgtccagcggacattgccggagtagagcagatgattggactattcattaacacggtccccgtccgtattcaaggcggacaagcaactgcatttacagagctgatgaagcagactcagcgacaggcgcttgcttcgggaacatacgaaacgttcccactctatgagattcaggcacaggcagagcagaaagtggaactgattaatcatattatggtatttgagaactatccggtggatgaacaaattgagcaattaggtgaaagagaggaagctgattttaaaataaccggagcaggagcggttgagcagacgaattatgattttaatatcgtggtgttaccgggagagacgctgcgagttcattttggttacaacgcccaggtatatgactatgaaagggtagaacagatccgggggcatttgctgcaactgctggagcaaatcaagatcaatccagctggtcggatttgcgagctggatatattaacccctcaggaacgcgagcaaatgctgggtgcttggtgtgacacgatagcagcatatccacgtgagcagacgattcacgggttgtttgaggagcaggtcaagcagacaccagagcaggtagcggtatattttgaaggagcacaagtgacctaccgtgaattaaatgagcgagcgaaccgtctggcgcgaactttacacagtaacggtgtgatagcagacggcctaatcggcctgatgacagagcgatcgattgacatgattgtcggcatcttgggtattttgaaggcagggggcgcctacattccgatcgatccgacttatccggagaaccgcatccgttatatgctggacgattcaggtacggaactgctgttaacgcagcagcatttggttgaaaaactggaatttaggggcaaggtcctgctgttggatgcagaaatgggcgaaggcagtgtggatgcaagtacggctgaagcaaaaggagaacccgtgtccgtatatcacagggatggtacgaatttggacgctatatccggtcctcataacctagcatatgtaatctatacgtctggaacgacaggccagcccaagggagtcatgctcgagcatcgtggactctgcaatctgcatacgtatttcagggaaacattgcggatcagcagttccgaccgtgttgtatcgttcgccagcttttcctttgatgcggcatgctgggaaatgcttcaggcgctcttcaacggggccactttatgtatcccgacatcagaaaccattctcagctatgacaagtttgagcagtatatggcggatcatcacattacaattgcaacgctgcccccaacctatgccatatacttgagccctgaacgaatgccggaactacgcatcatgttcacggccggatcggcgaccagtactgagctagtcagcaaatggagagacggtgtgacctacgttaacgcctacggtccaacggaaaattccatagcaacgtctgtttggccagtaccgggagagtccgaagcaggggtatccatctcaatcggacgtcctgtaccaaatcaccgcgtgtatatggtcgatgcacatgggcaacttgcaccgacaggaatcccaggtgaactgtgcgtatccggcccagggttggcacgcggatacctgcaccgtccagaattaacggctgaacaatttgtgaccaatccgtttacaggtggggaagcgggctatgaacgcatgtatcggacaggcgacctggcgagatggatgcctgacggcaacattgagtacctgggtcggattgaccatcaggtcaaaattcgcggttaccggattgaactgggcgaagttgagtcgactatgctgaaggcagatcgcatgcaagaggtcatcgtactggcacatgcaaatagccaaaaccaacacgaactcgttgcttattatgtggcggaacgggaagtgacggggagcgagcttcgcaagatgttaaatgaagaactcccgaattatatggtcccttcacatttcattcagttgcagaacgtacctcttacaccaaacggtaaaattgaccgtaaggcgctaccgataccagaagatcgtttggccgaccatgttgcaccgcgaacgtggatggaaataaaattggcagacatctggcaggatgtgctgggtctaccgcaagtaggcatcaacgaaaatttctttgaaattggtggtcattcgctgcgggcgacgacactaacttctagagttcgcaaagatttaaacagaccgatggatttgcaaaacatatttgaggcaccgacaatcgagcaattggcggccttgcttgaagaacaggatcaaatcacatatacatccattccggtggcggaaaaacgcgacacttacccgctttcttttgcacagacacggatgtatgtgcttcaccagctggatccggatggaataagctataacaccacatcagcactgagagtaatcggtccgatagatgtgaaccaggtggaagaggtattccgtcaattaatttcacgtcatgcgtcactccggacaagctttgaactggtgaatggtgtgccgatgcagcgggtgcacgatacgattcactttgagttggaatatgccacaatatcagaactgcggacagaatccaatgaacttatgcttgaaaatttagcagaagaacatgcccgttcctttgtacgcccatttgacttgaggatcgctccgttgctacgtgtaaagctggttaaattgggattggacgaggaaggacaggagccgcagcacttattgatgcttgatatgcaccacatcgtttcagacggagtatccattgaaatattagctggtgattttgcccgcttatatagcggtgaagtattatctccgctgcgtattcaatatacggactatgctgtgtggcagcatagcaaaactcagcaggagcgaataaagagtcagggagagtactggctgaatagatttagtggtgacttgcctcaactggatttgccaactgattttgagcgtccggtaacacgatgtacgaaaggtgacgctgttgagtttgaaatgggacaggaattgactcagtgtttaaaagaactggcggtgcatacggattctacgctgtacatggtacttatggctgcatacacagcattgctgcattattacacagggcaggaagacatcattgttggtactccgattgcaggtagaccgcatgctgacctggagcctatgctcggtatgtttgtcggcacgctcgcattacgcaatcatcctcacgctgaacagacgttttataactgcattgaggacgccaagacatgtgcactgcaagcatatgcgcatcaggactatccttttgaggaactggtggaaaagcttgatctgaaacgagatatgagccgtaatccgttgttcgacacgatgtttgtattgcagaatatggagaaaaaggaagtgaagttggacaagttgttcttccactcttttgacatagatcaggtttctgcgaaattcgatctgacgcttgaagttagtgaggaggaagcatctattcagctccaatttctgtacgctacatctttgtttaaacgggaaacggtagaaagcatggcaaggcattttgtacagttggttaaaactgttgtagccaatcccaatactaagctgggcgaattgacgctgatttcggaagaagacaaagggattctaaaaaaacatagggacaccctaaaggcttctcgctactggagtactctgctcgaaggctatgaagaagcacctcaattgccatatgccaatctgatggggcgcagtccatatcaggcagagcatctggagattaatttggatgttgaacgaacggtggcactgcagcgaattgcacaaaatgagcaggtgacgataaatacgctgctgcagacagtctggggaattttattacaaaagtataacggtacagatgatgtggtgttcgcttgctccatatcaagtcctttaacagataaattggattcgaagcattcaattggactgggtaaccacaccttaccagttcgcattcgaaccgaagcaggagccaactttatcgggttgatgagaaatgtgcagcagcaaaccgatgaatctgcggtatatggacattttccaatgtgtgaaatggttacaacgaaagtgcaacaactggcactttttggacatagaatggtgtttgagactactttggaagaggccaatactgagcaagaaagctgcgatttaagcatcatagtacttcagggagatacgctacgaattgatttttcctacaatgcccaggtatatgatcatcagagtgtgtcgcagattcaaggacatctactgcagttgctggatcaaattatagcgaatccggatagtttaattgagacaatggatctgttgactaagcaggagcgggagcacatcatccaggtgtggggaaataccacggcagagtattcgcgtgaacaaacaattcacgaactgttcgaggaacaggttctgcagacttcggatcagacagcggtatattttgaaggtcaacaattgacctaccatgaattgaacgagcgcgcaaaccgtctggcccgtactttacgcagctatggtgtgaaagccgatagtctggttagtctgatgacagagcgttccgtagaaatgattgtgggcatattgggaattttgaaggcggggggagcatatatcccgatagacccaacctatccggaggaacgcatccgctacatgctggacgactcaggtacggaactgttgttaacgcaacagcacctgacggaaaaggtgctgtttggaggcaaggtgctggtgcttgacggtgaacaggacggagtcgcttccgatacaagaaaagcggatgtacgcggggaaatgctgcccgtatatcatcagaacggttcgaatctggaggctgtatcgggtccaaacgatctagcatatgtcatctatacgtccgggacgacaggtcagcctaagggagtaatgcttgagcatcacggtcttagtaatcttaaaacctacttcgagcaaaaattgagtattggcttgtccgatcgggttgtcatgtttgccagttattcgtttgatacgtcatgctcggaaataatccagtctttactttgcggagcgacattgtatataccttcctccgagactattttgaattatgaacgtttcgagcaatacatggctgcctgcagaattacaattgcaacgctgccgccaaactatgctgtatacctgaacccggatcgcatgcctgatttgcgtgttctgcttacagcaggatcggcctctaccgcagaactggtgtccaaatggaaggaccgagtggcttattacaatgcgtatggtcctaccgaaaattccgttgcaacgtctctttggccggtatcggaagaaaattctgagttaggtggaatcatatccatcggacggccagtatctaatcaccgcgtgtatatggtggatacacacggaaatctttcacctgcaggagtccctggtgagctgtgtgtatccggtccggggctggcacgcggctatctgcaccgtccagagctgacaaaagaaaaattcgtagccaatctgtttgcagcagaggaagttggctatgagcgaatgtaccgtacaggtgacttggcacgatggttgccagatgggaacattgaatatttgggtaggattgaccatcaggtcaaaatccgcgggtatcggattgagctcggtgagattgaagcgcaaattatcaaggtggacggtgttaaagaatctattgtcatggctcgtgcagatcagcagggagcctatcatttggccgcttactacgtagctgaaaaagaaatcagtggcagtatgatgttgaatttgctgaatgagaaattgccgaactatatggtaccgtcgtattttatacaactgcagaacatgccgctgacaccgaacagaaaaattgatcgcaaggcactgtcggcattcgaggaacatactgatttgactgcagaatatgcagcgccgcgcacagccatggaggcgaagttagcacaaatctggagagaggtactcgacattccgtccgttggaattcatcataatttctttgccattggcggacattcacttcgtgcaactgcattggccgcaaaaattcacaaagaactgaatattgagttaccgttgcgttatgtatttgactttccaacaattgagcaaatggcgcaggctgttcatgaattgtcaccaaatccatttgcagcgattcctgttgccgaattgagagacagttatccggcatctataactcaaaatagactatacgttttgagcagcatgaataactacaatatgtctgccatgcttttgatggaaggggaactaaattttttaagattagaaagagcgcttaagcaattaattcagcgtcatgatactttgcgaacctcttttgaattcgtagatgataaactggtacaacggattcacgaccatgtcgatttcactttggaggttatgcagggacacggagagaacgaagcaagagtaatgatgagacaatttatcagaccttttgatcttgggaaggcaccgttacttcgagctgctctattgcaagaatctccacagcgtcattggtttatgtttgacatgcatcatgtgatttcagatggtgtatccatgagtatattgctgaacgagctgcccgcactgtatgaagaaaaaacgttgccggccttgcgaattcaatacaaggattatgcggtatggcagcaaggagatattggtagctcatggatggaaaaacaagaagcatactggctgaagcagatgagcggcgacattccgattttgggtattccagtcgactttgaaagacctgcaacacgtagcacctcgggcagcaccgtttcctttgccatttcacatcaggacgtggacggtttgaaacaaatcagtttgcaggcgggagctaccttatttatggtattacttgcagcctacaagaccctattgttcaagtacagcggtcaggaggatatcgttgttggaacacctattgcaggtagacagcatcacgatttgcagcctgtcgtcggcatgtttgtcaacacgcttgcattgcggagctttcctgaaggggacaagtcattttacgaatatgttcaggaagtaaaggaccaggtgcttgatgcctttgagcatcaggattatccgtttgaattgctggtggagaagctgaatgtacagagggacctgagtcggaatccgttattcgatactctttttgagctagataacatggactctggtacgacggaattccaagacttgcaggttactctgtgcccaggcgaacagaatatggcaaaattcgatttgacacttacggccatggaaagctctgaaggtttggttttcagcttcacatatgccgatagcctgtacaagagaagcacgattaaacgaatggccgatcactttctccagttgattaaagctgttgtagatgaaccacagacaaagctttctgaaattgagatcattacgccacaggaaatcgaaatgatattggatgtctggggaaataccgcggtgaaatacccaagtgaaaaaaccattcatcaattattcgaagaacaggtagagaagactccagatcaagtagctgtagtttttggagatagccagatcacatataacgaattaaatgtgcgtgcaaaccaactggctcgcgtgctaagagcagaaggagtccaggcggatcaattggtcggaatgattatggagcgctctatcgaaatgattgtagggatttttggtattttaaaagctggtgggggatatgtacctatcgaccctgagtttccgcaggaacgtatactctatatgttacaagacagccatatccagcttctgattgcaaagccggaaatggccgtgaaggtaccgacggatgtgctagtcatttcacctgatagtcataggctatccgcagaagacggttccaatttggccgaagtatgtgaatccggccatttggcttatgtgatgtatacctccggcacaacgggtaaacccaaaggagtgatgattcaacactctaatgtcgttaatatgacaaccgcatttagacaacaagtgtataagaaatacaaatcgccaatgcggatggcatggctatcgccgtatgtatttgacgcatcagtgaaacaaattttcccatgcctgcttctcgggcatgcgcttcacgtggtgccgagagagattagcaccaatggtcatcgtttggctgactatttcagatcccaacggattgattttactgatggtacaccggcacacatgcatatgctgacggaaatgcaagactccgttgcagacctgaatgtacagcattttatttttggagcagaggcgctgcccggtcatctcgttaaaacatttttgagcacccggcccggatatcgtccgcaaataactaatgtttatggtcctaccgagtgctgcgtagacacaactgcatacgacattgacggggaaacgatgacagcttggacacatacggtgccgattggcaagccaatggctaaccagcacgtatatattatggatatgaatcggaagttggttccgataggaattgcaggcgagatctacatcggtggtgatggagtagggcgaggttatatgggaaatcgtgagctgacagatgagaaatttatagcagaccccttccaacccggaaaacgtatgtaccgcacaggagatttggcgcgatggatggcagacggaaatattgaatatttaggcaggatggatcatcaggtaaaaattcggggttaccgaattgaacttggagaagtagaagcgcaattaatgaacctgcctgcgatccgtaaagcggtggttattgctcgtgagaatgaatcaggacaaaaagatttatgtgcttattttgtggctgatagcgatctgaccattcaggaacttaaagcagcgttggttccgaatcttccgatgtacatgctgcctagctattttgttcaattggagaagatgccgttgaccactaacggaaaaattgatcgtaaatcgcttcctgcgccggacggagacattcaaacaggtgttgaatatgcagccccgcgaaacggcatggaacggcacatggtagatatttggaagcagaatctgggtgtcagtattgttggcattgatgataactattttgatttaggcggacactccctaaaagccattcaattggtttcacaggctcaggctattggcattgaaatagggattaatcaggtgtttcaatatcagactattcgccaaatatcagagtatatgcgagcagacacttcaatgtcaggtatgctaacacgtgatattgccgaggcaatcgacatcatcgaaaaggtttataacgtacatgctcatttccaatcaacagctgttgaagggcgagatcaattaactttgcacatagatcctttcgattctatacaagcagaggcgctgaaggaagtcattttgtcacgccttcatcctgaccttcatccacatcatttgcttccttttgaagcggctgctcaagcacctgactgtaaaaagttatacacagatacgatggtagacgatgaagctgtgaagcggcatgctgaggaatggctggaacatctgctgcggatgaatgaccaatggaacagcacgatgctggcaggggagcctttacaacgatatgcgcttgctcccgctcaacattatcatttggagcatccgcaatcctcaggaggtgtcattccttttgatagttacctgctggatgtagaacggttatctgcaatcatgcaacgcctgatagagcgtcatgaactctttagaagtgtgttggtccaaacagatgtcggatgggaatgggaaatgttgtccatgaaggagcgcatggatattccaatgatagatttatcgaactacggtgcagagatgcaaaatcgtatactctcacatatactgcctgcattctttatgaacccttatgaaacaaccggaaacttgttatatcgcattgcgcttgttcgccttaatttacgggatcatttgctgctgctcccttgttcacatctcatctatgatggcatgagcggagaggtcgttaagagtgagttctaccgtgcatatgatgacatgagcaatgtaaaagagcaactagcaggaagctaccgtgattatgtgagtcaggttcgcaaaggacctcagggcatgggcgatcaagagattgtcgacaaatttcgcttgtccgcatttgctgctgcttcggacgctgtagtcctcgcaattgatgagcgcagccatacaacgggcacagatgtgacagtagaacttgcagattggaatgattctgacgcaatcggagacatgtgggacttggctatacgactagctaaccgctttttccgcagatatttgcaagtggacgagattcctattcttctcaccaattatggccgtgcatatgaggagaagcagtattttgatattataggtgaatttatagaccaaatccctgtactgcttacagatgcggatgaacatgggcatgagatcagaaacagtatgcagttggccgtagcgcgtaatctgaattttctaaatctcatatacaatgatgaaatggcttcgttgtatccgcagtctaaccggtatctgaagtatagcctgaataagctacctattgtcttcaattaccttggcgaagcgtcggataaatatcagctgtttaaaaatatcgagccagaagagagggacatctatcgggattcaatcattttctttactattcagcatatggagaatgtattgcaaatctcactggaacttccttttgaagaaaatccagaaatcgttaaagcaatgttggaaacagagctagcgaacttactagtaacagacggaagtggaataatgtccacctgatttttcactttaggcattaaaaacaagctccgagttcaaaatacggaaactgccccaaagctttcgaatggctttggggcaatctaaacaaaccacaaaagccgcaagtctccaataaccccggagatttacggcttttgtggtttgaatgtagcgaagttttatgtagcaatgtcgctgaattaaaacttgttgtagtagatctttaatccaaataaatgacattggatgcatgatgattggtgccgcgcaatggtttgagatatgaacttagtgaacctacgactcatgcaattgcgctgacttccactgctgccgactcatgaataccaaagacaatgcaattaccgtgaggataatcccaagcatttgaaatcctttgaagctaaacgtacctcccattacgatagctatcaataatgaagagataatggttcccagatatctggatgtgttaaataatccggatgctacaccgattatttcttttggagaactttggaacagtgctgcttgcatacctacattgttcaaaccgttgctaataccgaatgcagctaaagccaaacacacgctgataaccggtgaagttggattcaatgtcacgagccacactgaccccaatgtcatcagaattgcggacaccagcaatgccggtcggggtcctgatttatcgatccattgtcctgcaattggagaagtaattagcgagcacaagcctaagtttagcatgagaatgcctgtttggaactcactgacatgacgtaccatttgcaagtaggacggaagtccgaaaaagagcgagtaatatagtacattaacgagcatgaattcaacattaacccaagtcatcgcagggtacttggcaaatgtacgtaaaggaataaagggtgatgtcgcttttaactcatgtcgtacgaatatccccagcgcaacgagacctaccagcccgaaaatgacatttcctaataagatatgtccagatgattttgctgagagtaatccaacgagcagggtaaccaaagccactgtgaagagcagaattcctaatgcatcaatcaattcaaaccatttacgaaaggacatgttgcgtgctacggatgttggcagttcgtccttaggaatagtcctccaagccaatacaaagctggccaccacaaacggaatattgatgaaaaagatagcaggccaattccaccagtgaatcaagacaccgccaataaaggggccaatcgctgctgctccagataggaatatggacaaaacagacagcgcagttgctggtttctctgtaatatgaattcgaacaatagccattccaaccccaaccatcatgcttgttccgatggattgcacaatgcggaacacgatgagccacccgaaatttggtgataatggagctaataatgatgcaatgaagcttacaacaagcccagaaagaaatatcctcctacgaccgaataaatcgctggcctttcccatgacaggttgtgcgatgctacttgcaatgtagaaagaaaaaataatccaggaaacacctgtaaagtcaagttggaacacattttgcagacttggaatagcaacagaaaccatcgaagaatttaatgggttcaatagtatccctagaccaactgaaatcattaaccaccagctgcgaacgctcatttctggtccccccatagcgaattaatgtcatcgtacttgaaatcgattatttattccaacgcatttgatgttataatctcattgacttgagggaatgaatgggggatcataatggaacttcttcaactgcaatattttctgacggtagctcgtttggaacatgtgaccgaagctgcacgaagtctgcacgttactcaatcgtcgctgagcaaaacgattcaacgcctggaggaagatctgggggttcctctattcgatcgaacagggaggaaactgcgattgaatgagttcggaagtagattccttcaccgtgcagagagggctttatttgaattggagcaggggaagcaggagcttagtgatttatccagcccggaacatggcactctcgaattggcagtgaccaccgcaagcacattacccaatattctgcgagagtttcggaaaaagcgaccctatattcaatttcatgtgcaaatgctgaccacgcaggaaatggtaacgctgcttcatagaggagaggtcgatttttgcttgtcctcacctccaatagagggagatgacatcgaatgccaaatcgtgtttatcgatccaatccttgtagctgttccaaaggggcatcggctggcggatcgaagcagtgtaacgttgacggatctaagggatgaatggtttgtcggtgtaaagagaggctacggtactcgcgatttagtggactctgtatgcaaatcggaaggttttatacctaagtatgtgtatgagggggatgaacctgcaaggcttagtacgcttgtggaagctgaaattggcatagccttcataccaagcacggcaagaaactcacgggaacatcttaaatatcttcaagtagaaaatcacgaattggtacgggagatcgctttattatggcacaggagtcggtatatttcgcgggctgctctagaattccgtgaggtagttgtagaatatttcggagcaatatccaaacagacaatataatcccatatataagtgaaataaaaaacattaacagaagcggtagcgtaggacatgttaaccaaacgtcctaagcggccgcttattcttttattcaactgcaaaatttgtaatttcgatttgtacgctgccatacacacatgcccagctattgaaggagttttttagattgtactaacccatccttctcagctggcgaaactgctccgtcgtgatgcctgtatgctcccgaaatctcttgataaaatagcttctttgatgaaagccagtttccagtgcaatctgctttacagtgagtgccgtggatacaaggagatgtttggccagcgttattcggcattggagcaaatattatgcttttatgtacagagcaccggaatctggaaaagtgtgtggattgaatatgtgaatgaggtaagaatcaatgaggtcaagataacaccggatatcgaccgtcatatgatccgctttgactttcagctcatgggtattgaggctaaagataatttacgcctggagacacggattgcgctgaaaggacagcatgtgaaaaaggtcagcttatctgccgacaggccctggataacggtggaggcccatgtatttcatgaagcgtgtggtccatggaagcagtgcttgtggtcaccggaatcgcccaacttgttcgatgtagagtttgctctgtatgaggatgagaaagagagcgacagggtgtattcttattttggcatgcggaaaatatcgattgaaaacggacagattctattgaataatggccctctttaccagcggctgattctagatcagggctattggccggaaactcatctgactcccccttctgaagaagctcttatcgaagatatcgataaaatagccgcgatgggatataacggggttcgtaaacatatgaagctggaagaccctcgctttttatattggtgtgatgtgaaaggtatgctcgtctggtcagaaatggcgtcgacctttgagttcaatgatcaggcggttagccgctttacgaaggaatggctggaaatcgtgccgcagcagtacaatcatccaagcatcataacttgggtcccgttcaatgaatcgtggggcatatcgaccattggacatgatgtaaggcagcagcagttcacgcaaacgatctatcatctgacgaagacgattgatccgtttcgtccggtggttaccaatgacggttgggagcatacggtctcggatattttgacccttcatgattatgtggagacgggcgaagagtttttggagcgatatcaggacaaggaaagcatcgtaaacaacagcatctcctttaacaattggaaatatgcctttgcagaaggatatgcctaccgaggacaaccgattatcataagcgaattcggcggcattgccttccagacggacaagggctggggatacggaaaccaggtggattcagtcgaagcttttatcgaacgtttccgtgcaatcaccggagcaattaaagcgaccccctatctctcgggctattgctatacacaggtaaccgatgtacagcaggaagtcaacgggttgttgacggaagaccgaaaaccgaaggttccgcttgaagtgattcgggaaataaatctagcttgaagcgataattaagataatagaatttgcagaacggctgcatgctgttgttcagccattgctggattcacttaactagaggtttaaacttggaatagcaatgttggaaaacaggacaacttttcgcatacaggctttttattagaaaactggatttaattattttggttttttgttccccactcacataacccttccaaaacaggtaatagcgtttctgctttatctgtgagactgtactcgactttaggggggacttgaggatattctttccgattcaccagaccatccgcttccaattcttttagttgtgaactcaatgttttataagtaatagcccctatctgtcttttcagatcattaaagcgaactgttcggttttcggctaggagataaataataaccattttccatttaccaccaatcagtgaaactgtataaccaaaaggtgtatcttgaatgtttttaactttacctttaaattcagccatactcatgtttacaatatcctttcgggtagtacctatcaaaatagtgcgtactacgtttttatttgtgttcagtttatactaaccttacttttgaagtaaaggagagaaaacatgactaaaaaaacaatacgtctgttaatgccacaatggcaagggggaaacaatcctaattactcttttggagccgaactgcttgcttggctagctccggataatgatcaaccccttattcatgttcccattcaagcttataacggtactccgcttgaaaacgaaaacggtatgaatgggagaaaacagctacttgaacagttagaggcggctcagcatatcattgatgctcataagccagatcgtattgtaatgtttggtggtgactgcttagtggaacaagctccatttgcctatttgaacgaacgatacggtggggaattaggtttaatttggatcgatgctcacagtgatttagttagatatgtgggctatgataacggacatacattaccgctcggaaatcttttgggagaaggagatgaggagttcgcaaaacatgtgaaaatcccactaaaacctgaaaatgtttttatcgcgggattagcggctcctacagaacaagaaacagaagccatttcagaagcgtttcaaagactagggatagctcctgcagaatcagacacagaagtgattcaaagactagggattaaaactgcaggaaccaaagagttaacgaatagtactaaatctattagagagtggattaaagaaagtggcattaagcatctagctattcaccttgatttagatgtgcttgacccaaaagcatttcgttctttactgttcgccaaccctgaagcgccctataatttttctcctgcgggaacaatgcaaatgcctcagctacttaatctgattaaagaactatctgaagaaacagatgtagttggattaggtataacagagcatatgccgtgggatgctattaatttaaagaatctgcttggagagatacctattttaaataagtaagttcatacatggattataatagaacaatgatctgcttaatcacaaaaatacacccccgcaaacataaagtgcgtgagtgcatttttatgataagcgattttgacatcctatatttgggattgtgatatgtaggagaaaattcaacgaatttagttttatgaatgaacagagctgagaaatgacaacttaagaaagtagtatacatcacaatttccaaaggaggatatctgttatggctcaccagaagaaaaggaaagaagcagcctggaagtcacgaaagcaagagcagcatccccatggtaaagtcaaatcgctcaaggagctgtccagcgaataggagtgaggagtatactgcttgaaagagaaggactgtcggtgaaattcatcggcagccctctttttgcaataatttcgcttatagacaacccaatgcagatagcgggacttgtaaaaaatgttttcctgatgacagcgtctacaaacaccaaattgctatgcgtcacatacatcttcacttattttggaccagtaatttacagcgttctactatagagggtatcttcttaaattcgtttttctacaggttgcctgttccggctaagaattgaagcatctcctgttcaggagatgcttcttctacgttatgattggggagtctgagataagctgatttatcaggatatgattgaattcaggagaccctgcttcacctgatccgacaggggcataagtggcagacgcaattgctcggcggcaataatctcttgttgggtaagccaccacttgatcgcggccggggctggctctgcaaatacatgctggatcatcggttctagtagcataaaactgtctcgcaacccgttcatgtcgccagccacaaaacgttggtatatatccacatacttctggatatggagatgagcggatgcaagcataccaccggtagccccctggcatagcatggcatggaaataggcatcctctccgcagaggacaggcttggtctcgtactgggccaattttaagagcagatcaagaccgcccgtgctgtccttgagcccaattatgccatccaggtccagcactttgcgtattgtatctattgtcatgcgactacccgtgcgaaccggaatctcatatactagcacaggcaggcctacacgagatacgacacggaaatgctccaatattccttcctgcgtcggccggttgtaatacggagtgaccaccatggctgcatccgctcctaattcagccgccatttccgtccgatgcaccgttgaataggtatcgttcgttcccgtgccaacgacgatcggaatggttttgttcatgctcgtcagaacatcctgcgtcacatgtaccatctgcctcacttcatcccaggatacggttggcgactctcctgtcgtaccattaacgaccagaccctggatgtcatggcctgcaagataggtaacatacttccggtacgaatcgatgtccaacttatagtcacgcgtaaaaggtgtaatcagcggtatgaaaatcccatgaatatgttgttcgttcatcatcatcagttatcccttcccgttgaattaaatctaatgtaacataggaaacagcatcagagttatctataataaacgatgattctaatcaaaattttcgatggggtggccagattggatttcatttatcttcaaacatttcgggaagttgccattcgtgaaagctttacaagagcagcagaagtgctcggttacgcacaatccagcgtcacgacccagattcagaagctagagaaaacgtatcaagttaaattgttcgagcgctacaataacaataagattcgtcttacctccgccggagaagagctgttcaagcttgctggacaaatgctggagcttttcgagcaatcgaaagaaaaattggccaagcagggcgggggctccatgacgatcggtactatggattccatcgcttcgtattttctgccgccgtatatgcaggcgactcgcaaagaatacccagatctgaacatacgattgcacacggatcgcgaagagatgattttgcaccaggtgagggaaggggaggccgatgttgggttgatcctcgcggacgattcaagcaacccggcgttgcagtggattaccattcgagaagaaccgcttgtgctgattgtccatccgaaccatccgcttatcgctaaagagcgaatcgacctgaatgatctggttgatgcggagtggatcatgcccgagcatacgtgcaactacagacaactgctggagagagtgcttcgagcaaatggaatcacctatcgcgtgagtctggagctgggtaatccggaagcgatcaaacggagcatcaagactggagagggcatatccattctacctctaatggctgcactggaggagatcgaacgggaagagctgaaggtgttaccctttgagcatgccgagctcaagctggaaattcagcttgttcttcatcccaagaagtgggtgtccaatgcattgagcttttttatggagagcatgagaatgtagattttcctccacatcaaaatcaatatacaatacgagcgcttcctagtagataccagaagcgctcaaagttaaacgtaccgaaggatgagaacttagaaagcaaagatgaaccaaagtttattcaaatcatcgaccgtattttttctggaaaataagcaatcaatatttgtattcactaaaccattcggttacttaatgtttaattagaacaagatgatcgaccttacagccaagaatggtgatttaagttaatgggaaaggaaaaaatataataatgaggagtgattaggtgaaggttttggtggtaggttcaaatggacaaattggacaacatcttatccattttttgaaagaaaacaaagaacacacagtccgtgcgatggttaggaaacaagaacaagctaatgcttatcataatggtaccatgttcctgatgttttggtttttaggcaagggcatattccattactttatcaaataaaactggagcccaaagaagaacgaaacaatgatcgaacagaattgtgtaataaatattgtagaacatacgcatcaaaaaaggattgggaatatcaagtagttttcccaaaaacacctccgatatctctgtcccgtaaccttaagtttttgaaaggttttttaaaagagagaaagtactattcacaatggtataaccctgttatctatcgacttcagtgtatttgggtcttgtccagttgaccatcttgcctccacattcgtaaacaatacagatcccctcttaattaaaccattgatttatcacctcatcgcaaaaggaacattaatcaccaatctcaacgagcttatttcatcccgtagcataatatcactaaacacacaggtgaacccccaagtagaaaaaatagatggaggaatgttgtatggcatttaaccaaatgaggatatatgcttagtgttgtctttatgggaaaaagttcaaggtggttaccataaatccccctcatgtgtggctaaggaggcctgatggtgaggatctagagatattttttactgatttagtgaatcacccgacttttgtactggaagcctcgatgaaacttgagaagcaacaagagaagaagtcatacgataaaagtgctgtacaaatctcttcaactgcaattttggaatacataagatgaaaacctgcttgttctccatggattctcaggctactaagcctgctgctacgaagcctacaggaagtagacgaaagagcgctgctgatgataagaagaccgaataaggagagcgtgccatggaagtccgatccggacaattcgcatagcagccattggcagaaaaaaaagggttgtcccataagtcataaaaatgactagggacgtcctgttctccaattgtaaaacaataagaaaccgttcctgggtaaaatggaggtaccacccgaccatttgaaaggatatggtttctttgtacattcaatataccattatgagataaaaagaggagttacgcaggactatccctcatccatgttatgtggctttgtggccagcccctcaattaatgtctattagctcttaaaccttcaataaatatgcggtgtaatccatcaagaactcgttggcttgtaaagccttcatcttggagatggtaatcgatattgtgaagcacggccagcagggcttcaatagtatatgaaatgtccaccccggatacgtctccctgttcaacggcctcatttagcagatttctgcttatattgcgcatccattgacataacggagattgcaacggacgatgcccggttgaggcccggctgacctcacagagccaaggaactttcgcttctaaaaaagagacatatcttacgattacatggtaaagccggtccaaggcagcggtttctggggattgatcaagaaatgcttgaacttcatcaaacaaaggttggtattcttcatacgcgatctcctgacatatgtcgcccttatccgagtagcggcggtataggcttgcttgtcctactccagcagtcttcgcaatctgatgcatattgacattgtcaacaccgtttttgatgaaaagttctctagccgccgccaaaattcgtcttcggtttaactcctctctgggaattttcagagagacagattgcgattctgaattcatcataaacatctcccttcatcattaatttaactgttatttaacacgaaaaacggacaatatgtccgtttttcgtgtataggacatgttgtccgtcttcatattataatacatttcgtgaaaaattaaaaatacattcatttgggtgaccgatgagcttttttttatttcttggtatagtgctttttgtaaattggaggcaaatgcggttcaatgcccgataggtccagttcctttaaacttgcgatcgaatgaataaactgctcgtatgcttttttcttgtcgctcgtcgtatctgttccggtttcggttgatgctttcctgctaacttcagagttaagttgcttttgatccatagattaccctccatcaaatatattcaggcttacaaatccggatgtctcttgtgccagtctgtattcatttcataagtattgccgatacctagtactgtcgcttcttcgaaggggcggccaatcaattgcatattaatcggcagaccggaaggtgagaagccgcaaggcatgctcaggctaggcaagccagtcaaattggtcggaaccgtaaatgagttcaatctgaatacactagcatcatcatctgcacgcggcgcagtgatcggtgttgccggcgtcaacaagatgtcgattccggacaatgcattcaaaaaatcattgacaattagttgccgggcccgctgagactgaaggtaaatggaagccggaatatctctactgctttcaagaaacattcggacgtccggtccatactgttccaattctgtctcaagccacttctcgtggtacgagtacatttccgtcatcataatggccatcgtcgcacttctaacatgtttgatcaggggcaggctaacttcgatgatttctgctcccagttctcggaatttattgatagcggccttcatcgcagcttccacttccggcatcaaatcctcgtaatagtagcttgtcggcaatccgatacgcacacccctgagaccattcggatacatcttgatacctggcgcaggcagatcgacagtcgattcatcctttggatcgaagccagacatcacatccaagcacagggacgcatccatgacacagcgggtcaacggacccgagtggtccaatgaccaggccattggaatgataccataccgactgacccgaccgtacgtcggcttcatccctacgacaccgcacaaagcagcgggtatgcggatcgaacctccggtatccgagcctgtgcccagataagtaagtccagccgctaaagcagaagccgagccgccgcttgaacctcccgttacaagttcagtgttccacggattgaggcaaggaccgaagtgcgggctagttgttgtcaatcccgcagcgaactcgtgagtctgtactttgcctagcagaactgttccagcctcatgtagcttagctgcaaccgtcgaatcgtaatcggggacgaagctgttcaatatttttgaaccggcagttgttcggatccctttagtgtaatatagatccttatgaacgatgggaatcccgtgaaggggccctttgtaccgaccatgcataatatcgcgttccgattgcttcgcttgttcaatcgccagttcggacgtttgggtaacgaaaacgttcagtttcggattcaaacgttcgatgcggtgaagcgcatgttctgtaatctctaccggggatatttcccttgttcggatcccctcggccagctcatgaatagcagcaaaggacagttggaaatttaatttactcatctattcatcctccgtctctttcggacatgtcgtaagtctaccaaactaattaccatagcttccgctacgatttgcttttcttgcgaataagtatgtcaggattgccaacagggaaatggtaaaataaacaacagaaaaaggcatctttagatcaatcagtcggccgaccagcgcagggccgaatgctccgcctaggagataggccagtgtgaaaatacccatccctacacccagctcagccgaacggagtgtcgtcgaaactaaattgctgctagaggtgaggacaccgttgaatccaatcataaggataatgatcaataaagcgtcgatccatggcggcaaatgtacggatacccccagtagtataaatccgctgatgacgagactttgcgatatgacaagcacgcgggagcttccgaaacgatctgtccaacctccgatccgggatccgagcaaggctgcacaggcggcaccgggaagcatcagcagaccgattttactagttggtaaatgaaaggaattcttcatcatgacaggaagagtaaaggttaaccccgtgttgcatacgaaggtaaggaatccaatccctagaattcgtcggtaaggagcatttttcatgaaagatgcatcgataaatggatgttcttttttctgaatatgagtaccgaaccatagaagaactgctgctcctgcaatgagcataaaccaatagttcgtaacccctagcaataccaacgccagtcccgcggagaacaaaacagctccgagaaaatcgaatgaaccgcggtcgtgtttcttgtcaggaacatacttgaatatcaaagggataacaaataggctcagactggacacgatgaacaaagcacgccagccaaagtattgctccacgaaaccgccgaacacaggcccgaagccggaagcaaaggcaattgtggcggataaggttcccagcacccgtcccttgactgtaggcttaaaatacagggttactgccgtataagacaggggagagatggatgaggcccctgctgcctgcagcagtcttccaatgatgacttgcaagtatgaagctgcaaaaaagccgatcatagagccgaaagctaaaaggattaaaccaatgacatacagctggcgaaaggaaaaggactccgttaacttgccgtaagtaccggcgccgatagccatcaaaatgctgtagccgaccataacccagctcacctgcgaggaggtcagggcaaagtcagcggaaatcgaaggtatagacaaattaaacatggtcatattgatgtttccgaaaataatgagcaagcaaagtgtccccattaatttccgctcattgccggacaaagccattgattgagtatccatggcctgttcctccattacaggaagtcaggaaaggtgcggcatttttgcgcctgatctctatcgtgtcccaagaaaacataggacggccgaacatcctgaattaactcctgcatgcgagtaatcgatttggcagccatctcttgatcgaatgtcaagaacggtacgctattctcgaagttctcccgagtataagcaacatcaattgtcagtagcactggacccgacttttctgttgtgacaaggactgattgatggccaggggaatgacccggagtgaataaaatttgaacccccggaatcaattcatggtcaccctcaatgatttgatattgtaaatcgtgcagcctgcactctaatggagagtaatcctcattgtttatggccgcatcatactctgccctttgaataaggatcggggtattgcggaaatgcccgtttcccccagaatgatccaagtgtaaatgggagctaatgaccatttgaatatcgtcaggtcgataacctacacgctttaacacatttacgatcgagtcgccgtcagacatgttggggacgacgcgcccttcacgtctagtccccttgtagtaatcgggattgttgataaaagcgtcgggcattcccgtatcgatgagtatcggcccgctggtcgtttccaatagaaaagaccacacaggcattccgactaatttcccgggggcaagggttcgattaactgccgattgatctaggaaacattcacctacaggtaaaaaatacaacttttttatattcattccagtttcacccttcatattataaattcggacaatttgtccgttttgttttgattatatcggacaaattgtccgatgtcaatttgtcatcggtggttgggcttcggcaaaagccttacacctgcaacaatacgccaagctaaagaatgtcgcctaggtggagtgcaaagaaacaacggggctgcgttaaagccgcagtgtacaaaaaccaaggggatcgcgatatcaaagtgagcaagagtatttgcggctaaagagccacgcaagacaaaagccaaggagctaaggatatcttattgaatacacttccggcatattgacgcaggtatgagttacggtaatacatgagacgaatttagctatactttttttggtatatgtcttagacttttttagccgggcagattgcctacagtttactcaaacggatgttgtgtcgctgttgcggttcaggtagaaccagtagctaaaaggaatctactggttctcatttctcttcacagttatagaatgacgagtgatcatattagggtgtgattatgttattgttggaggataagtctcagttataatccaaaaaaacgtaaaaagtctcagttataaagcaagaaagtatcacttataactagaaattttaggaatgtaagaataacttttgtctcaagtatagccattactcatagctggaaagcagcagtttgaactacacaatcataagactggggattcttttaagtgaaatcggtacgggaaaagtggctaccgcggagaatatcacctatggcagcatcccacgtgaggatctagcccgtgccattgtggcagctttagatgaggagaacacatacaagcgagcattgatctgattactggtgacgattcagttgtcgaagcattgcaaaaaatctgaagatgaatgatcaagtgtgaatccaaacaataatgaattatttgcaccaattactttgaaattttgaaatcatgcctagagttgacaaatgaaacaaacatgttaatgtatatgcttgtgcatgcattttattgatgcatttcataatataaatcagagaggagtctttctcacatgaaagatttatttagtccctatacaattaaaggtttggaattgaaaaatcgcgtagttatgcctccaatgtgccaatattcggttgacaaaaaggatggggtcgccacagattggcactatatacactacgttaaccgggcggtaggcggagctggttttatcataattgaaatgacagatgtagagccagatggtcgtatctccgattttgatcttggtttatggtcagatgagcagattcctgctctcaaacggattgtagatgcttgtcacagctacggtgccaaagtgggaatccagatcgcgcatgccggacgcaaggcggaagatgctgaagtccctgtagcaccatctgctattgcatttgatgaaaattcaaaacaacctcgcgagcttgcaacagaagaggttaaaggactcgttgagaaatttcgtgctgctgtagctcgcgctgttaaggctggattcgacagcattgaaattcatggtgcacatggctatttgattcatcaatttcattcgccgcttacgaacaaacgggaagatgaatatggtaaagatcttaccctctttggtcgggagatcattcaggcagcgaagggcgaaatgccggaagatatgccactgttgatgcgtatttctgccaaagaatatgtagaaggtggatatggtattaaggaaagcattgcttttgccaaggaatatcaaaaggcaggagtagatatgtttgatatttcatctggcggtgagggacctatagctgcatggggcagaccaggaactcacgcagcgtatcaagtccccttggcaaaagatatcaaagaagctctggatattccggtgatggccgttggaagactggaagatccaattttggcgaatgcagttatcggaaatgaagaggctgatctggttgctgtgggtagagggatgttgagaaatccttattggtcactggaagcagcatcaaaattgaaaaaagaaactgcaatccctacacagtatactacagggttttaagactgactgtatacattactgattgagcctgcttgggtcagtaaaacgattcgaatcgattaagcaaaaaaagtacgtcctttagaccttctgtaaagtactctatcaaggtactctacaaaaggtctaattaatgagctctgcgatcacagagagcatccagaatattgttgctcaaaccaatttgctggctgcctgggcaggagcatggaagaaggttgccgattgtggcgggagaaatacgtaagaatgccgaatatgctttgaatctgtgggcggaatcgatgaccagacgattcatcaaagtacggcatgtagaacttgaccttacaaacaataatgaagatgttcagaggaagatacataagaagagattcagttttagctctgatgtctttatattggactttgtgtagaaaaattggtaaagatacaagctagttacggaggatttttttgtattccatattttctctaattgactttgtgactcgacattattattatcttatactataagattaattatctcatactataaggtattagcgagaaggtgttgtgaccaatggattataaagcattagcgacagaactattcgagtatatcgtcaaatcgcggaaaccggcattagaggaacgagggcacttctcacgtggcgaaatggggattctcatttgtctgaatttcaataaggacggggttacctctggccacttgagcgaatacttgtccgtcagtacgggacgggtagcaacggcactgaagagtctggagaagaaaggactagttgtacggcgtactgatgtcaacgacaaacgtaaggtgattgtattcattacggattcaggtaagcaatttatgattgataggcataatgaaggaattgcatggaccgagaatgttcttcgaaagttagacgaagaggatgctaaagaactgattcgactcattaagcttattgtctctagaagctgaacttctatgcagatgcaggacgcaccatacttcaccaaacatcaaagactatcagataaaaggagagcaacagaatgctaaagatattcaaatatctcaagaaaaatgaatggatgctcgtgctttgcagcctagctttcatcgttgtgcaggtatggcttgatctgaagctgcctgattatatggcggaaattacgaccaagctgcaaacggaaggaacgcctgtgtccgaactgctgattcccggtagttacatgttgttttgtgccgtcggcagtatgattgcatctattattgtgggctatttcgcggcaaaggtggctgctgggctggctatgcgtctgcgtgcgatggtctttgacaagaccttatccttttcgatggaagagatgaacagcttttcgacggcaagcctcattacccgctccacgaacgatgttacgcagattcaaacggtggttgcgctggggctgcaggtgatcatcaaggcacctattctggccgtatgggctattgtgaagattgcggataaaaactggcagtggaccgcctccacaggagcggccgtggctgttttgattttaatgctaagtgtcattgttgttttcgctcttccaagttttcagagaatccagcgtctcaccgataatctgaacagggtaacacgtgagcatctgatcggacttcgggtagtacgcgcttataatgcagatcagtatcagcaggagaagttcgagcaggctaacgttgagttgacgaatacaaacctgtttgcgaaccgattaatgacgatgattggcccaggtatgacctttattatgtcaggtctgagtgtctctatctattgtatcggcgcttacctgattaacggggcggccgtaccagaccgcatcacgttgttctccaatatggtcgtattctcctcttatgcaatgcaggtggttatggcctttatgatggtaagtatgatattcattctgatgcctcgcgcctcgatctctgccaaacggatcatggaggttttgaataccgaatccagcatcgttaacgggcatgagacgactggagaaaagagcgttatggggcaagtggaattccgtaatgtcagcttcaaatatccagacgcggaggaggccgtgcttcgcaacattagctttacggcgaaacgaggcgagacggttgcctttattggcgctacaggcagcggaaaaaccagcgtgattaatctgattccccgtttctatgatgtgaccgagggagaggtactcgtggatggtgtgaatgtcaggaactataatcagcaggcactccataacaaaatcgggtatgtcccccagagagctgtactgttcaacggtacggttgtatccaacgtttcgtatggcgataacggaagagcaggagcttcggagaaactcgttaaagaagccgttggtattgctcaaggaacggagtttgtcgaaaagatggatggtcaatatcagggtagaatttcgcaaggtggagcgaacgtgtccggtggtcaaaagcagcggctgtccattgcgcgtgccatctaccgtcagccggaaatttatattttcgatgattccttctcggcattagactacagaacagaccggattctgcgctccgctctcaaaaaagaaaccggtcacgctacgacacttatcgttggtcagcgcataggtacgatcaaagacgctgatcggattatcgtgctggaccagggagagattgtagggagcggcacgcatgaagagctgatgacgaactgcagcacctatcaggaaatcgcatattcgcagctttcgaaggaggaactcatatatggataagaatgaacacaccgtcgacagccagcaaatgaaaatgaatcagcgaggtcccatgggtaaaggacccgcggggggcaagggtactggtgaaaaagcgaataattttaaaaagaccatcagccagcttgtatcctacagcaaggcctatgtgcctatgattatactagctatggtactggccctggtcggctccaccctcaacgtgattggccccgataagctcagcgatattgccaacctgattcaggaaggaatcgtgaccgggattgatgtaagtgctgttcagaagattgttcttgtattggcgcttttatatggatttggtcttatctttaactatttccagggctttattacagcaaccgtctcacagcgtcttacaaagaagatgcggacagaactgtctcgaaaaatcgatcatatgcctttgaagtattttgactctacgagctacggtaatgtgcttagccgtgtaaccaacgatgtcgacaccattggacaaacgttaaacaacagtctcggcacgcttgtcagtgcgctggctacctttgtgggcgccttgattatgatgctgtatacgaactggatcatgaccgttaccggaattatagctacgctgatcggcttttgcctgatgagcgtgattatgaagcattcacagaaatactttgttgcacagcaagcggagcttggccagatcaacggtcatatcgaagaaacttatgctggtcataacgtagtcaaggtatataacggggaacaagcagccaaggaagtgtttcatggcattaacagccgcttatatacaaatgcatggaagtcccaattcatgtctggtctgatgatgccagtcatgatgttcattggaaattttggttatgtcgcggtctgtgtcgtgggagctttgctggtcaaccaacagactataactattggaactattgtcgccttcatggtgtatattcgtctgtttacacagcccttgtcgcagctggcacaggccgcaaccaatctgcagtcggcggctgccgccagtgaacgtgtattcgaatttctgggtgaagaagaattggcagatgagcgtcacaagaccataaagctggacactgccaaaggggatgtcgaattcaaacatgtccgtttcggctataatgcagatcgtatgatcatcaaggacttctccatgaaagctgaagctggtcagaaaattgccattgtcggtccgacaggcgctggtaagaccacgctcgtgaatttgctcatgcggttttatgagctgaacgatggagaaatctacattgacggcaccccgattagccaattaacgcgcgagaatattcatgaattattctgtatggtgcttcaggatacctggctgttcgaaggaacgattcgtgacaatatcgtcttttccaaagatcatgttaccgatgagcaggtggaagctgcatgtagagcggtgggtctgcacagcttcattaaaacactgccgcagggctatgatacagtgctggatgacaaagccaatctctctgccggtcaaaagcaattgattaccattgcaagagcgatgattgaagattcacccatgctcattctggatgaggccacaagctcggtcgatacgcgtacggaattgctgattcaacaagcgatggaccagctgactgtggggaaaacctcctttgtgattgctcaccgactttcgacgatcaagaatgcggatctgattctggtcatgaaggacggtgacattatcgaaatgggtaaccatgaggaattgttggctaaaggcggcttctatgccgatctatacaatagtcagtttgaacatgcatcttaaaactaaatgcttgaaagcacattaaatatccatataattctaacgaaattgacagcagcatgtggacattataaggtatgaaagccagaattttttaatcataattgtggaggcagatcaatgaaccagcgttttcgaatcacccgttccatacaggaaagtcctgtggagccatccatttccctggaggagtgcaaagattactttgcatcccagccagacttttcgtattcacgagtgctaatcatacaaggtgctgagagtaccatgtcgatcgagggagactttttcatgtggaagtatgctgatgtagaaataccttttcgtcattacatgggtgatgtgtatgtggctatttccgatgaggctgtcgtgcctaagatgattgaaattgcaacagatttgcaagcagatgtggtgaatgggtgaagaactattcactattcttattctgctgaaggttgttgacttcgtagtatatctttacagcaaattgacagtgctgatttctgcctgctgacatcaagttacatagatgtcagcatttttgttaattatgtcaatatactgggaagaataatccataccacaaaatacatattccattggctggatgctaagagacttaacagttggatcaactaaaaggggaacgatgctaggttagagatgtttcgctgtttctcattacggaagcagtgcaagctggtaaattaggcgaacaaccattgacggtaaaaagcggtgatttaattattgctttggatggcgcattaatggagatctccagttcggaacagtttggattgtcaggatgggctgtcagcgctcgtttgtatgggatgtttagcgaggaagacagtaatgagattgttttgcgtaaaaaactggagcttcccaacgagtgaagcattttgaatcggttaatgtgaacagctgcggcaagcccttgtcatttaaaagacgtgatgtacgagggtttgtctggatttctgatgagtggtttcaaaggattcgtttcctgtctggtcactgggcagaagctcactcggttgtgatgcgctcggtaacaaaaacgattcgattcgtacacagtatacatcacacaacaaatgtttccggtacgttcgctgtgagagtattcacttcattcttaagggtcaagtcgccaaaaccttaaaatagcaagtctcttgcaacatggagacttgctattttgtattttccgttcattaaattttgcgaaaaaaatagttccaaagttatgagttttctaaaaatttatatttttaaaggggaatcaaaacgtttctattaattaaaaaataaaatttatagcttaaattagaggaaatttaagctgaactaaaatttcacaagaaaaattaaagaaaattccgcatgtaaattagttcaaaagatctattaaaagtcactatctatttaaaaagtgaagagttattaattttgaatcattccagcttaatgcaaataaattccatgatataggtaattaaagaatattgctgaaaaagttgaaatttgtcggataatgtcaggattgatttgttatatttgtgttaatggtatgtaacgtaaaatttgttttggcacaaggattttgagactttcttgcaagcctacattattttgattttatcaattgataaaatcaaaaaatttgttttgaatcacgttaacgggtcatggtcagtattcaatttaataaaaaagtaaaattcttgaatttgaatctataaaaataatagaataatatgggttatttattgatttcatgaaatccatcaatttggaacttatgtcccatgctaatcggttttaaagtttgtatatttaaaatagctagaaagtattgggaggaaaaaagggatataaggatttattgtgagattttggacagtaagaggatatgagaaatttatatgtcaactcggtcatgacttggttttaaaaacgtgatccatctgactgagaagatccagttattttgtttcgctcgacatgggggctttaaacctgaatggcttacagaacatgaaagttgttcaacagaagctccatggatatcaagcagaacaatatgccctcaacggcttcccgaaatggcttcataagtacataagctgttttcttttttagacactgtatgggagcactgattgtaattgaaacagcatggcagttgtataggcaaaactgcaagatttcctgtccatagcatcatatctggtaaatccgtctcacattttccgtattccaaaagtcaactctattattttaaggtatgcgaaatatatcctaaacagccttggaatcccgttggctcgtcagatgaccatcatttttcatccatgtacaaaatcagggaagttataaacgcagtcgtgagtatttttttgtcctttcatcctagaattacgctcctaaccacgctgcagcagctcatgtatctcgcagcatcgataccctccagccaagattctaacagcacacagcatgatacactacgttgttaacactgcggcaaccattctacaacccaccaccaagatgtactctcagcataattcaaaaatgttctcactccatgcacatattcatacatccagagtcagagttatttcactatgtccgcccaactaaaaaagcttgcactgcgaaagtgtgagtgatgaaaaagagagatgtgcttgtttctattcaaattcagcttttcgaagacacccatatctcaatggtatatcaggagtggtcgcttttgccgactgtcattggcaatttaatgccggtgaaaaggtacgcatgaccagttccttgacaaggacggtcatttatgaggagttactttttacccacatctatttcgcgaggagagatacgtatgactcagcacaatgttcaattgtttgcattaagccaaccacagcaacgtatttggtacacggagcttgtgtatcccaatcgcaacacgtctacgattattaccactgttaaaatcaagggaacagttcgaatagatgcattgcagcaggcaatgaaccaggtgattgcacaaaacgattcttttcgtatcaaagtcacggctcgggacggcatcccctatcaatatgtggagccgtttgctgctcaaagcatagaaacgcttcaggttaccccggaggaagctgagctatgggtcagccatcataacgcacagccgttccccttgttggatttgcagctgtatcggtttgttattttgcggttgggggcagaagacacctggtttagtttcaaaatgcaccatattatttcggacggcgtaaccatggagcaggccattaatgaaattacggggcattatatgaatattgtgcatggtacaggttcagatgcgttggctccagcgaattcatatctcgattttattcaggtggagcaaagctatgagcaatcggaccgctatcaaaaggacaagacgtactggacggagaaatttgccaatttgccggaggttacaggtttaaaatcatacaatccgcttacggtgagtacggctgcacgccgggagaactatacactggagcacgaattatatcgtggtgtcacggctttttgcgaggcgaataacatcagtatttttacatttttcctggctgctctgtatatttatttgcataaaatgacaggggaacaggatttaaccgtgggtacattgtatgctaaccgtacgttgaagaaggaaaaaaatacaatgggcatgttcgtcagcactgtggctacacgtctgcgggttgagccggaatccgagctactcaccttcctgcaaggtgttggcaaggagcaggcgtccattttgcggcatcagcgttatccgtacaacaaaatcatgcaggatttgcgtgaacagcaaagcggcacggatattcgccgcctgtttggcgttaccattcaataccgtacactgagcttctcccgttttgatgaagccgttcagcaggtgcataccgatttctgcggagatacggtgagtgacttcgatattgccatgatagacatgctggatgacgataaacttgtattgcaactggattatcggaccgagttgttcagcgagcaggagatcgcccgaattattcgccaattcctgagtgtggtagagcatatggtgaaagggccacagaagcggattcaggagttgtcactgatgagtgacgaagagcgggcacaaattatggatgtatttaatgcgacagcagtgccctatccacacaatgtggggattcatcagctattcgaggaacaggcagaacgtacaccgggtcaaacagcggttatgtttggaaatcagtgtctgacctatcgggagctgaatgaacgggcgaattcattggcacgaatgcttcaagcacaaggagtaggacctgacaaactggttggtctgatggtgcagcgctcattggaaatgatcgtaggtctgctggccgttttaaaagcaggtggtgcatatgtgccgatcgatcccgaatttccgtcatctcgtattgaatacatgctggaagacagcaaggccgaagtgcttctgaccagtcgtgatctggcagaagaacatcattacatcgccaataccatgtttcttgaggatgcagcattgtatcagggagaaagcggcaacctagaggcgtttgcccgcccagagcatctggcttacgtcatctatacctctggttcgactggaaatccgaaaggagttatgctccagcatcgctcggtactcaactttattaccgggatgcgtgaaatcatcgactttgaagcgaacaaaacgattttgtcactgacgaccatttcattcgatattttcgtattggaaaccatcctgcccctgttgagtggaatgactgttgtgcttggcgaccgccagcatcaggtgaaccctcaggcgcttggtgagttgattgctcaccatcatattgatatgttgcaaatgacaccatcgcggctgcaaatgctgatggatcatgaatcaggtttccgcgcgctgcgagacgtaaaggaaattatggtcgggggtgaagcccttccgtccaagctgctcgcagcactgcaagaaataaacggtccccgcatttataacatgtacggacctacagaaacgacggtttggtcgaccgtacaggaactgactcatgctcaagacattaatatcggacgtcccatcgcgaatacccaaatctatatcatgaatgcgagtggggaattgcagccagtcggtgtgccgggcgagttatgtattgcaggggaaggactggcccgtggatattggaatcgcgaagaactgacggccgagaaatttgtggataatccgtttgccggaggcaaagtcgggtatgaacgtatgtaccgtacaggcgatttggcgagatggacgctggacggcaacattgaatatttgggacggatggaccaccaggtgaaaatccggggctaccggatcgaactgggcgagattgaatcgcagctattgcaggtggaatcggtacgagaagcggtcgtcgtggcccatacggacgaaacgggtcaaaaacaactcgtggcgtactatgtggcgagtcaagaactcggagccagcgaactgagaagtgagctggggcgggagctaccaagctatatggtgccgtcgtatttcattcaattggagcagatgccgctgacaccgaacggtaaaattgatcgtaagtccttgccagcaccggaaggcagcctgcaaagcggagcggattatgtagagccacgcactgcaacggaacgggcactcgcagccgtctggcagtcagtcctgggcgtgccaaccgtcggaatgttggacaatttctttgatctgggcggcgattcgatcaaggcgattcaaatcgtatctcgtgcgttccaggcaggctacaagctggacatgaaggatctgcttcggtatccaaccgttgcagcattggcaccgcacatgcacgaggcaagtcatacggcagatcagggagaagtgagcgggaaaacagcgttgcttccgatccagcacgggttctttgaacaagagcaagtggatgcgcatcattttaatcaggcggttatgctgcaccgggagcagggctttgacgaagctgctttgcgtcaggcgcttatcaagctgacggagcaccacgatgcactgcggatggtgttcaggaagaccgagcaaggctatcaagcgtggaaccgcggaatacaggaaggcgagctgtatcatctggacgtgctggactttagagctttgacagataaatccatgctgagcgcgacgattgagacgaaagcaactgaaattcaaaataacatgaatctgtccgaaggaccgctggtgaagctgggtctgttccgttgcaccgatggagaccatttgttggtagcgattcaccatttggtggtcgatggcgtgtcttggcgtattttgctggaggatttggcatccggctatgagcaggctttacggggcgagtctgtccgtttgcctaataagacggattccttccgtctgtgggctgatcagctgtcgacatatgcgaacagttcggctttggagaaggagcgtgcgtactggcaacagctggagcaagcggcagctacacaagcagctttgcctaaagattacacccgtaaatctcaggccaagccacagcttcgcgatgatcggacactgacagtagcgtggacagtcgaagaaacagaacaatttttgaagcaggcacaccgggcctacaatacggaagcgaacgacctgttgctgacagctctgggcaccgcaattcaggagtgggcaggcatccgtcaggtgcttgtaaatctggagggtcacggacgggaagctattttgccggatgtggatattacgcgtacggtcggttggtttaccagccaattcccggttgtactcgatatgggcgaggaacagaatgtgggacggcgtgtcaagaacgtcaaggaaggactgcgccgtttgccgcataaaggaattggatacgggattttgagatatcttgctgacggggaaggggaagctgcttttgtcgccgagccggaaatcagctttaactatctcggacaattcgatcaggatttgaaacataatgcctttcgcatgtctccttattccatcggagcttccattagtgacacgttaaccaagcggtatgctctggatatcaacggcatgatcacggacggtgcactggaactgacgatcagctacagcaacaaaacgttcatgaaaaagtcaatcaaaaagctggctgatctgcttcaggagagcttgcgtgaggtattggctcactgtgtagaaaaagagttgccagagctgacgccaagcgacttgtccttccaaggactgacggctggagagctggatcatattgtagagcagacggctgctgcgggtgagctggaaaatatttattcactcacacccatgcaaaaaggcatcctgttccacggtttaatggagccgaaatccggggcgtactttgagcaggcgacatttgatctgcaaggcagctttcaagtggaggcttttgccgaaagcttaaatcaactggtggatcgccatcaaatattcagaacgaatttttatagcggctggaatgagcagcctttacaggtggtgtaccgtcacaaacatgccgggttccgttttgaagatgtacgttcaatgggacaaggagagcaggacgcatacattgctgattttgctgagcgtgacaaagccgaaggctttaatttcagctcaggcgagctgatgcgggtgtctattttgcgtacaggtgaggagtcgtaccgttttgtgtggagcttccaccatattttgatggacggctggtgcttgttcctaattgtaggagaggcatttaatacgtactttgccatcctcgaagaccgcaagccggagcttgccccggtaacgccatacagcgaatatattgaatggctggagcggcaggacaaagcagaggctgaacggttctggagtgattattttgctggtttcgagcagcagacggtattgccgcaggcaaaacagctggacggtcccgctaaagaatatgaagcggacaagctttcgtttacactggaccgcgaagtgaccaagcagatgaacaagctggttaagcagcagcaggtaacggtcaatacactgctgcaagcggcgtggggcgttgtgctgcaacggtataacaacagtcgggatgttgtatttggcagtgtcgtatccggcagatcagcggatattccaggcatcgatacaatggttggtttgttcattaataccgttcctgtacggattcacagtgagaaagatatgacgtttgctgagctgatgaagcaaacccaggagcaggcgctggcttcccgtgcctatgaaacctatccgttgtatgaaattcaggccctgactgagcaaaagcaggatctggtaaatcatattatggtgtttgaaaactatccagtggaacagcgtatggagcacatgggcagccgtgacacgaacggttttacgattgccaatgcttcaatgtcagagcaaacgaactatgattttaatattacagtggtgccaggcgatgaaatgggtattcatttggaattcaacgcgctggtgtttgaacgtgcagctgtcgagcaattccgtgagcactggctgcatgtgatagaagaagcaattcacaaaccgcatgcgctggtagatgagctggagctagtgactgctgaggaaaaagtgaagatcatcgacggctttggatcagtaggcgtatctgcatggagtgatgaaaagcaatcagaagggttgttccacgcctatgtggaagaacaagcgcagcttgtgccggatcacgtggcagttgtatacgaggagcggcagcttacataccgtgagctgaacgagcgtgggaaccaacttgctcgtagattgcggaatgaaggcattgggcgcgaatccattgttggtattttaagtgagcgctcggtggacatgctggtcggcgtactggcggtatggaaagccggcggggcatatgtaccgttagatgcagattatccgtccgaacgtatccgctttatgctggaggacagcggtgcgacagtgctactgactcaaacaggtttgcaggagcgtgcccaagcatggctggaggaaagccgatgggctttggccggagggcaggctgagggcgagctggaaacggcggttagcattgaaacgatggaaagagacagccttaatgagggattaagcttgaaatcagaatctgatagcgaagcagcatccgaacccgcagcgaacttgcgtctgcacaccgtactggtgctggacgatgagtcgctgtacatcggggatgccacggatgtggaacctatcaatgagccgcaggatctggcgtatgtgatctatacgtccggtacaacgggacgcccgaaaggggtcatgatcgagcatcacagtttggtaaacacagccgcggcctaccgccgggattaccgtttgaaccagttcccggtacggttgctgcaactggcaagtttctccttcgacgtgttcgtcggggatatcgcacgggtgttctataacggtggcacgatggtcatctgcccgaaagacgaccggattgacccaagccgtctgtacggctggattcacgactatcagattacggtgttcgaatccacaccggctttaattgtaccgttcatgcagcatgtacatgaacagggactggacatgaacagtctggaactgctgatcaccagctcggacagctgcagcgtgacagactaccgggtgctgcaagaacggtttggcgcggatatccgcattatgaacagttatggcgtcacggaagcagcgattgactccagcttctacgacgaagagctgtcgaagctgccaagcagcggcagtgtgccgattggtcaggcgtggctgaacgcacgcttctacattgtggacagccagctgaatccggtgccgatcggcgtactgggcgagctgtgcattggcggtgccggggtggcacgggggtacctgaaccgtgcagacctgacggccgagaagttcgtgacgaatccatatgtagcgggtgaacgactgtaccgcaccggcgacttggcgcggtggatgccggacggcaatgtggactttatcggccggatggactatcaggtcaaaatccggggatatcggatcgagctaggcgagattgaaacggcgatccagcgggtgccgggtgtgcgtcaagcggtagtcatcgaccggacggatgagcgtgggcacaagtacttgtgcggatacattacgggtgaagccgagctgcggatcgaggaagtacaggccaagctggaagccggactgccagcacatatggtacctgcacgcttgatgcgtctggaggcgatccccctgacgagcaacggcaaaatcgaccgaaaggccttaccggaaccggaaggaagcatccatacgggtgcagcttatgtggcaccgcgtaccacggtagagcaagtactggctgcggtatgggccggagtactcggcgtggaagcggtaggcacgcaggataacttctttgaactgggcggcgattcgattaaagcgctgcaagtgtcgtcccgattgctgcaagcagg

SEQ ID NO: 27 - DNA, 368976 bp, Unknown
  Kingdom: Bacteria, Phylum: Firmicutes, Class: Bacilli, Order: Bacillales, Family: Paenibacillaceae, Genus: Paenibacillus
tgacgagataaaaatatctcattttcgcttccatttcatacagcctaatggcatgtaccaaaatttctgcgttggattttgtaaacaaaatccatactcactcgttgttcagttttcaaagatcaaattttcatgcggctttgtttgagccagaataatagtataacattttcatctgattcattcaacctgtaaataattccaggcgattcatccaacccagatttttaataatcatttttgggctggactaacaatatatcaatttaaagcaattaagtctacctgtgaaaatttccatcttgttcaaacttattaaaattttttgatcttgttttatcggctggactagtaatttaacacgtataccaaattaattctacttgcaattaattccttttaatagacaactatagataaacaccaaaataattcataatgccaataggcggaagtataacttaaatctgtgttattctaattttacataaggatttgctttgtcaattagttatggcaaaaataatgcttacgtcactcaatgaaagtgaggttactcgatgcgtattccaagagttgataacttcatctgctctatgacagttagattgatcccgaaatatgaaaaactgcggtatctttagacgagtcctagataccgctgttttattgaactatcgttcctcgtttgttaaacgataaacttaatctccgtattgtgtttacagcatacgcaactcctactttgagttcacctctcgacgatgcaaggtgaagaagaaccttttgcctactgtggggacagatttaggaagccatgactttaatgttcaagaggatgccgctaccgcaagcgtaccggaagaatcagctgtatgatgaatactccgcacgaagcgaatcgtttttgtttccgagtgcattacaactgaatgagtttccgctctgtgaccgggaagagaacgaaccccctgcaaccactctccaggtgtcacacctgtagccacaaacatcacgccttggcgtccgaccatatcatccatggaaagcaacgcaccggggtcagtaatgcccatacgtttgcaacgctcaatctcttcttcaccatgaggcagcaggcgaccctggatttctccgcccatgcatttcagcgctgcagcggccaatacaccctcaggagcgccaccagaaccgatatgcaaatccacaccgctatccaggcatgtttcaatcgcgcccatcacatccccatggccaagcagtttgattcgaacgccgctttcccgcagaagcttgatgatcccggcgtgccgtgtacgatccagaatggacacggtaagatcagacaaggatttaccgagtactcgtgcagcttttgacaatgtagttgggatggggtcctcaagtgatagctttccagccaatgccgggccaacggccattttttgcatgtacatatccggagcgtggagtagactaccacgaggtgcagcagcaatgaccgacagagcgttattcaaaccatttgctaccgtttcggttccctctagtggatcgacagcgatgtccatagccggtcctctacgattgcctactctttccccgatatacagcatgggagcctcatccatttcgccttcaccaatgacgaccgtgccgtccatggataccgcattaaaatgagtgcggatggctaccgtagccgcctcgtccgcgctattcttatctccacgccctgtccattgtgctgattgcagtgccgctgcctctgttacccgaacgaattccaatgccatttgactctccatacctatccctccacctctcctaaaaataatcgttacccttaagcaaatgaattatttagggtagctttgccgcaatctttctatttatctattaaactcctgtatcctacgattttaatttttagttatatgagcagctactaggctctataacattctgataatcaaacctgccgtctcttcaatcgccttatctgtaacatcaataaccggacaattcagctctttaaacaaagactgcgcatacgctatttcctcttccaccctcgtcgctgtagcatactgcacattattaggaagccccataacctttagtcgctcactgcgtatttttaacagtaactctggctcgatcgttaatccgaacactcgactacgctgaacatccttcaactgaacagggggtgtcagctccggtacaaccggtatgttgaccgttttataacctttatgcgcgagaaacatggataaaggggttttggaaatacgggataccccaagcaatacaatatccgctttaagaatggcgctcacatctttgccatcatcgtattgaaccgcaaaatccaaggcctctacacggcgaaaatagttgtcgtccagtcgatgcagcagaccaggcttctctttgggatcgtcatggaacgtatcggcaaacgcctgcatcatcggtcccataatgtcgacagcccgcacattcagccggacagcctcctctttcatcgcctctctcaattccggctgtaccagcgtataagctacaaagcctttacgctcggcaacttcctccatcacccggctcagctcgtcttcatccctcacgttcataaatcttttgatctctgtgtctggtaactcaaattggcgcatggtcgcctgtacgacagcttctgccgtctcaccaatcgagtctgaacagatcgctataaaatgactgctcgcctgaaccatttgattcctcccattaatcctctgctaccatatcgagcaacattttaataatattcgtttttgtaatgcgtcccacgactttccagtgctcccctggcttgtcggagtcggaagggacgacgacaggcaggctgtcgatttgacgggcaataattttgcgcgctgcctctaataccgtatcctctggggaaacggtgacaacattcgcctgtcgggtcatcacaaggctgacaggaatggttgctgcattgggattgcctaacgttaccttgagcaaatccttgcgggaagctacccctgccaaatctccgtcttcatcggtgacgatcaaattgctcacattttccaaaaagagagctacgacagcttcctggatcgttgttgtttctcggacgatgactggaaccccatgaagatcgccgaccttcatttgcaacagccggaatttttcctcccgatttggcgtgccccgttttccaacaaaatatccgaccttgggctttgcatctatgtaattcagaatgcccaatttggataagtcggtccgaatggtcgccttgctgagattaagcatttccgcaatctgatccccggtaatcggagcatgcttttgtacgatgtttaaaatttctacttgtcttgccgtaaggtcgatgatgaacgtccctccttttttctttcgatctgatattgaatataatacgtcatatataacaataaatcaaccttaaaaaccatataaaacatcatatatataaaactaaagtgtttattcatgtcttttcatcatttaaaacacttattacacacaaaaaacgggtacttacaccctgctctttcgagtaaggcgaagtacccgctaccttattcgtatcttaaagcatcaatcggacgtagcttcgacgccttccgcgccggatatactccgaacaacaccccgactgccatacagctcagaaaagagtacagcacgggctctatcgaatacacaatcggcatttggacgaatttctcgagcagctttgcacctccgagacccaccattacgccgaccagtccacccatcagactgagaaaaacagcctcagccacaaactgcaacataatatcactgcgctgcgcaccaatcgctttgcgaatcccgatctcccttgtgcgttccgtaacggacaccagcataatattcataatgccgacaccaccaacgccaagcgcaattgcagctacaccggccagcaacatattcataatccgatcaaccccggacactgtttttaagatttccgtctgggtcataatctgaaaatcatcaccctctgatggctttagctcatgtctgacacgtagcacctgccgaatttcagcacttgcctgactaatcttctcctctgttgttgcggaggcgttcacctgctgaatactcatattgcctagccgttccatccccgttgtaatcggtacatatacctgctgaccactgttactcatattggaattggaatttgccagcacaccaaccaccttaaaaggaagctgtttgatcatgatcgtctcaccgaccgctctggaagcatccggaccaaaaatattacgggccgcatcactcccaagcacagccacattcattcgtttatccacttcatagtgggtaaaggacctaccttgagctagcgacagctttctcacatgaacaaatgccagcgaagtcccctcaatttgcccgctgaccttattgcgactccatgtaatatctgcattggtcatcgcacttggcgccacctcggctactgctttttgctgctctagcgcctcgatatcttccagagatattccttttgtctgattaaacgacatggaacttgatccatcatatggagcataaggataaatcatcagcagattatttcccatactgttgatctgagatgtaatcgtagccgttgatcctttaccgatggctacaatcataatcacagcggccactccgataataatacccaccatggtcagcaaagatcgcagcatattggttcgcaaactgttgagcgacacacggataatttccttaaacttcatgccttcacttcctctgccgccattcttcgtttcccaacaggctgatcctcttcaatccgcccatctcgaaaatgaatcagacgcttggcgtattccgcaacctcctgatcatgagtaaccaatacaaccgttttcccctgatcattcagacgctgaaaaatccccatgatttcaacacttgttttggagtccaatgcgcctgtcggttcatccgccaagagaataaccggattgttcacaagtgcacgcgcaatggatacccgctgctgctgaccgcctgacaattcgttcggcctattgttcatccgatcgcctagacctacgctagtgagggcttccattgcccgtaaacgacgctccttggcagaaatacccgcatagatcataggcagttccacattctccaaagccgttgctcgcgggagcaaatgaaatttttgaaatacaaatccgattttctgattacgtataatagccagttcatcctcgcgggcatctaatatcgaatagccatccaaataaaattgtcccgatgtaggtaaatccagacagccgatgacattcatcatcgtggacttgcctgatccagacggtcccatgatcgcaacaaaatcaccgtcagcaatatcaagttgtacctcacgcagggcatgaatttcctgatctccgacctggtacacttttttcaaatcctcaatctgaatgacgtatctcatacccgtttaaaagcctccctgcatgccgcccatagcggaaggatccggcggaggttcaggagcaggcacaataagcgtgtcaccctcctttacacctgacttgagctcgactcgatctggcgtgtaaaatccaagttctacgggcttgaatgtgcgcgcccctggattcgcagcattattggcggcaacatacacgccatcctgtcccccttcggatctcagcgcagtcgcaggtacgaacagtacatttttgtgtactcccaaaataacggccacattcataatcatgcccgttttgagcttgcctttcgggtcatggacagacagttccatcagatacgtcgtcatcccttcatccgtagaggcttccggtgagacgaattgcaccttccctggaaaagattcacccggataggcattggtagtcaacacggctgaaagacccttctttactttgacaatgtcggtctgacttacctttacaactaccttaagatcattggaatccgagttattcatgacaatgaatggagcggtcggactagtccccacatccccgttcaccttcaagatcactccgtcccaaggtgctgtgacctgaagcttgttcaattcatttttcttctgctccagttccgtcgcctgtcttcgaacctctatccgtgaggcttgaatattggatgcatcagcaggaacctgaattttgcgaagctctgccattgccgtacgatatccgatttcagcttctgaaatggtgcgacgtttttgcgacatgattttgcggaactgcagatccagaccatcatagtccgtctgtgctttatccagtgcttgctctgcctgctccaattcactgttggacaccgccccggcatcatgtaaaaacttttggtcttcatatgcctttcgcgcctgttccaacagcttttgggaagttttcttctgactttcggcttcttccaattcaaatgattcttgcgctgtatcgatagccattttggcccgaagtacatttgtcttctgaatttcaatatcctctgccttcggacctttttctaattcagccagcttggctttggatatttccaaagtatcagacgcagtctgaatttgcattttaatttctgaactgtccagaagagccagcacctgtccttttttcaccttgtccccggctttcacatttaccgctgccagcttgttatcacctgcactcgtgaagtttaacttcacttccttggatgcttgcacagtgccggacgtgtccagcttctcactcacatcgccgcgctctactttaagcgtctcatcctgaactaaaggtgcctcctgctccttgggcagattcagatatactgccgctccgcctccacctacaaccagtagaacaattgcagtccatatccacttttttctccgttttttccgcaacttgattaaagcatcatttaaaaccgtttctgccaacgccgtttcctccctatgtgctccatggcttgttcaacgtatactcattttgatccaactcgatcgccagctcttccatttgccgttcaatctggttcacttttagctgattatttttcaactccgtctcgataattagacctctggcccactttttgcgtgataactccaaggcctcttttgccgtacgcaagctttcttccagttgtacgtatttcttttggttttccttaaccgtggcatacaaattgcggagtgattcagcaaaatccttttgacctttggcgagctcctctttggctgtatcgacatccattttagctagatcgtaagcacctgcgccgctgttaaaatcgaagtatctcacattgagctccgaagttttgatactatcctccagcttccataaattcggattcatgtctgtcagctgttgtatatgtaattcgatatccagttttttgggttccttgtacacgggtcgatccaccatttcataagctgttccattaggctgtcccataaggaagttcagagcatctctggatttttgcaacgcaattttcccctgctctactgtttgctgagcctggcttctggcctgtgtactctcgtttttcgtatactcagacagcttgccgcgcgcaaatttagcaagtgcaatcttttcctccgcttgagcaatttcaagcgcttccagatcatttttcacctggttttctgctacaaacacactttggtagcttttcatcacattaaaataaatctggtctttggcgaactgcgcctgctttttgctggctagataagatagcgtcgaagagttataacttctccaagaggtattatcatcaacatattcgccgtctataaaatcaacaaatgcattccccagatccttttctgcattttttagttccattctgcgacgctctacgtcccgttcggcggtacgcgtattgtaactgttcgtctgtgcccattccgcggcctgcttgagtgtcaatgtaggtaaagcctgacccgttacggatgatgtcttcgatgtagccccagcggatggactaactgacgtacttgatgctacatttcctgataaactctcagcctgtacagtggaggccaagcctgatgataaggacaatacaagcagcacggcagccgctttttgcttcatagatgaatctctcccctttcgtgcgttcttcgaatcatttccattcttttcgacataaatttccacgaactctttgcattctaattgtactttcaggtttatgttggtacaaggtgtcaaaacaatacatttttgtaacctttacttcctgattactcgctttatactacttttcgtccaataagacattgattcaagctatttttacctgaactttacctaattttcagctaattttaaggaaaccaacagcatctattaaggtttggaacatatactagagaaagaataacagccgctcactgggagggttaatagatgataaaagaatctcgcatgacaaccactaacgaaccgtctgatttgtggatgacccgctttttacgtgaatcagaacaaaaaaagaaacaactaatccgggaagcccggaaaaataacgatataccactgatgaacagcatttcttttcaccttgcccaacgggatcagcagcatcttatcggataaaatgacaagtgaatcttatgctataaataacagattacctctagttatctgcttcgtatgctagataaaaaaatccgggacaaatcgataattgatttggcccggatttttgtgataatcaaatctattataaaaccgcatagcttgttccgttcctattcttccatctccgcttgcggatcatagagatattgatctagtggaatacgcccgctttcattaaaacgtatgccttcctcctccaaatacagacgctgcagggatgcggactcatcctcctgcaaagcaatctcccccaagcggttgactactctatgccaaggaagtcggtgtttttggctcaatgtatgcaaaattcgcaccacctgcctggcacctcttgggcttccggcctctgccgcaatttgaccgtaagtcattacttttccctcagggatcaaccgtataatttgaagcacacgggcagtgaaaggctgcatgttctaattcctccgtattactattgctttttcaataattatagcaccttgaacagaggctaaaaacccctgctcctacgaatgcaagaagcaggggaaaacccatcatttaaatttagaatccgctcagaccctgcctttttaaatcctgtgctaccaatctggccagttcccttgcaccttcatagtttggatggagtgtatcgccattcatatacaaggccagtgtagcgtctttaccaatagaagtgaaataagctgagctaagaacattcagatcgactaaaggtgtttgttcctcttgagccagcgccaaaatagcgcttctataccatctattttctgcgttgtgtacatggttagcattaaagtcagtggctcgtccttgcggagttgacaggattaccgtcgcccccttggccttaacctgccggatcatatcccgcatccagtccttaaactccgcttcgctttcgttatgctttggattggtgtcattaatgcccaattggagaataaaataatcccccggcttgatatattggacgatggcctccaactgaccgtcctggtggaagcctctagcaatttggcctcctgacgccatattgcgaatttgaaaagtattcgtgttcacaaactctggcagcagttgaccccatcccgcctgcacgctactatctagcggataatagttacaaaccgtagaatctccaccgatataaatcgttcgattcgtaaccggattgctagataattgcttgatttccaatgcactgagtgtgaagaccgcgccctctttgccttcagtaaccagcagatttatctgtccgtctgtcactggaatttgaaagcgatccttggccccattccctgtcatattaatgacctgatataccccttcagccgcaatactcgaacgagaggtatctcctaaagtaaccgacacctcatacaaaccaggaggaagatcaacgtcaaaagtattctcgcttttcgtacctgtagccaggaaccgtaccgcatcgcttgccactccagtccccgaagcactgacattacgcatattctcaggggtacgaaagccatagccacgtgctgagtcataggacagcgaagcgctcactccagtataacccgtttcgaccgtacctccaccaaaatcaaaattgtactcgccagcggatgcatgtgccagggtagctatgcccacacctggtgcaccacataaaaaagctgctaaaagcataccagtcaatccttttttccacttcattcttcattcctcctccaaatttttaattgtatgaagcaaaggatatttcgttttttgtaagcgcatacataaaattctatccattgttgcagggttttgcctatgtaattcttatgcaaaagaaaagtagtttattcgttaagctgaaacttctacttgtacacaaaaaagcttcgcatttacaactgcgaagcttgaagcatatttcgtcatatcaaattactacattaatctgcaaccagaattccgtcaaagctctctggacctactcgtactgtacccagcaggttagcagaaacaaaagctgtataaaccaattgtggtgtaatcggcgggttaaagtcatcggctgagaacgcaataacctgtggagctaataaactcaaactgaaagtagacgtagccgaataaacaacagggtcagtgactagggtacctcttacaatagtgatcgttatcccgactaaagcaagcggaagttgaagcgatatggttcctttaagcagaacccgtggcgtacctgtagctccctgtgtgtttaatccgatctgcccgaacaattgaggtgtatttaaaagagtgatcggaatggcaatagagttggctgtcgaagcattttgggatgttcttccatcaataaatgttcccatggtttcccctcctctctctagcagatactcatagactatgaaaaagtttgttttgtgcttggactgaataacttgtaaaacacacaacttctgatgaataggctaatatacagccctttctctggccctgtgaatacactaaaccaacactgggaaaggagggatgtcatgtctaataagtttagagccaccttaaggggggctaatgaagtgcctcctgtcagaacaaatgcgacaggaacagccgaatttcgttaccgtccaacgagccaacaattaagctttgaactgactgtacgcaatatctcacgggtaaccgaagcgcatattcatctgggacgaagaggtgaaaatggccctgttgttgctacactgtttggtccttcgaagtttgggataaccgttagaagaggcgtcgttagcggcgtgcttcgtgcatgtgatcttaccggtccactcagaggcagaaccatttatgatttggtgtgccaaattagagagggcaatgcctacgtcaatgtccacacgatccgtcatccgaacggtgccatccgtggacagattagacgcgcacctatcaaacgttgcaaataacgaatgaacatgagtataaaaaagaacttccatgccactcattttgaggctatggaagttcttttttattcaggattttgcaaaattcgattccagtcgctccaaagtgcaatatatagacgaaccaaaccatttcgatctatatcttgttcattggaagtcgcttgtgggatttttgtaaaatcctcaattcttaacaaaagttaagaagttcataagcgtttcttaagccgttccctttcaggttgttaagaactttatcttttaatagaaagagttcaacaagatacagttcactcctgaaaggaaatgaagcttatgaagcctaaaaccaaagaaaaaattcccgaattgcagttggtcagagccatggcgattttagccgtcttgatggtacatgccacttcttatgcaacggttcagcttacaaattccagcctatatgttgtatacaatgccctcaatgtgttgatgaagtatggaacccccgtatttatcgcgcttagcagcatggtgctgttctacaactacaaggatcgtccgatgggacgacagctcttaagccgcttttataagcagagattgctgtacatcctcttaccttatgtcatgttctctctgttttatttcactctgtcccttatggctggcagctccgaaccatggaatatagccacacttgcgaagagctttgctctgaaactggccacaggcaaagcttatactcatttatattatatttttatcatgatgcaattctatctcgcatttccattcgtactgtggctgttccagcgttgtcggcaacttccacaatggtctattgtccttgggctgttggtacagtggtcattttttattggaaataaatttctatttcaggttcaaaataagggcagttgggcactgtcttatatagcctgctacatgctgggtgctgctctcggttactactacccacagctgagaacgtggtttttgatgcgtaagggggaacgaagtgttgccggcgtgctgacatggatcgcaatttggggtttatggctgatttcagccaccatgcatgtctatatgtggtacgaaaatagaatgtacggaatctcgtacaactcactagtttttgaacttatgtataatatgtacagcctgtctagcacgctggtaatactacagatttcctttttaatgtttagacgacaacattcctttgtcactcgcaaactggaacgtctgggcacactgtcgtttggtgtgtatctgattcatccgttcttcctgctcctgtatcggcagttttcaccacatatcgcttctccgcagcttattcatgcgtggtatgccggaggttttttctttgcacttctttgctcttggctcgtcgtgtcgatcatctctcgtttcctgccatttgcttggatcttgttcggtcaactaccgggaatagaaaaaagacaattcaagcaagaaaaccgcatttcttcaactgaaacagccctatccaaaggctgacgaccccaagcaagcgaactgagatgagtgtccatagcctccatctttaaaaaggtatataatacgcccatattgtttactgctagaaagaacagaaagggtgcgcaaccatgcataacggaaccattttattagtagacgatgaacctgaaattattaagctgatgcaaatttatttggaaaatgaaggatatcgactgctcatggcacgggacggactggaagcgctggagcaagtcagtcgggaatcgatagatgtgatggtgcttgatgtgatgatgcccaatatggacggggttgaagcttgcatgaagatcagggaaaccgagcattttccgattattatgttgtctgcgaagggacaagatatggacaaaatcacaggacttagcgttggagccgatgattatgtcactaagccgttcagcccgttggagctggtggcacgcatcaaatcccagctgcgcagagtacggaaatatacccactcttcccctgcattggagcatgaaataatactggatgaactctccattaattctgctacgcatgagatcactctcgccggagaatccattaagctgaccccgcgcgaatttgccattgtcgagctgttggcccgtaatcgtggtcaagtactgagcatggagcagatctatgaaaaagtgtggaaagagcaatatctggaatccaacaacacgctgatggttcatgtgcgtaaaattcgcgagaaaattgagactgatccgagaaaacccaaatacctgaaaacagtgtggggcatcggctacaaaatggaaaaattcgattaatggaggatttacgtcttgaaggcaaaacgatatgacacgttgggatggaagctggcagcccttagccttgccgctttcgctctaaccggactgattttgatggtgttttattatggagcatccttgctgctatggctgaacccttcccgttcattttttggcacccgtctggttcgctggaccgtaaatcacattgggtccccactgatcatgctggtgggcgggctacctacatatatttatttctttttcctttttaccaataatacgattggctaccttcgcgaaattacgacggggatgcaggagtttgctgatggagatctgtcctatacgattcctgtttcttcagcggacgagctgggtaccttggcgaaaaatatgaacaccatggcggacaagctccgtctctcactggaagaagaacgggcttccgccaaagccaaaaacgacctgatcaccggcgtatctcatgatcttcgcaccccgctaacatccgtgatcggttttttggaatatattgaaaccgaccgctatcgggatgaaattgagctgcgctattatgtgaacattgcttatgaaaagtcattgacgcttaaaaagctgatcgacgagctgtttgaatacacgcgtgtgagcggtggcagtctgccactggagctggagcctgtagatctcggcaaattgctcactcagcttgctgaggaatttgtaccctcgctggaacaggcggacatgtcctaccgtgtccgaatcgtcgagcctgttcgaattctagccgatactgacgagctggtacgcctgtatgaaaatttgttttctaacgctattcgatacggaaaagacggcaaacgcctcgatatcaccataggacgcgaagacgacgaggcggtggtaatctgtaccaactacggccccccaattcctgcggaagatgtcccgcacttgtttgagcggttttaccgggtggacaaatcacgctccaaggaaactggaggcaccgggctaggccttgcgattacaaaaagtattactgagctgcacgatggccacatttcggttagaagcaatcgcagacaaacagattttgaaacccgttttcccctctatcatgctcgttaggcggtctccacgctagcccactaacaacgtatagacgatgccgggtccatgcacgccaatcgtcaaatcattttcaatatccgacgagcggctcggtccagtaataaaatgaatgcctgcgggcagctgctcacgcccgatttcgtcaaagcgacttagaatctcgcccagtcgtgttcgcaagcgctctacgggcagaagaataatcagtgcggttggcaaaaggctgaccgcacggcctttctctggcgaggatagcaccgctaccgaaccggtgtaagcagccgcttcgtcggcgatgacgatgccaatatccgcctcggcggcgcgggccttccaatcctcgactggatcggtgttccacaccgataaacggacttccggcagcaccgattccagctggagcgcatccaggtccggctcattctgccggacgatataggccgctcccagctctcgcgctttgtgcgcgatccagtctgcggtctgctccaaatccggcagacgcacgacatgcccgccaacacttgtaaagttggcggtgaactcctcgatgcgccgctccgcgctccattcgaattcgtgccaaaatgcaggtgccccgcgaaacggctgaactggcggctccgtttgtcgtggacgcttgagccgcgccgcgatgccgtccataaagcgtacttgcttagcacgcgattctgcttccatttgctgaagccacgcttcatgggccgcttttgcttgcgcagaaggattactctgttccctcatgctgcgtccctcctttacttctatctgccaaaatcttctccattcggctgagaacatccggctgcatcacgttgcgttcctgctccagtttatgctccaacgtgttccattgctgacgaaaggattttttcgccagagagggagctacgcggtacgtattccatccctttagcgggcccagcttaagggtaatttcgcccttacggacgaccgctttctgtgcaatctgccctagccgaatcgccgctgcgaatcgcttcgagctggaaaccactgtcgcaaaacctttcattcctgccgtttccagcttatctccttgtcccgcctccaccttacgtctacgcaaatataccagcatatcatgcagcggtattttgaccggacaggcttcataacacgcaccacacagactggacgcactcgcaatatcgttccactcttcaatgttgccatgaagggcaggcgtaagcactgcaccgatagggccactatatgtcccaccatacgcgtgtccgccaatgtgtcggtacaccggacaggcattcaggcaagccccgcagcgaatgcaattcaacagctcttgaaactcgggattgcctagctgtagtgaacgtccgttatctacgatgataatgtgcatttcgtcaggcccatcggcatcctggctgcgccgggggcctgaaataccagacatgtacatggtcagcttctgtccggtagcagatcgtggcagtaatgtagccatcacctccaaatccgtccaggatggaataatccgttccatgcccatcaatgtaatttgcgttttgggcaaagtggataccattcgtgcgttgccttcattttcaaacaggaccatggagcctgtctcggcgatggcaaaattacacccggtcatgccaatatccgcttccagaaacttttcgcgtagctttttgcggacaaagcctgccaaaatcgtcgtatccgcggacagtttctcccctgcttctttggataacagttcggcaatctgatagcggtttttgtgaatcgccggaatgacgatatgagacgggggctctcctgccagttgaataatatattcaccgaggtcactttcaatcgtctcgatatccgcaccctccagcgcctgattcaaatgtaactcctccgacaccattgacttggatttgacgacggaacgagcttggctatgcgcagcaatatccagtgtaatacgtacggcatcggctgctgtgtcggcaaaatggatatgcaccccgttggcgcgggcattttctacaaatagatttaagtaatagtccagatgggcaatagtatgaagacgaatttggcgcccgcgttcacgccattcctcccaatttccgtgctgctctgaggccacccgcttaccgttgcgcagccgctctgtagtgaaacgaactgcattccgcagaaaatcatcattgagagccagctctgcgcgtttcttaaccttttggttcatggaatgtgagtgtacggcggtcatgcgtgcttcaccccttcgtacagcagctcagccagatgcatgacccgaactggctcctcccgataccggagatttccggcaatgttcatcaagcaggccatatctagtccgaccagtacctcggcttcggtctccctgatgtggtccactttttcagtcaccatcgctcccgaaatatccggcattttcaccgcgaaagtcccgccaaagccacaacagtcctcagcaaagggaagtggtactaattgcagcccctttacactgccaagcagcttcatcggttcctccttcaagccgagtaaacgtgtgccatggcaagacggatggtaggttaccgtatgcggaaaagacgcgcccacatcggtcacgccaagcacttgcaccataaattgcgtaaactcgtacgtcttttgctccagcctccgtgccgaatcgagccattcgggctcatccttaaacaactccgggtaatgatgaatcatatatgtgcaggaaccggagggggatacgacaaaatcgctgtcgttaaacgctttcaaaatcgttttggccgcagccctcgtttcatcccaatacccgctgttataggacggctgtccgcagcatgtctgcaccttcggaaaatccagctggacaccatatctggcaagcaagcgtgccatcgcttcccccaccttgggataaatcgcatcactcaggcaggtaataaataaagataccttcatacggaacaccccttccgtctatggaattgctattactttataactgaaaagttacctttggtgccactgcgcagtcggatgttgcttcccatcgctgttgcccccagattttttactcaatgctaaaaatccggggaagtgataatttagaagcttgcagcgggattctcacttataccttttttacatcatcaaagaatccccctgcaacagcgatcgtaagattaaatgaaacgcaaagcggccttcaccttggaaactccccgctttatacaaccgtaactggaatcgccagctccgccagttgactgcgaatcggatccgacaaccgtgaatctgtaatgatctcggacacttgcgacaggttcacgacatgcgtaaacgcctgttgcccaaatttgctcgcatccgccagtaaaatcacacggtctgcaatgctgaccattttctgtttcaaacgagcttgcagttcattcgattcgctaataccgcgatccagatgaaccccttggctggagaaaaacaatttatccacataataggtttctagtgaacgctctgcgagcgggcctacatatgacaacgagcgttgaagcaactgcccccccgtcgaaatgacctcgattttttccttacccgccagctctgtagctacccgaatcgaatttgttaatattgtcaaaggaatatccggtaagctggacgccatataccaggcggttgtgctagcatccagcaaaatacgatcattcggctgaatctgcttgactgcttcttcggcaatcctacgcttttcctctgcgttcataatttcccgtaccgcatagggcgtttcaggttgctcgtttttgacactgaccgctcccccatgcgaacggcgcagtcgtcccgcctgctccaggcggtccagatcacggcggatcgtttcctccgttactttgcacaactcactcaattcggacacccgtatgctccctttttcattaacgagctgcacaatcatctcatatctttctgcgaccagcatggcaatctcactccacatctttaatgtacaaaaagtcccgccactcgccggaattgcccgtaggcatcctcccacgcttctgactcggcaggttcatattcctccacggaaatagaatctgcgatgacccggcgtgcttcccatatatcggcgaactttccctgtgtcatccattgtaccgcaagattgccgattgcgctcgcttctgcgggtccagcccacacgggtttttgaattgaattggccgtccattggcacagcaagcgattttgaatccctcctccgaccatatgcaaaccattaaaccgttgtcctgacacccgttccgtaagctccaaaatgtaacgatactttaacgccagactctccaaaatacagcgcgtaatctctcccggcgtctccggcaacggctgcccagtgttgcggcaatattgacggatacgtgttttcatatccccggcgtgcagaaacagtttatcgtccggatcaatcaaagaagtgaatgctggagcctgttctgccttatgaaccagttcagggaaggaataggagcttccctgccgctcccactctctacgcgcctcctgtaaaatccacaatcccatgatatttttaagcagtctgtaagttcgacccaccccaccttcgttcgtaaaattaaaacgaagcgtatcgtcattgattacaggctgtgctgtttccgttcccatcagggaccatgttccgcagcttaagtacgcaaacgagcgctccagcgcaggtacggcagccacagcagatcctgtatcgtgctctgctactgcaatcacaggaatcgctccaatgcccagatcggtcatgaccgacgagcggatcgttcctacaacatttcctggttctaggacctcaccaaaccaggaacgggggatatcgattccagacaaaagctcttcatcccatttttgctgcaacggattatataattgcgtgctggtcgcattcgaaaactcattgtacatttcacctgtcagaaaataccgcagcagatctggaatcatcaagaaatgctttgcctgctccagcaacggtgaactggcatttcgcatagcagccagctgataaatcgtgttaaacgtcaaaaattgaatgcctgtacgctgaaaaatggactctttccctagccgtccctgtatttcttccatcaccccctgggtgtgccaatcccgataatgataagggttgcctagcagttctccggtttccccaatcaatccaaaatcgaccgcccaagagtcaatcgcaagactggacggattcactcccatatgtctggctttgagcaaaccttgctgaacctcgtgatacagacgcaacagatcccagtgcagacgttccccaactttgaccggatcattcgaaaagcgatggatttcctccaccacgatacgtgaatctgtcaattctccgagtagaaccctgccactgcttgcccccaaatcataagcgaggatactcaccagcttgcaccacccttgcctctttgtaaaatctgcgtgccataattagatgccaagtaggctttcatcgggtctgtaggtaatccctgctcttcacggatcgctctgagcaatggtgccacatcaaactcaaacgcctggcgtacagcatcctctgcacccagcacatcctggcggtttgctgcatcttccacctctgcatgattaatcaagagtgcctttgcatattgagtctgcacattcaacacggagcgaatcatggccgggattttggattcaatattgtgcgactgatcaatcaagtatgcgattttgtccacggtttggcggatatcagcttctatatcctgagcggcatttaaaatttgaaaaaagatcaaaaataactcatacggattggtagaacctacaatcagatcatcatctgcatatttatagctattaaaatggaacccacctagtcgctgctcatcaattagaaacgcgacaatatgctccacgttggctcccggcagatgatgccctgtatccaccagcacctgtgcctgcggccccagcttggttgcgtaattgtacgccatgccccaatcggcaatatccgtatgataaaaggctggctcgaacgccttgtattcaatcagcatgcgcatgtcaggtgtgagcgccttatacatttcactgagcgcttccagcatccaatttttccgtttgcgaatatccccctgaccgggataattcgttccgtctgcgaaccataagctaaaatcgttagagcccgtttccttcgcaatatccacgcattccagcaaatggttgatggccttacggcggatggccgggtctacattggtgacactgccgagcatgtagtcctcatcttgaaacaaattgggattcacggccccaatctgcaaaccgaggctttcggcatgaccgcgaagcttgccgtaattgtccactgtatcccacggaatgtggatcgcaacggatggacataagcctgtcacagcatgaacctgcgcggcatcctccaacttttcgaacggatcacgcgggacgcctgttttctgaaagactttaaaccgtgtacctgagtcgccatatccccaggatggtgtttctatgctaagcgctttcagctttgcctttacttgctccaggtcaatgccccgttgttgctgttgctcctcgaataaggcgtacgctttgtcactcatcgtggttcctccttggaaaataaagtgagttacggggggaggccgcttcgcgtgcggattgttcttccgatcgctccgctgctgaccacccataaagtcacttctatttttaaagtgttagtgtgtatataaaggatgagaacacgtaaatacgttacattgcttatttacgtgttttccaaagtgttttacaacccttcgaaactatcgtcatgtggcttacataggttcattttaattcggctagcgtgtaaaggctgcggggacgccaccgtcgatggtcagcatacagcctgtcgttttctctgccttggatgaggcgaaaaaggcaatgccctcagcgatatcctgcggataaatgttgaccaacagcgtcgtccgtttgcggtaatgctcctccagctggtcgggctcgatgccgtaggcggcagcgcgctcgttgcgccaattggagttccaaattgccgagccttgcagaatggcatccggcaaaatagtgttcacacggatgccatattcaccgccttctgcggcaatacaacgggctaaatgtgcttccagcgccttgaccgagctataggccgttacatttttacctgcgtagaccgagtttttggaaccgacgaacaccatgctaccgccaagtgtctgctccttcatgagcttgaacgcttctcgtgcaaccagaaaataacccgttcccagcacattcacatttaaattccattcctttaacgatgtttcatcgaacggactggatgtagcaaggcctgcattgttgacaatgatatctacaccgccataggtcaatgccgtttctgcataggcagcctgaatctgctcctcctgcgtcacatccatttttacggcgatggcacggttttctccgtagctgctatttatctctgcggctaccttttgcgcgccttccagattcagatctgccagtacgacatgtgcaccttcatccaccaagcgacgtacggttgcactgccaatcccgcctgcaccgcctgtaatgaacgcaattttacgggaaaattcagcttctgctggtgcgagtgacagcttataaagctccagcggccagtattccacgttgtatgactcgttctcgctgagtgaaacaaactctcctaacgccgttgctcctcgcatgacagcaatagcacgatgatacaaggcgccgcttacctgcgcgttgctccagctttttcctgtgttgatcataccaatacccggaatcaaaattacacgtggcgcagcctcaaacataacatctccctcatgccgattgcgctcgaaataagcttgatactgttccttataggccgctataccctcagcgagcttaactttcaagccctctacgtcctccacattcggtgtccaatctacatagagtggcttcatcttggtatgaaccagatgatccgggcatgctgccccaacctgagataaaacagcagaatctcggccgttcacaaactccaacacatcctccgcgtcatcaaaggtgaggatcatctttttctcatcactgactgcaccccggacggatggcataacttgggaagcaatgcttcggcgctcttcataagtaagcgctttatattttacgcctccaaacgcctgcttttcctcttgacgagctttaatatagctttctgcttcttgaatgatttggattgttttcgcataagccgcttcggatgtgtctccccacgtaaccagaccatgcttttccatcaataccaattcagcttgtggatgatcgattacaccttgggcaatcattttcgacagcttaaagccaggacggatataaggcacccatacaaaacggtcaccgaagatttccttagccatttccttaccgttgtgcgcacaacacaagctaataatcgcgtctgggtgtgtatgatcgacatgtgtaaaaggcagaaaagcatgcaatagcgtctcaattgaagcccgtggatgcttggcatctatcatacagttcgccaaatatgcgaccatatcctcgtcagacatatcttccctttcaaataaaggacgaatatcctccatacgaagcccggtgaagttatgcgctttcattgttgcgagatcggaaccgctgcccttaacgtacatcacttctacttcacgcccacgaaaatcttgtatcatcgttttggccgaagtgttaccgcctccccagttgcacacactcctatctgtgccaatcaggttagaacggtatacgagctcttccagcgtgcttttctgctcagatgcttgtgaagaaatccacagactttgtaccataggaaaaagacctccaagttcagttttagttttgaaaggctttattacagtggtttttctttgtttatggagactataacacttttgttttaatttgaaaatgagtaatacaaaaataatcaaaaataaattttaatttttatccatctaaaaaaatggatatattcatttggtaaacgatcatggccacgcacaaaataaaggccatgtcagaatcggttataagaacctttctggcacggcctcattcgtttaactcatctaattacccaactatacgcatcactttggctagcagctcgtacgagcgcaggcgcgcctgatggtcatatacctgagaggttgtaatcaactcattggctctcgtctggtcgattatcaaatccatcttttgcttgacggtgtcaggactgccgatggctgaataccccagcatattaccacgaaccatctccttctcgtgctcactccatagcttttccatgtcatccactggtggcttcagtcctccgctgtgcccgcgcagcacatttagaaactgctgttcttgtgaagtaaagagccattttgcttcctcatcagaatctgcaacaagcacattaacaccgaccatcacatatggcttatccagtgctttggatggccgaaaattgcgatggtacaactccagagcctgaagcaaatgagccggggcaaagtggctggcgaacgcgaacggcagcccaagctgacctgccagctgtgcgctgaatccgcttgatcccagtaaccagatgggaatgtccagcccttctccaggaatcgcccttactcccggaacggctccgttcagtgctggattcaggtaagaacgcagctcattcaattgctcggggaaatcttccccagtactgtgaagtcctctccgcagtgccctcatcgcaggttgatccgtgcctggagcccggccaagtcccagatcaattcgtcccggatagagcgactctaaagttccaaactgctctgcaatcatgagtggagcatggttagccagcataataccgcctgaaccgacccgaatcttgtttgtatgtgcagctacatgcccgatgatcacggacgtagccgcactggcaaccgcctgcatattatgatgctccgttagccagtaccgatggtacccccattgttcagcatgctgggcaagatccaccgtgtcgcggaaggaatcggtaggagtgccgccttcaaggacaggtgcaagatctaatatagatagtgcaacgttacgcgtagtcattatatataaaccccctggcaaaatattattttacgaattttcctcaacgccttaattatttgacctatcaattgatacgtcaattatgataatgtgtcccgttataaattgcaaatgatttaaatttttagttttgttcaaaaacagtttacttttacgagaagctcgtctatcatgcatttatatggataatcattatctacattagcctggttataaagatcgaggtgattgctagtgcatatgaaaacaggtgtcgaacaatctgtctacgctcttcttctactcacgatgctgccggacaaagctgttttacctggtgaggccattagccagcagttaggtgcttcgcctacttattttcataaactgttacgtaaattggttagcgccgatttgattacttctgtacctggtgtcaagggcgggttcaaattaaagaaaaaacctgaggatatacgggtatttgatatttatctggcgattgaaggacaacagactctctattcttccagcggtatctacaacgatatgcttgaattaaagaaagacgatcagtgttgtttactggcaaatttgatggaagaagcggaagcctcctggaaagccgttctgaaaagagaaaccatcgcatcactatccgctgacttttttaaagaaggatatgatgacaaaatgacttctttggagaactggattcaggaaaaaatggtcttgtaaagaactctaatgaacagaaaggaatatgaacatgaacgattatttagtaaaagctcttgcctacaataaccaggtacgggcttatgccgtgagaacaacggaaacggtaagtgaagcccaacggcgtcattatacctggcccacagcatcggctgcattgggacgttctatgacggtcggcgtcatgctgggagccatgcttaaagatgaggataaactgacgatcaggattaatggcggcggacctatcggcactattcttgtcgataccaactccaaaggtgaagttagaggttatgtaaaaaatccacaaacccattttgagcttaatcagatagggaaattagatgtcgccagagctgtaggaacagatggagcgctaattgtatctaaagatatcggcttaaaacacccatttgttggacaagtccctctcgtttcgggtgaactgggggaggatttcacatcttatctcgtccaatccgaacaaattccttcttctgtaggagcgggagttattgttaacccggataactctattcaggcggctggaggttttattattcagctgatgccagatacgcaggaggaggttatcagttttatcgagagacgcattgagagcattccaagcatctccgcaatggtcatggaaggtcttatgccagagcagattctgggtcagattttgggagaaagcaacctgaacatactggaaaccatgcctgtgcaatttcattgtccctgctcagaagagcgcgttaccaatgccattatcagcttagggaataaggaaatagaagatatgatccataccgatgggcaggctgaagctcattgccacttttgtaacgcacactaccatcttaccaaagaagatctcgaagacatgctggaaacaaacatcatttaaatatgggctgttcccaaaaagttggtttagctactggggaacagcttttttctttcccaatgcttccgatgatttcttaatcctaaacacggtagacttgttcatgatgtaagtgataatgttatattattccaatcacttgaaatgaggtgcgctatgctcgaaaaagatacgcaggaaattttaagacgaagattgtgctggaggtcttgcaggaagagcagaccgtgaacgagattgccgccaaatatgaaatgagtccgtgatgattagctggtggaaagccgagtttctgagccgggcgtctatggtgttcgagaaagggacgagtgaagcggacaagatgagaaaggaatacgaaagcaaacaggagcgcctagaaaagctggtcggtcaacttaccgttgaagtccactggctcaatgggagcattacacatcttccggcaatccgcagttcattaatgaatttcggcattaacggaatgatcagcccgatgccggtgaacaccggaaacagattcagcataaggacacatcatatccccctcataatttaagggttactgctccctctgtaattctaagcaaaaaaacacctgctcttcggcagatgttcctcgcctttcgtatttcttgagaatatccgatccatttgtccgttctaatcgttcaaccctttgccctccagaatgggctgtgtgtatgtttcaacccttgaaacgcgcgttttgaactgcttcggttgtggtacactctccaatccagcgcttagtttatcgtcaagcatgaacgtgcgagcagcggagagattgttgttccttttcataattgatatatctacaactcagtgcatgtagcgcgtttattgctgctcggcaaatctccaccaggcaaatgttccgactattccggctattcccgtagacgcaagaatgattatactactcaactttaaaaacccggtgctttgaaataccgacgggatggtccacggaaaatagggggcgaatccaaaagaggccaaaacatttgagagaatgacgattatcaggatgagtcctaatggtgccaagtatcccttgctcacattggccagaagagtgcctggtgtggtaacaataataaacaatagcgatgttataatgaatttaaagaagatattccaaataaaagaagctaacccgcccgcaactcctagaataccccccacagcaaaacctatggcaaacatatacatggaaagtaataggctccatgctaaaattacaagaaatttggacagtacaattttcgatctggaaacgggctttgcaagcaaatctttaattgttttatccgaaaactctcgtccaaatacccatgccgcgatgaaggtgtacccgataagtcccagcggggcaagactatcaagcaattcggttaaatacattctccaattgatgccgccggcgtcactggataaaataattccgactcccatcatgattggcccaaatgcaaaaataagaaataccaaccaaaacacattggcgcggataatcttgtgaatctcacaatgtaagacagaaaaaatattcattatatattcccccttgtcataccaattgtgcggagaaaatatccttccaaatcctccgtaatcactcgaagcaatgttggcggttgattggatttaaccagcagttcggccagtcgttcaggactatccgctacgtggtcatcggttagtttaatatagccgtctattatctcctcaaattcatatccatgctcttcaagcacctcctttaaggcatgtttgtcgcggccattcaccactaagtttttctgtaacgattgctccagcttatccattgcgacttctttaacaagatgaccattgtgaataatcccaatgcgtgtggaaactttcgagagttcctctaacagatggctggatataaaaacagttacaccgaaatttttcgctaggttatataacatattccgtatctccgccacgcctgcgggatcaaggccatttatcggctcatccaatattagaatttccggattgtgaatcattgctttcgcaagtcccaggcgctgtttgtttcctaaagaaagattctttgccttcttctgtttgtgcagctcaagccccaacttatagataacccgatttacggaatctttgtcaggcaccccttgcatgcgtcgtgctatgtcaagattttcaactacagttaaatcgggataaaaagtagcctcctccaaatatccaaccttgtcccataatttatagtttccggcatcgaccttttcacctaacatatagagcttgccggaggttggcttgagcatcgccaagagcatctttatggtcgttgtctttccagcgccattcagtcccaaaaatccaaatatctctcctcggctcacctccagcgaaagattgttcaatgcgatatagtcgccaaattttttgtgcactccctcaatttgtatggcgggcgttccgccatttttttcctttgataaaatactcattgccttcaactcctccataaacagagagcttattcaggattctaagtacgacactcctgaacaagctcaatcagaaattttccaataaatctactttatgatgtcctggcaatcgcttaagcgaggcgaggctggcccaagcccaattgagcagagccaattcagcactacctcatgcagcacgttgatgttgtctacctgacagtgttctaatccgccaagtcgtctatcctctatcgggtagaacgtcttgtttttcgaacccgcttgctcgtaattcttcaaggcttgtgtcagcggatttggctgaaccaatatctcttccgctccgtgcattacaagaagcggacattctatctggtggagcacgccctcaagatcataggcaaaacgcggattccccgcaaaatcctccaagctttttgcccccagaattctcatgccgtgtgcggccagactcggcggcatccatttaagcatggcatcccagtcgaaggcgtgcgtaccgccgtcggagatgacggcagcaatcctgtgatcgaacgaagcgaatcgcagcgagtcgtaagccgcaaaactctccccgtgcacgataatcttatcgggatcaacttccggccgcgttagaagaaagtcgattgctcgggaatggaaagcctcactgtccgctcgtcttccttttcccttttcgtacagcgagaggccggtcccaggctggtcatagaccagaaagttatatccacacgaaataaaagcgggacctagccagaaatagttttcaattgaccactcgtcgccaccgttgagagcaaaaagggtcggcttcggaccttttatccaggaaggggagaagaagtaaccatccaacttgacatcttcgtaatcgacttggatcttctccggttggacatcgaagtactttccggcagcttcgaagagttcatttactttcttaaatacacggattttctcggtgtcatcatccatcaccgcatattccgcaattctgtagtaattgcaggcacgaatgtagcagtttcgtgctgtataccagtttccagccgtttcggcctccttgccgtgtctttccaatgcctgagccgttatgagccattccctgtgccacgtgtccttgtcatcggggtcgatttttttgcaggcctcgtagatctcggtgacgtccgtagcaccgaggcttgccatacccaaagctttggtgacttggtatgacatcatgtagtgattgggccaacggctgaactcaattgacattgcaacatcctccttttccagttctagtgattgtagtttttttactacaagtaatttttacaacacaaagataaagcttctttaaaagaaaaataaatgtttataaagagaatataaaaaactataaaccgctgaaaaaacaaaaaaggctgctgcctgggtgttcacccccggcagcagcctttaactcctgtagtaaaagaaaatgtgcaaaaatagaatcagtgttgtgcggccaagggaaggctgaatcttatccccaaaccgccatattcggaagggtaggcgcaaattttgcccctatgatgttcaataatggatttacagcttgcaagacccagacccagcccgcccttttggatttgccgcgatttatccacagtgaaaaatttgaggaacagagaagatatatccttatccggcactccaattccattatcttcgatttgaaaaaaggcatactgtcctagcgggtatccggtcatatacactttcagtttatttttccctccatatcttacagcattgctaaagaggttgccgaaaacccgacgtatcatcggttcattgaccatcagcaatatattttccgtgaatgaatggcggcaagtaagctcgttgtcaagtcccgccaactcatactcatattcaagggcaatgttttcaaataattttgaagcttttacaggtttagctaccatagattccaactccagtttttctttggtgaaactggagaaatcattgatgagttcgaccatatatcctgacttcctttgaatcaaatcataatattcctgcttttcagtttctggtaaatccttgtgtgtagctagcagttcagtaaaaccattaatagatgtcaagggtgttttcaagtcgtgggcaattgccgcgatcatatcgatctgctctttgtgcgcgagttgaagccgatgctccatcttattgaagtgcttataaagttctccgatctcatcattacttctcagagctagcggaggcagtggatgtacaatatttacttcttcaagcctggtattcagaagctgaatgggtttctctatgcaaaaatgaatatagataatcagaataataaatatgaaacaggcaattgcaaatatgggcaggagcaatgctatatatcgcgagtccagcaatgaactgcgtataggggaatatactgcaaagacaagcttcagatacattccgatcgaaaacatgaatattataaacatcagcaggaacaaaagaggaagctttattttcagtttcatactattgctctctttccgtgtatttatatcctatgccccatattgttttaataaagtcatattcagaaccaagtttcttacggatattttttatatgaactgttacggtatttatttctccgtattcgtctccccagacgttttcatatatctgctcacgagtcaatacatgattggggtggcgcatgaggatagacagaatctgaaattccttcgttgataagtcgagcttcctgctattcagaaatgcttcaaacgtcttatcgttcaaaatgagcggagcatccgccttttcgttactgggactaagttcaccccactctttaaaaagcctgtccacttttctgaagtgagcctttatcctggagacaagctcctgaatactgaaaggtttggtcatgtaatcgtctgctcctatttcgagcccaacgattttatcaatgtccttatcacgtgcacttaaaaacagaattgggacattataagaatttcggatacttctgcagacatcaagtccatccatatcaggcatcactatatcaagaacgatgaaatcaatgtgattttcttccaatgcagataaggcttctttcccggaacatgccgaaattattgcaaattgctcgtaccttaaactctttgtgatgagttttacgatttcttcatcgtcgtctacaactaatatcgtttttggcatctttatacctcccaacctctttaaatggactgcatttatataacacacaagagccgcatggactcgaattgacaaaaaaagtcgcgctcaaagcgcctctccagttccggatatttctcctttggatgtcagttgaggtaataggatttcttgaagcaacatgttgatttcttttaaaaaggctttattgtccggactttctcccagaaaaatgccttgggggtgctcaatacagcgttatccccattattagataaaaaattctacccggtatggtgccgctaatgacaccttgaatcgatatgtgatgcttcattgtattaaaaagaccgaatcccttataaaaataagattctgcgagttcattccttgaatcatgtgatgagcacacatctgtctgatttgcctcccataagcctatgagagtttcgatggtctgtacttgatgcctcgcttcattatggataaaacatacaattcggtcaagtgtactttgggtaatgaagaaggcctcggcagcacagttgaatggcttccatggataggctattgtaaggataggatacttttcccagataaaagaacttacaggaggtcgtttttcttgatgatccttgaactggtggcccttatttctactgctgtcttgtctacgtttttttcctttcgataccgtttgtggagacgactatagtgagaagtgaacaagagatgctgcataccattctccaatttgctcaagaggacgaacgggtacgtgctgtgattatgaacggttcacgcgctaatccacatgctctacgggacatttttcaggattatgacatcgtctttctcgtatcttccatggacagctttattcaggaacgtggctggattcaccactttggagaattgatcattatgcagacgcccgatgagcatgtggagcctactgtgacgtcccatgatcgctttgcttttcttatgttatttacggatggcaatcgcatagatcttaccctctgtcctgtggctaacatcgccaattggacccgagacagcttaagtgtactgctgctggataaagacgggcttgtggagcctttcccaccgccaagtcttcaagattataagacggtccctccaaccgcccaaacctatgcagattcctgtaatgagttctggtgggtcagtacttatgtggctaaagggttatggcgacaggagctgcctatgctaaatttatgctagatcggcctgttagagatgcgctccacttgatgctggaatggcatattggtatacgaacagacttcgcggcagatccgggtaaacagggaaaatatttcgagaactaccttgagcctggactttggacgctctacatccaaacatttgcggatgcagattatgaacatatgtggcagtctcttttgatcatgggaaatttatttagagaagttgccttggaagtagcgaactattatggctacgaatatccgactctggacgatcaacatgttacgaactatctccatcacgtaaaagctctcccagcagatgctaagggcatttattgataaaaaaaaccagtcggcacttgattttcatgtactaggctggttttatttttatactctaagttattctgtcctatatgctcctttaggtctgctccaaaatattatttttcggtcagaacccggtcacctctgctcgcaggctgagaaataaccaaaaattcaacatcctgattcgtttcattaaacatttgatgaggcaccataggaggaacctcacatccttcctgagatcctaattggattcgttcaccatccacttcaagtaccgctgtgcctgataaaataaagaaaaattggcgcgcatgatgatgataatgtctgacctcatgtgtatttccgggcatccgctcatgaataatgctcaaatcattatttttcaccaagcgccaaccatcacattgatctccccatatataatgttccgcattatttttactaattttcattattgaactcctccttttgcaattacagtttattttatatatgaattcatagagctacaatcttaattataaaacggcaggacaaatataaaaaagtccgacttagtcagacttttttatatatctgcctcgataatttcctccaacttaatccagctaaaatcctcctccccacgggacagtttcacttctcgccgacttgtattaatcaccgtgaccaatccacgaagctcctcatcatcaaacgggttgaacacttttagcgtaataggcttccgttcgttataggatacgatgatggcctgttcaatctgctgcatttcctgatcgtccagtgctggcttgccgcgccttccttgctccttcatcagtcttaaatatgcctcccgatgctcaggcaaaatcatgcgcgagctttcccatatgccatttccttcaagctttttccccatcataagcccctcctatgctgttctggttaccggatgccatgccaatacatgatctaatcgaaaaacacgtggctggcctgtctgtagacaggtggctcgtatcaagccattctgcacacggtgcacctcgatacgccgatgagacagcttgcccttccgatccaaatacacgatttccacgatctgccccacgtatttttccaacatgatccttcactccttatcagaacgtttgtttgtattatatgcgaacatgcgtttgattatcaatgtaaaaaaatcccctgagggatttgactctctcaagggaattaaaattcataggtggatagcttaatatcttctttattcaaatctttcagcgggtagacagggccattccaataagtcagaatatcgatcggctcattagtaccatgttcttttaaagaaagagataattcaagtaataaatgtggaagttgataagagcttgttaaaaactgatattcctctggaccttcacaatcttctgcccgatagaacacaaagtatccctcggtatgatccccaatgagtacaatataacgagcaagaaacataatttcgccattggcaaaaggaatggaatgtgtcgaagcagagatcaaatcagtctctaatccctcaatacgaagggtaagttcattgttaagagcatccattctttctctttgttcgctgatgaggtgttcataatttacagggacaagccctccattcttgatcgtagcgatcaattcgtctataaatactttttgagacaacactcgattgctcatcctattcatctccatattcgtgaaaataagcatggaattctcgctttaatatgttcaatatttatgtattaaaatcttgattcattaactccccagcatttttgtgactgcattcacgaccctttccatctcaaatggtttaacaataaagtcttttgcacctgcctgaaatgcttttataatcgcttcctgctgccccaaagcagaacacatcaaaatgttggcttgtggatcaagctctacaatctttttaacagcctcaagtccgtccatcttaggcatattaatatccatggtgattaaatcgggacgaaagtgtgcgtatttcaaaacagcatcatacccattttctgcttccgcgataacagcgtgacctaaatccaaaagaatatccttaagcacagaacgcataaataaagagtcatccactactataactgttgccaaattaatctctccaatccgttgtcaaatgatatgcacgcccaaacttcaatatcggtgaataaactagtaatattaatagaaagaatctgtaaaaataaaaacgctaccaatgaattataaaagaaatttgaaactagctactacagcattagttttcaaaaaaacgtttcacaatgacgtaaataatttatgtagtgtgaagattacaaagtactaggtatctattgaaaccttagtactatataagctgaatttaaaaactacctatcgtgccactccgcagacggatggtactttcttgtacagcaccattccgcctactccgttttcatgtaagtttgtgaacccgttctgattaacaatttctacttttttaggattcttaactttagaatatgtagcctatattataatgtttcaaattcaaagccccctgtcataccatgcattacatcacaagtgagccaatctaatgcatttttactcaataacttcataacaatttcttgtatctttacagatatgtctcctgttagacaagatgctaattgaatagatgcagtgctccgaacttcaacgtaaaaacgatgcaaacccgtttgataaattctctccactcttgccaaatgaacagtgccagttagaacatacatagcatagcctggcttaataagataagcctcgctcgtttcataatcaagttcttcctcttcccatacatgaacaatcacaatcttctcaagcacagcaatgtctgacatgtccttttcctcttttctaaaaaaatttatttgaccggatcaaaacttaatctaacaaccaagcaagtataataatcaattcgtttgtgaaaaatagatttctagtagatattatcgtttaatatttatcgttatacgataactcctataatgaatatacactcctaaacgtttatcgtcaaatgattatttcataatgcttactaacagggtaaaatacttgataagaggtgattatctttggcgataaatataaagttagaggaaacattgggcaaagcaggaatcacaaaaaatgccttggctcgtgaagcaaaagttcgaccgaacttaatctacgatatgtgcgatggtaagacaaaacgcatagatctggaaacattaagtcacattctcgacacattagaagatcttacaggtcagagacataacctgagcgatgttctggaatatatcccacgcaacgcaaaaaacgatctctcttctgtctaatggagagagatcgtttttatggtctacgtaatagagataactgcttatagcaataagtaaatataatataccgcagctttttaagtatatttctgaccttttcggacagtgtcctaaaggaagcaacaaactcatagcaggcggcggttttaccgtgcctgttccggctggtggataatgattttctcgatacactcgatagcttagggtaaataaaagcctctcttccaaagcggccgctgttgttatcagatgaaaagcgtggttgatcacgctcatgactatcctacagcttttcagcgtataggctcgtaattttcttgcacatcaatgagaaggactgtacttcatcttctgttaatgcttcttccattaaattcatgatttcatttccgaaatcctcaacacggttaagaaacgcttttccctcactagtaagtacaatattataagagcggcggtcattgagttgcctttcctgatttatatactttttctccaacagacgtttcgtcaatttagaaatacccgattgtgaaatacctttcatttcagcgagttcttttgttgttttaggaccttgcttattcaaagtatccagtatatagtattgtgccgttgatacaccttctacgctgaaccggttagagtaagctaaaatcatacattgaaaaggaacataactatcttctaaatcttttgttggcattgcttttcctcctatgtgcgctcaatatattctttcaggtaacttcctgtaagtgaatctctgcatttaactaaatcttccgttaaccccgtaaatatgatttcaccaccattttgcccggcaaaaggacctaagtcgataatccaatcagattgacaaataatatcaaaattatgttcgattacaataagggttgaattttgttccactaggcgattcattacaccaattaactgttttatatccgccatatgcaggccagttgaaggttcatccagaacataaatttgcccgtcattttcaagctcggaagcaagctttatcctctgtaattccccgcctgataaagtgtttagtggttgtcccaaaggaatataagtgattccaacatctgaaagcatttttaatcccctgctaatttcttcttcctgaaaaaagtccaaagcttcggctacagtcattttaaggacttcactaatatttttgcctcttagcttgtattggagcacttcatcggtaaaacgatccccttggcattcctcgcacacggtaacaattgtatccataaaagctaagtctgtgtatgtaacacccaagcctttacaaacaggacaagccccttgcgaattaaagctgaacagggaggcactaacaccgttcttttttgcaaataactttctgatcctatcaaagatccccataaaggtggctatatttgaacgttttgacgcttgtatccctttttgatcgatgaatatagtttcaggaaaaaattgaggtaatacttgattgataagcgtactttttcctgaaccagcgacaccagttacaacggtcattactcctttgggtatttgaaccgaaatatttttcaaattatgtaatgttgcattttcgatggaaagccagccttttggggtgcgtgtattgagtttaaactcaggctggtgtgacaaatatttcccagtcagtgtacccgattcctttaatccttgtaagtcgccctgatatacaatttcaccaccataaattcccgcacccggtcccatgtcgattacatggtctgcaatctttatcagatcggggtcatgttccacgataagcacggtgttgcctttgtctcgcaaaagtttcataaggtcatttattttgcttatatcatggggatgtagccctatgcttggctcatcgaaaatataagtaaggtcagtcagactacttcccagttgacaaaccattttgattctttgcgactccccacctgaaagagtaggtgtttctctatttaaacttaaatagcctaatccaattgataccatctgccgcagccgattgactaactctgaaacgattgtggtggtcatcggagtatgaatggcctcaataaactctaaaagttcactcacctgcatttcagcacattcagcgatatttttcccattcactttacaagataggaccttgtcactcaggcgtgtcccgttgcagtgtgaacaagtctgtttggtaacaaaacgttcaatttgtttactgtatcttatcttttctccttcttctttttttagaaaactccgctcaatgcgcgggatcagcccctcatacaacgaggttttgtgccattcaggtgagggttttttcacttttataccatcagcgtaaagaagcatttccacctcggtttcggaataatccttaatttttttgtcattgtcaaaaaaacccgaatgaatatagcgtgttaatcgccaacccccaggttcaaaggtgggaaaacagactgcgccctcgtttaaggatttgtttttatctaacagtcgttcgatatcaactgtttcaacctttcccaaaccttgacattggctgcacatacccgccagattattgaatgagaacacatcagagtaccctacaaacggagttccgattcgtgaaaataacagtcgcaatagagaataaatatctgtaactgtccctactgttgaccttgcgttaccacctaaccgtttttgattgataataaaagcgactgataaattttcaattgtatccacatctggttttccataatgcggcatacggtgacgaataaaacttgtgtaggtttcatttaattgccgttgtgattctgccgctattgtatcgaataccaaagatgatttccctgagccggatacacctgtaaaaacggtaatttcttttttggagatcaccacatctatattttttagatttcgttccctcgctcctaatacccgtatacaattgtcgctcatttcatttaccttctttacaatatagttgattaggttgatagttgatatgctcaactatattttatcattatttttatgaatggcaatgttgaacttagtcagcagacacgaaaatcaccagtaaccaaagggccgatagtcataaaaaaagacgccgctattatgccgacgtctttttcgaactatttatttaaagtttacttattcattcaaggcttttttcaaagcctccagattgtttttcatcacaccaaggtaatccaggttcttctgtttgtcttcatctgtcaatccttcgagcggattcagtacatcggtttttgaaccgatttcagtagctacggtctcagcgaccttcggatcaacaagagtttcgaagaaaatcgttttaacattattttctttggcaaatttgataatacccgccagcttgtccggtgtaggctcttgctctggagataaaccggcaatgggtacttgggttagaccgtattgcttagccaaatagctaaaagcagcatgctgcgtaataaagtctttacgttttacatctttcagacccgttttgaactcggtatccagttctttcagcttagcgatataagcatcggcgtttttctcataatcagctttgtttgccgaatcggcttttacaagccctgcttctatagcttctacttctttttgagctaagactggatcaagccatacatgagggtccagcacatgatcgtgatcatggccttcctctgcgtgtgcttcttctccttcttcctcctcagcagtcccttccatcaggttcaaccctttgctcgcttcaactacaacacgcttatcgttggacgcgctgctcaaagcctgttctgcccaaccttcgacaataccgttatacacaaatacgtcagcatccttaacctgtgccatatctttagcgctcggttcccagtcatgcggttcagcaccagcaggaatcaacgcggttacgttagcatggtctccagcaacttgcttcgtgaattcatacattggataaaaagtggtgactacattcagcttcttaccactgtctgctgtttgtgccgcattcggctcggtttgggaagcatttgtagctgcattatcagatttggctccgcagccagataaaataagtgctagtcccgcagacaatacaaatgattttttgaaccatgtattcatattcataactccttatgtgttagattttttggtaaattctcactgtaattacactcactggcctgtcgccttcttccgccgggaagcctgttgcttgcccagcttacggaccagcttttgaataccagctcctataatcaggaataataacagcaccatggcaatcgtcccccctgggggagtactgagttcatatgatgccgttaaacccataaatacgccgatcaatgcagtgaccatagatatccagatggctgccgcgaagctcggtgcaattcgaatcgccagcgcagcgggcaatacgattagcgaggagacaagcagcacaccaacaatcggcatggctgcggctacaatcatccctgttaaaatactaaatgcaaatgaaatggacttgacaggaagaccattggtcttcgccgtttcttcatcaaaggtaatctgatacaaaggacgccggaatacaaaaaagaaaatacctccgatgatagccactacaatcatcaacatcagctctgtctgattgaccgctacgaccgaaccaaacaaataagcggaaaatcctttgttgatgctctgattcagattcattaaaataacggccgtcgagaggccacctaccataataatagccacagatatctcactatatgttttataagacctgcggacatattcaacgataatcgcgccgattacggcaacaacaaatccggttatcgtcgggttaatgcctaaataggcacccgctgccacccctgccagcgatacatgcgatagcatgtccgccatgagagcctgacgccgcagcatcaggtatactccaagcaccgaggccagcagtgcaattaccccaccggcacaaaatgcccgctgcatgaagtcgtagtgcagcatttccatccgccatcttccttcctttcaagctcaataattcgatccagataatgttgtacttccgatagtccatgggtcaccatgaccacagttcttccatatttcttaacctgctgattcatcagatcgtagaaatgatggcggctttcctgatccatgccggtcgtgggctcatccaaaatgagcaaatccgattcctgagcgagcgctctcgccacacaaatgcgttgcttctgtccaccggacaattcgccgattttacggtgacgcaaatcccacatgcctacctgacgcagcgcctgctcagtcagatcatgatcctcagaccgcatacggcgtaaccaagagccatgagtatatcttcctgaacggacaaattccaaaatcgtacttggaaatccgccattgaaagcagcaatttgttgggatacaaagccgacaacgagctttttgccttcacctgtacggttagacataaacaccttgcccttccaaggctgaagcaagccgagcaatagtttgagcatggttgatttggaagcaccattcggtccggtaatagccacaaattctcccgaaaaaatttcaacattggcatccaccaagttaggaacatctccgtagccaaatgtgacctgttccaatgaggccaataacatgacgcaaatctccttttcctttaaaaagcctggagccatctgagcgatcatcatttgcgcagattctccaggtcgtttatgatcattaaaccatctaccgtaattattacgatttggtaataaaaaaataagcgtttgataaacgtaacctttacgcattagcaagtttaacagtttaggcaaggttcgtcaatgttttggcaactcttttgtttgtttacttcattttgtccgggtacaagcctacagccaaggttttcagtgcaatcggtgcacgtacaccttcagccgccgcggataatggcaggactataaaccgtttgtttttgatcgcttccacaccagccagcgcaggcttgctcaggagcagcttctctttatcagccagtgaagtatcaccatagtcgagaatgacgatcacatcagggttacggttcacaacctcttcccagcttacttcggtgaaacttttgtcaatatcatcaaaaatatttttcgccttcacactttcaatcaaagacgttagataattgttggcagccgtaaagggcttgtcttctccgctgtcataaacaaacaccttgggtgcctgctcaacagtaccaatttgagtctgaatggacttcacttgttcacggatgtcatttaccagcttttctgcacgctcctcaaccctgaaaatacgcccaatatttagtatatcctgatatacatcttctaatatgggacccggtttgtttgaggactcctgtacataggtcagcaccccttgtttggctagctcctcacgggaacccagatttttatcattaaaggcactcttccagcctgcataggcaaaatccggtgcagcggccataaacacctctttggacggatattgttcggccagtaccggaattttgtcatattgagccttatatttcggtaaaatctgatcatccaaatacgcagttcctaccatataggattccagtccaagagccagcataacctcagtcgcgtgctggttcagtgtaaccgcgcgtttgggtgcctcgggaaatgccattttaacgcccatgttctcaagctctaccgacgtcttattggttgccgattgcgatgcggcaggttgctgcccgtttgccgatggatcgcttgtttgagccgtgtttcctgctacgcaggctgataacaacagcatcatcgccaaagcgatcataaccagcggtaacgcgggcttgctatattttttcatatgtaccgtctcctcttttatttgtagtttatcttacctcatcatatcaccttttctgttcgcatcatggatagcctcctctcctgagagaatccggtaaaaaggtaatattcggcttcccggtttttggatgaatacagatttctgtctccaccccgaatacactccacagcaggtccggctgaagcaaatcctccgttatgccggaggctaccactttgccttcttttaatacatacattcgatcacaataaaatgccgccaaattcaaatcatgtagtgcagctagcgtagttatccgaagtgttttgaccaaatccagaatttgcagctgataccggatgtccagatgatttgttggctcatccaaaacaagaaatttcgcctgcccggccaaagctctggcgatcaatacccgttgcttttcgccgccagacaaggtggcaaaaccctgatccgcctgagcattcatgcctacccgctccagcgcctgctcgaccaattcatgatcggcgacagtatctgcttccagcagtttcttatgcggatggcgacccatcaggacgatgtcccgtactgaaaaatcaaacgtttgcggcgcatcctgactcaccactgccatttgtcgggccgtttctttatacttcatctgcagcatatcttggccatccaacgtaaccaaaccactgtcaggctttagcacacgatacatatttttgagcaacgtcgatttcccgctgccattcggaccaatcaatccaaccagctcccctgcttttacctggagacagatgccgtcgatcagccgtttatcgtgaatactgaaggtgacgctttcgacttctatattcatttttcgcctccaaacgagtaggaactacgacgcagcagccacacaaaaaagggtcctccgcacacagccgttacaataccaatcggcagctcctgtggagccagcacgagccgggcacatacatcagcccacacgacaaaaatagctcccgccaacagactgacgggcagtacacgccgatgatctgatcccactatgagcctaacgatgtgcggaatcataagcccgacaaagccaatcgagccactcactgatacgactgccccggttaaaagagacgccacaacaaccagtaatacgcggaacgtctgtacgttcacccctagcgttactgcggtttcttcacccgttagcaaagcattcagcgaacgatatcgggtcaggaggactaccgttccaacggctacaatgaggcttggaatgaaaagcgtgtcccattgagcacctgccagacttcccatcatccaatacatcgcgtcacgaatgcctttttcattcggggccatcgtaacgataaagctagtcacagccgacagcatcatggacaccgccactcctgccagcaataagcgggtcgtcgatatgctcccagccacacgggctaacgcgaacaccataagcattgcagttaacgagcctataaaagcagataaaggcagcgcaagtcgtcctaaaaatccgaaagctccgaacacaattaccaacgtggctgtcaccgaagccccagacgagactcctaaaatataggggtccgctaacgaattacgaattaatgcctgtatagtcgcccctgtaacagcaagtcctgctcctacgacgacacctagcagcacgcgtggaaagcggatttcccaaacgatatattgctcaggcttggtccatgtcacgggtatccactggtccagccagggaagatgagacagtgcaattcgccatatcgtccccggtgcgacagctacaggaccgagcatgactgcgagtgtcaccgaaagcaacagcccagcagtcagcagcagaattgttgtaaatccccaagtagacttgccagctaggtgtgcgcgagaattatgttgtgatggattaaggttgctcgttctcgaagtcatgaactactactcaatggcttttcggccgcttccaactttctcaattgttccttgatctcggaagcagagaaattctcacccatgacaaccgctacatcgttcactggcttttgcgggcggatcggaatgatttccagctcccgataggcaaactgaaacatcatctgaccctctgattccagaaaccgcacaattcctttggcccggtaaatttcagctggcaaactgcggaacaactgttcaaactcggagcgtggcacaggttgtccaaagaaatacgtgtgaaccactacgtggtcgtaggaatgataatgctccccatgttcgtggtcatgggcgtggtcatgggcgtggtcatggtgatcatgagagtgatggtcaacgtccatacgcccctctccttgagtggagaaaaaggtacccgcgtccacgtcacttcgttgcgtgctcacagtcagagcatatggatttaactcttttacgagggcctgtactttctgcaactcgcccgcagccaataaatcggtcttgttaataatcagtttggaagcgcaccgaagctgatcctgcatcaaacgaagcgacttgcctctctcgttccccgaggcaaaatccagaaattgacgcgcgtctatgaccgtgataacggattgtaatatcatagaagaatagatggaggcgtctgtcactgcatctacgatctccatcgggttagctactccagtacattctacaataatcacgtccggcttatattcctcagcaagattcatgagctcgacgcccaaatccccgcgaatagtacagcatatacaaccactgagcatttccttcatgggtgcttggccattcaccaaactgccgtccagattaacatcacccaactcattcatcaaaatggctggcttgaggcccttctccttgtagtaagccagcgcatgctgaagaagagtggttttaccgctacccaaaaaaccggataaaacaactatcggtatcatataacccctccttgtctttacaacatttaatatggatcgtaccgtaaaagtttccttcttgcaatcatttatcggattttaatcgtaataattactaataataaacataaatatatatgacccctctttgaattgtcaatataggaggtgagacaagcacaatccagtgggcatgattgtccccctacagacataggatttagataagaacccttattcccaaggagacgtggaatgaaaaacagtacgctgttgaagatgctgccttttatgattccgtttgcctttctcatccctgtacttgttacgctatctccccagtggcttcgtttgttagatatgggccaactgcaaccgttaaaaacggtatttatgggtatttttctggaagctgttccgtttctccttatcggtgtactcgtctcatcccttttgcagtggcttgtaccggagacatggattcgcaaaatagcgcctgcgcatcctgtaccgggtgtcctgctggcctccttattaggtatgctgtttcccatctgtgaatgcggcatgatccctgtcgttcgccaattaatgctcaagggaatgcctgcctatatgggtatcacttttattttaagcgggcccattatcaatcccgtggtactggctgcgacgatgatggctttcccttcccatcccgaggtcactgccgttcgaatgggtttggcttttgccgtctccgcgatcatcgggctgatcgtgtatgcctttgtgcgagtgcatccgctcaaacggtcgttgctctcttttaaccagcaaaagcagaacaatcagactcatcggcatagtcgcacatggcggggcttttttgtacatgctggtgacgagtttttggacatgagtaaatatctcactatcggcgcattattaacagcctgcatccaaaccttcatcccacgtgatgagatgctttcgttaagcaacggaacggtcggatcgtacgcctttatgatgggttttgcctacatactgtcgctatgttccacctccgatgcctttgtagccactgctttttcacacacctttacactaggtccgctggcagcctttcttgtactcggcccgatgctagacttcaaaggcacgctcatgctgctaagcaccttccgcactaaatttgtcgccatcctgggcttgctcattgtttcactcgtcctcgtgggttctatagctgcagaatggttattggggaggtgaatacaaacgtgaattcaacctttagcatccgctggcaatatggtatgcgctccttgctcctaatcggattggctgtgtacattatctcattaaaccgtacgaatgcacttcattactacctagctccccatatgcaaaagctgctcctactctgtcctgtaccactcttgttcatcgcattggcgatggcattacacggaatcatcggagagcgggacggtgaggatgtatgtgattgtgagcatccgttgccgcaaagctggttcaaaaaaacactcgtatatggaatgctgctcatcccgctcctgttcggttctctgctgcccaatcaggcacttggtagtgatatggccgccaaaaaaggcatgtccttcacgtatcccaatccggatatccgacgaaaagcagatatacagaccacaaaagcatccacctcctcccttttatcaactgcatcttctgtcccaacttcgccccctccagagggaaaatggagtcaggaaacgctggataagctgttcgttccgcctgacaagtacaatgtagaattcgccgagctggcgaaacgcctgtatcagcaacctatcatacagatcaagccggaggttttctccgaaactattggcgccattgagttatataaacaagcttttgaaggaaaaaaagtacaggtgactggctttgtctataaagacgacaacctgccaggtaaaggcctatttgcagtaggaagattcctcgtcatgtgctgtactgccgatgccatgccattcgggatcatcgtccaatcccagaaggccccgtcctttgacaaggatacctgggtgaccattgaaggaacactgcatgccacacaaaagggcaacgctcccttacttgaaattcgatccgaaaaaataaccgctgtcgagcagccagaatccccttatgtctatacccaagcagactcggtagctacctttgatcgcttgaacacagcacactaaacccatcaaggaggaaaaatgatgaacaaagttcctgttattttaatcagtggttttcttggaagcggcaaaacaacactgcttttacgcctgttagcccatactcgccaaattccccttcgtgctgctgttttaatgaacgaaatgggtgaatatgatgtagacagcgctataatttcagaggaaatgcctgacgtaacagtagaaggattgctagaaggctgcatttgttgcagcaaaagaaatgagctggcaggggctctgcataccctgctcagtcagaagccagacctgatcttcatggaaaccaccggggtagccaaccccgaacaagtactggaggagcttcgctcccctctactggcagatcggctttatctggttcacagcatcagtgttgtggatgctgagctgttccatgaatacaatagccgatttacggctgataaagaactggttcgcaccctgcacggacaactgcgcaccgcagactttattgtggtgaacaagacggatgcagcaagtagccgtgaagtgacgaaggtcgtcaagagcatccgcaagctcaacgatacggccaagctgcaaactactgaatatagccgagttgaccttgaaccactactagagcctgttctggcctccgcatccgttgccgcgaaacccatacagacacttcaacctgcacctgcacaagtccagtccaccgatgcaggtgtaccgtccgtttccattcccgtcaaaagtatcggaagcaccagtagtgtctccagaagtacggctttcaaagttattgcggcacacagtcataaccacgatcctaagcagcctcattcgttctcccgtctggagagcctaacgctgcatcaatattctcctcagccactcgacaaacaacgattggaaaactttttgaccgggttaggttcctcgttgcttcgtgcgaaaggttactgcgtgcttcctcaggaaggtactatgcttttgcaattttcaggaaatcacttggagtggcagcctactgcacttcctgtgagccagggatatgtcacactcattggagaacagcttgacaaagcctccattaccgatcaatgggaacagtgcttcgtgtcgctgtaatcgacatattcggctagtaatgatgaaaattccctttggtatgtctacgaaattaataaggctgttcctttgacttttaaaagtcagggaacggccttttttttcgtaactatcataaatttgcatctacgcagtatgtaccttataggatgccatgttgaaagattgggaataaaaaaagctgtcgagaatgtctcgacagcttgagtaccactatggcagagttatacattaattgcttggcgacatcctactctcccggggcccttcggcccaagtaccattggcgctgggggcttcccgttaattcaacaaaatgttatggagtatgatgactaaaatattggagcgttccggttggaaaagaattccattctcctggaagattataagaggtggaaccggacttaatccccgattttcggataatagtcccattattcggcataaattgcgtttttccgttaggatcacctaagacgtcgatcgttacaccgttctttttcaggacatagcctgtcgttacattggtattcgtttctagtaacatcaattcatcattatagtatgtcgtaggaacaatgtcgaaaaagtcataaaagatggaatcgatatatatataaggcatgcctttccaaaacgaattaataggctggctccacactttaggagtatttgtagctaaattgtattgatgaatctcaagtgagtatcctgcattttctataggcttagaagtatctcctaccggattgtagaacagctcaatagcagtccgggttttatctaaggatagatactgggaaaaatatagatcctccggtccttgaggatttgaggtcacttggaatacagcggcagatccgttcgccccgattacccagaagtattgaaaaatatccccgttccatgcccaaaccgtcccattaagagggattggcccagtaaaggtggaatctgccgtacccgaatagattttaaatgaagtttcacccgggaacactgttgacatgtcataagtaatcggatctttaaccccttgcttggttcggatttgaacaattccattcgtcgcaagaggagcattcgttacctgaaaattataggtggctgttccgccatgcccgtcattcgcagtaatcgttaccttggtacttcctgtctgattacccggagtaagagtcaacgttgatccgttaacctctgcatttaccataccggttgattcaacagtagaagtaaacgtcagggcatccccgtcagcatcactgaacaattgagataggtcgtagcttcttgcattcgtaactcctgcagtcaacacttgttcataaatggtcgcatctacttgaggcggctgattagaagatgggttagacgaaccggatgattggacactgacctggaatgtggttgaagtttcccctccgcggccatccataaccttgatttctatgattgtcgtccctgcacttagtgcctgaatttccaattgagctccagtgatttccgccgaagcaacggacggatcagaagaggttgccttaaaggtcaacgtatccccatcaggatcagtaaaaacggaacctaaattgagtgagtagaccgcaccacctacagtaagcgactggtcggcaggtttagtttctactggatactgattctgtggaggttcagccgtgacggtggttttgaaagtttcgatcactttccctccccagctatctgttgctttgatcgataccgatgtactaccgatcgttaacggtgtaagagtaagcatatctccataaacggcagccgtcacaacagtagggtcagaaatgctatgaacatcgtaagttaaaacatcgctatcaggactggaaaagaaatcatttaaggacaattgaatatcgcctgtatttatttctttcatctgatccggaatccctgtggaaatcggggattcattgacggtaacatcaaaatcagtagtgacctcgcccccgcggccatcttttgctttaagctgaatcgttgctattcctgaggaaactgcatggaccgtggctatgtatccgttaacggatacaacagcaactgacgaatccgaagattctgccaaaacgtccacagggtcgccatcgggatcgtggaataccgaagataaatccaggatataatccgcatcgcctagattcagtgtctgattacccggcttctggtctataaccggattttggttagatacagcagttacttccatttgaaacgactggcttgtgctacctccatggccatcagatgccttaacagatactgatgtgctgccaatttttaacggtgtaatggtaagcgtgtccccatttagcactgcagtcgcaaccgaagaatcggaaatatcaatgctgtatgacaacgaattcttctcatggtcggtaaagaagtcgtttaaagataattgaatgtcgtctgaattgatttgtttcgtctgatccggaattcgcaaggataccggaggttcattaacggtaatatcaaaatcggtcttaacctcgcctccaaggccatttcccgcttttagctggatgtttgctgttcctgaggaaaccgcatgaactgtggcctggtttccgttaacggagaccgtcgcaatggatagatccgaggattctgccgagatgattagcggattgctgtccgaatcaaggaacaccggagataaatccaggatgtagtccgcatcgcccacagtgagcgtttggttgcccggcttctgatttacaaccggattttgattaggtactgcagttacaaccaattgaaacgactggcttgcgctgcctccccgaccatcggatgccttgacggtaacttgggcatgtcctacagctgccggagttaataccaattgatcacccgtcagggtaaaggtagcaatggaaggatcatcgatcgcaacctcataagtcataggatcattttcagaatccgtaaaaaacgatcctaaagataaggttacgtcgccgctccccaactgttcgttttgatcggggatactcaatgaaacaggagattcattgacacggaccttgaaattcgttcccgcttttttcccggcctggtcatctgcggcgatcgtaatggtcgcagtccctttgccaacagccttgataaacaggtttgttccctctactcggactgtactgatttttgtactagacgacactgccgtatatttgagctcggactgctcctcgtccgtaaaatgaccaagcaagtcaatctgaagttcagaatcgcccaccgttacggcttgatcgtcatatttggtcactaacttcggtgctgtattggtcacaaccgtagaacgcgagctaccagaagaagttgtagtgactccagtgactcctgataccgtcgaagaagacacacctactgcaaatgaagtattcgtgacttggctggaggagcttacactaatatttgctgcagagttatttacttgtaaatttgaaatagttccagctacctccagactgaccggagaggaactgttcacagccaatgtattaatggaggcctggcctgtcagagctacgggctgatcactgttgaccgacaattgcttaataatcccctgcaactctacttgcttggcaccggtaagaacattcaactgctgtatcgttgaggatgaatcattttcaatcgttgcattggaaatcaacgacatttgatccaccgtcgaatttccttgaatgactacgtggacatcctgtttggatacctcgacatcctgcagctcagatgtgttaaacaatacggtgttctggtcaccgccctgaatatatgtttttccttgtaccgtaaatttagaggcatagaaatcatgttcaaggcttgacgtaactgtaaaactatttttgacattcaaattcataaccgaaatgtaatcaccgtcaatagttaaatctccgtcaatcgaggagttatgaccatctaatacaagattgccgctgaattcggaagcttgccctatcggagcttgcccgctcgcatggatgaccagtttggtgatcgattcaatcgtccgctgtgatgctacaaattgaatatctgctcctttgagaatctcttggttagaggtttgcaggattcctttaactgaatccgagagtttatattcaatcccgttaatccaggcctttccatcctctactttttggagttggactacatggtccttagggaaaaaggtagacatcatatactgggctatatcttggcgctgaacggacgatttaggtttgaaaccggactgatccgtcttcatggagcccgactgtaaagccgtattaacgtatggccgtgcccacggactgacccgattccaatcagtaagtttagcagactccgtggcgtcagctgtaataggaagcccggcggcccgcataagcagaaccgcagcctcctctctggtaactgccgctttgggtctgaatttggagccgtcgtctccattcatgagtcctgcacgatgtacagcctcaatatagggactcgaccaacttttcgggtctacatccgagaaactgctgcttgctgctttagaaatagagagttgcagagcttgagttaatagaaccgccatttcttgacgggtcaacaaatctgttggccgataggatccagatgggtcaccatgcagaagtccagcttcaatggctcgcaggatgtttgtcttttgctctgaagcaatattattgatgtctttaaaaggcagactggccagagctgctccgtttgatgcaccgctggcagcagatgcaatcgtctgcaaagccgttggagcaacaagtgcagccaaggctaatgtaatcagccatttattaggtttagaactcatgatgttccctctattctttgtattcattatggtgcctcactactaaagatgccgatattatccgtataatcggttccttcatcaaaccattcacttgcctcgtagtctgcatttccatgggtaacatcggattgtctagctaaagtggtatgaggctgaaacactgccgtatcaatcaactgattatcgtaataaagcgataaagtaacaggtgctgaatcatcgttataaaatcccatgtccgtgaagtaatctacatgcgcatcaccaaaatacatggtatctcctatcacgaaagtagctccacctggaataaaagcaccagcgtcttgacttatttcgatcgaatttccactatcactgcgttcaattctaatttttgaagcatccaattcctcagaacccgcattataaagctcaataatttgcatcatagagtcgctctccccccatgccaactcggagaagaaaagtcccttcttttctccagcagtgacttggaagatcgtttgaacggttccccccttcccatcatctgcggtaactgtgactgtagcacttcccactgcaagcggagtaattctcagttggtcgcctgtaacggaaaccgttgctacgctagggtccgatgaatcagcggaatacgtcagtaagtccaaatcttcatctgcaaaagttgaagcaagtccaatagttgtgtccacagcacctgcttctgtagaaacatcattaatcgtgctttgaacaacaggagcgtgattagcagcaggtggaggggtcaccgttagagtgaaattcgtatccaccgtgccgcccttgccgtcatctgctgtaaccgtaatcgtgaccgtacccgcgttcactgggataattttcaggtcgctttcgtttaccgctactgttgccactcccgtatctgtcgaggttgccgtgtatgtcagtgcatcgctgtcttcatctgcaaacacactcgcaaggctcaccgtcttaactccatccgcggctcctgtcgtcacattgctgatcgacgtttccaccgtcggcgcatggttcacggcttccgggatcaccggcgtgatcgtcacgttgaactgcgtatccaccgtgccgcccttgccgtcatctgctgtaaccgtaatcgtgaccgtacccgcgttcactggcgtaattttcagatcgcttccgtttaccgctgctgttgccacgctcgtatccgtcgaggttgccgtgtatgtcagcgcgtcgctgtcttcatctgcaaacacactcgcaaggctcaccgtcttaactccatccgcggctcctgtcgtcacattgctgatcgacgtttccaccgtcggcgcatggttcacggcttctgggatcaccggcgtgatcgtcacgttaaactggtcgtttatggtcccgcccttgccgtcgttcgccgtaaccatgatcgtaactgttccggcgttcaccggcgtgagagtcaactgacttccattcactgataccgtcgctacgtttgtggctgaagtttctgctgtgtaggtcagagtgtctccatcagcatcggtaaaactatttgccagattaatctttttaggctcatctgctgtacttaacgtaatatcagtaaacctggtagtaacgcctggcgcatggttagtcactgattttgttgaagttccacctccggaggaaaatgtcacgctgctcgacgtaactgtagtcggttcttgaaccgttccgtcagcggactgaatttgtccaatctgcttttgtacttcgctgtaattttggataacttgtgaaacggatgcatctttaggcagctgaatcatttcaactttaaaattcggattcaatgtcactttagcgtttgcgttagcaacttgaagctccccgattgttccggttcctttaatagaaataccattgccggaattcacattaagatagtttacgtttccattcagctggatattagaaacaccgtcattaagctcgattactcctttgatatcccctttaatctgaacaccatcacctaaaattcgaagcaggctgctttccggtagaccattggtgtttaacacaacatctttttgcacgatttctaattgttgcagtccgtccacattacgattgcgcgaattaaactttaatttagctccttttaacgcatctttattggagtttccgattaactctttcaaattcccctctattaaataaggaacattatcgattgttacaatgtctccatcaatgctattgatcgtagctgtttgctcttgagttttgaaaatatccagcaggaaaggagcaatatcctccctttttacttcacccgtgggattgagcttgctgtcatgaatgtcaattaaacccaggcgaagtgctgtatctaccgatccagccgcccattggcttaccaaggactgatctttgggtaaaatgcttgatccgccctctgcattaacccctccgactgcacgaacaaacacagctgccagctcttcacgggtaacaggatcgttcggacgaaagtttcctaatccatccccggatagaaacccggctttttgtgcggcttctatatatggggcagcaaattgtttactttgcacatctttaaaagtagaagaactcgaaatagggtccaattttaaggctctgaccaataatactgcgagttcctgacgagttaatgttgctgaagggcgaaaagttccatgaggatctcccgataaaagcccttggcgtacagcttcttggatggccaccattttatcactcgtcacataggatgtatctgaaaacaaattattggtaggcgttgcagcgtaagcagaagtaccaaacgccgcctgaagagcaacaagagcggctgcccacttaagtgaataaactttcaatggttctacctcctaatttacttttgagtcaaacgaccctattcgatcttcgaaatgtttctacataattcaaagataataaagcttattcactgtatttaccgataaaaatgtgtttatattaatcttttattcatatatttgtcgaaaataagtgatttatgtcgttttcaattaatatacatgaaaccactgaaccaattctgaacaaaagcttatctataatgatgcctagttgtatcaagtctctaactatatccttcaaataacttatttccgcaagtgatttatcggaaccctcccttaatcgcgactcttgtgctaaaaaaaataatcgcaggctagatacctgcgattatttttaaattaagacagcctatacgaagtatagaattacgttttaaaatgattagttgccaagattagcaatgtcgctgctgaatatcttaaaacgttatattcgtatcttttttcatcatagccctcgtcgactattgttcagcttcatttagcattaaaaagcagcagcttcacggactgttccataagaatgttaaattcgagacttgaaaatacatttgttattcgcgttgtttcggatgtaactatccgtaaaaaataaaaaagctaggtttacgaattattggcataatccgtaaacctagctctcgacgagtcttacttaaggttatattttttgttaaagcgatccacacggccaccgatatccacgtttctttgtttaccagtgaagaacgggtgggaagcggagctagtatctacacggataactgggtatgtgttgccatcttcccattccatcgtttcttgcgaatatttagtggaagcactcaggaaagtaaatccacagctagggtccaaaaagataactttgttcaatgttggatgaatatcttttttcattagtttcacctaatctttcatgtagttttagtttcaaacttaaacgtactggcgcaatactccatcagttggcaaaaggaacggttatgtcccagaaaaaaagacgacagatcataacagttgcgctcaagctcgtaaacgacaagcaaacgatgccgcatatacgcatcgcccattgcacgaacgctccggatctttcgtcagccttcatcgttatataagcatatagtgaatggtcctccggctcgtcccaaatgctgacaccagcacaggagaactcggtagccacgtgctttcgattcaaaaggcaaagcgtaccatgtagctcggcatctatcatacagccttgaaaaaaagccgttttcttaggtgcaagctttaactttggacgctctgtccactggactaattcaagttttcgccggttccataacgcaggcttttgcaaacttaacaggcttcgctcaggaagcagaatcattcaggttgctatgcagcaaacctcaaattatctagtttcacgatggatcgtgtactttttcagacgcggagagtattttttcatttcaagacgctccggatgatttcttttgttcttggttgttgtatagttgcgatcaccggattcggtgcatgccaaggtaacaattacgcgcatttctcttcctccttaattggaatacatggtatacaattacaatagtaatttttacgattagttctattctataattcatgctccgctttgtcaaccttagagtcacggtttgtcgcttcttcgaccgtgttccagcgattacggtactgtgcaagcttatgatgaagttcctggggttcgctcgaaagcaccaatctgacatttctaatccattctccaaatgatgcataggaagcgcacaaatttgcagtttcaggactcatgtacaaaaaaagtggggtcgtatacttttccgccaaaaaacggatggctgcttcaatcggcgtatactttttacgcttaccttcccagttctcaatcacaacagcactcaaagcttgctcccgttgccactctcccagctcgtccacccgcttgtaatacgaacgtaccggctgcttccacattcttctgacggtttcttcatgtagcggatacaacaccagctttgtaaaagataatgcagcccccgtttcggcaaaaagctccagctctctagctgtaatctgctcgaacgtatcatagtagaccatggtccctttatgcgtctcgatcggaggctcataaccatagggtacatattgaaggtttcttgtcatgccggacactccgtccttccatagatgaacttttccttctatattatacccttgttttggcatgagtttacatcaaatgtttatccttgctcaacagcaggcgtattacggcgtgaaccccttcggaattgcaacgcataaagtcccatcgtcacaagcgcaatcagtgcaagcaccgtaaaaatattgctaaaattgaatacctgcacattagatacgacaggattcaaatgaaaggacgacgaactatccagcgttttgcccaaaatacttgtcgtgatcgccccggcaatgaaattcagcagagatagcagccccattccaacaccaatctggtctttcgacaaggtacgagaaatcgtgttggacatggcaatttgcatgaaggtctgacctacgtttccgaaaataagcaaaaataaaatcagatacggagaggcacccacaaatgtagacaagctgataaaacagataaacaaaagcgatacagctgtatagacgagaaacgaatttcctttgctatccgccaaacgccctcctcttttacccaatagagccgaagcaatagcagccggaaacataaccagtccaattattgccggcgtgagctgattgagactgttcagaaactgcggtgccaagtacggcaatccaaagctaatccccgtccctaaaaaagcgataaggagcccgtaggaatattgcttgttacggaacagcttcggctggatgaatggatcatgcgcagtgttaatgcgccatataaacagtgcgaataacaccacaccgaccagaaagaacatcatattggtttgcgaaatcgaaagtaataagaaggctactgttccacccagcaataatccacccagaaaatcgaacttctgatcctttccacgctgatcgtccaaatatttgcggaagaacggcaatgcgatcagtggcagcatggaaatgacgaacaaaaaacgccagcttgcaaagcctgtgatcaaaccggaaataatcggagccagtgcagtacctaacgccaagccgattgctgtgacgcccaaagcacgtccccttttttcagccgagaaataacggactgggacgatcatagcagttgccggaataacagcagcccctgcagcctgaagcaaacgagctacaatgagcatccaaaattgattggccaacagtccaataagcgaacccagtgcaaaaaagataatcccaaacgtcagcaaatccttaagacgatatttatctgccaatttgccgtaggtcaccgagccaactgcatacacgatcatatagccagtcagcaaccaacttacatcggaagcactaatatgaaactcctctcgaatcacaggcataacgacattaaacataaaagcgttcatcactgaaaaaacaagtgtgaaagctagcactcgcataagcttatccgcattgggataagtttgttcatttatcatttggttgtctccctctcctgtaaacctcttatctaagatcatatttcactatttttgttacccctatccgggcaaattctctatatattcgctcaagcgtgggcgtccgtagggtggtagtcgcggagaatttttttaagcagacagcgtagcgtctccgattctccggcagataacgtttcacctaccgagcttttaattgcctcaatagtacgttcagctactttgtgaatctctaagccttcctcagtcaaatagatttgcttcattcgtgcatcttccgggtgacttttgcgtattgcccagtttttcttaacgatcccgttaaccaggctggtaacgcttgatttatcaataagcaatagcctttccaaatccgtattggtgactccaggcgacaccgccagtatatagagcgtctgcgattgtggggaggtgagtcccaaagggcgcagtgccgtttcaatttcgcgccggacggtagtgaaaatccatttaattaaatacatcgtgctctcttcctcccaaggaagacaaacgggatacacctcacttcccatctcactacgaacctccatatccatctaaatttaatagtttgaattccaactaattttaatcagctgcctacttggtgtcaatactttcgtaaaataatgctttactagataagatgaatttcaaattacgaattcattctttatggaaatttatgtatagtaaaagacgagcccttgaaggaagcccgtcttttactttatttctgttttatagttgcttagtctgcactcttcacttgaaccagcgggtattcttctccatcaacggtaaccgtgctagcatcgttcagctccagcctttgccaaatggtcaacagcgtacgataaggatacttcttcagatcgtactcctttgtctctgtaccatcaccggacgtgctgcctatggttttatcggctgctataccactaccctcagtagaaatctccgaagtcgagcctccgtccgtgttgcctgtcactgctccagactgatcgccgcttgttccactggatgtactaccacgagctgtggaaccactgtccgtggattgtccatctgctgtcgaactttttgtagtggcgctcccagtgattacgtcaccggatggatcattgttcgcattactggcagcttccttgtcgttctgttcagcaagcgtaaaattttcgtataagtgctcctgttggtccgccccgacaatgacgagcttcttcggcttaaattctgcctgctctgtcgatgtctgaaacgcaaacaacagcttgaccattttcgtagtggacttggtattaggcacatgtgtcactatcgccgtaggctcctcttttacgggcactgtaggctctacaggctgttgtacaggcttcggagcagcaacaggcgcaggtgtgtcaccagatccgatcaccccggttgctttcaggccgccgagcgtacctgcaatgacaatcagcacgatcccggaaatcaccccacctttacgaaaacgacgaagtgttttaaccaacggtgtgtccgtctcccgctttgctgccaaataaaaatttttaaaagcaggctttgcaggttcaaaatattgacgccacagcgtttttttatgcagtccctctcgtccttccttttggaagaatagaagtagcgcacgtcgatacgacggttcgaaaccgccacgtggagtggcaaactcggggtgttcttccgaccatcggataaagcggtacatcgtatcgttatccttcgcccatttgcggatcgaactgaccagacgagcgaagtccaatattccttctcccggcccgtcagaacgatagaatgcaggcaacagacgggcaaaatggctttccgcaagctgctggggcagccagccataagcccaatcctgtaccttttctacttcgccaggctccaggccgtccagcaccgacggttccggttcctccgtattaaaccaatcgtaagccgcaatcaatcgcactgcttgtcccttgaggggagcaggcagctttccaacccactgcaccaaatcgggccgtgtaaaaaatggaatctgtacgacctgatcgggtgatatttcttttagctctacttcggtaagtaaataccgatccgacgcttcctgcaggcgctctgtcaatccagattgctccagcggggacagtttgcctacagcagagctgctgtcccattgacgcaagcgttggtgaatggcagccacagcctctactggttttctttcggcacgcagtctgcccatcagtgcagattctgccaaaagctgaaaatcggcattcgccgacacttcgatataccgactgccccattcatgcacaacggccagcagccccttggcatccggtgttcttttcatctgactgtccatgtagggaatgaacagcatttttgtaagcgccggattacccagcactttcgtaaaatatgccttgcctaatgacggattctcctcaatcgtatggtaaatatacgtgactgcttccgtatttctggcagtataagcattgtttagcgaacggattaaatattccaccaaccgattttcgctgctgcgtgcatgaactttataatagtccttgaaactatcgactagacctacatctggaatatatccatccttcacccgatcaaattcatgatcaaaaaacgatagaaacagatcattcagcctcattttacgtggcagcgaatcgggtggcgataaataatcagtcaagcttcgtaatacagcgattcgttgttcgttgtataatgcccgctctccttgctcaattctgtacaacgtaatgagctcatgatagctggatggcgtcaaatcacgccctgcctccatacctgtcagcatttgctcggcaaatttgaagaaatcatccggcgtctcaccattcagcaacgtgcggacaatccagtcaaaatacggctgtctcacctgctctgcatccacattaagtattcgactatggttagacaggtcaaatacaaagtccttttccacattccgatcaccgggacgcaaactaaaaggctcaacgaacatcaagtgaatgccttttctgctgttcggttcctgtgcatatgtaagaaatccgagtctgttccgaaatgcataaggcagtgccgcatacagcacacccagcagctgcttggctgaagatccgaccgcttctacaggaacattcaatgctacatatacctttttgcgacccgctgcggacatcatgactgcgtataaaagctgtttgaacacttcttcgctcagctgcaattgagccagcactgtagacgggtcaacagccggaaatacacttccacccggtagacgctccaattccggtaaatccgttccctgctcaatatcataggtatcaacaaatgatgtgttcagccactgcttatagtcagacggagattcaccatgtccggctggaatcacatagttgtgcgtgaaaaaggcgctccgcagcccagtaaaatccgcagccttataaatactgcggccaagcactacatccccggaatccgtccgtaccagatgcatggcttctggatagacgctttcctgcttctcgccacgcgccgtcaaagcagcaggcgcatcatatacacataaggggtggagcacctttttaataaaagaagcatccaatcctttggaattagccactgtatcgaagccttccgtagaacggaaaattccacgccgttcccgtgtgtacatctgctgttgtatcaaatgagaggtagaataactcactgtgattctctcccctcaatgtacttcaacttataaagcagccaaatgaatggctcatccacacggatcggactaaccaacccttgcagcttttgctccaccggattgctacccagcgcggaaaccgcgaaataggccgtatccgtaaaatatacatccatcgtgcccttgaacggcttatccaccttttcgatgaagcgtcgaacttcgccatcaatgttcgcgaactcatccaaatccatatatttgcgatgctccatcggattaaaaatattgctattcctcttgatgtatgtgccttcttcatctgccaatgcagtaagcatatcacttttggtcaggacgacagcggtcggaatgtccgttttccctttttcctgataagcaataaaatcaccgaacatcgtaagtacgacatcacgcggttcatcatattgcgagacccattcacccggcttatcgccaaggttaatcttaatgcgctcccgaatagagcggatttgcagtggatcgaccataaagagaatacctgctgaattcttaatatgctgtccatgcagtcccagatagtcctgatctaccattccctcaccggcgacatcaaaaaataccagcgtcagtggcggcttttcctcatccttaaatacaaactggaagataaaaggctcctgcatcttttctttttgtgtcgatgtaagcagatcgcctcgttcaaataggggttcctcatacatggtgcggaactttcggctgatctctgcattgagcggcatgcaagccgcgtcaaaatgatcggccgtaacatgctgcagcgtgtgaatcagggaggtcatatagacagatttccccgcctgcgaagctccaataatcgaaatgatattgctaggcaccttacccgcggtcacgggcagctcgttatgacagtgtgggcacagtcgatgacgcgtcagctcgccataacggtctgtcagtcctgttagtacatgatcagaatacaatcgatgttcctcaggaacatcatggggatgcaaaatcgcctccatatcatgcacactgtccaagccaaaacgctcccgatatttgttcaacagctcatcttcacctaaagcgtagtcctcgtcatcttcacgatgatgagaagcacggaataccacgtcctccggggagaatttactaaagcaataagggcacacaatatcgtaaaataacggccttggcgctgcctgtggctttcttctgaatatattactaagaaaactcatcggttgcggcctcctttcattcaggaactatttcatataccgtgccatatttctggccgtctgtaaaaaacagccgcacatattcatctccccccacttcaacagcgggtaaaacattccgtcccgcggcaaagggtgccgtgaatggatacaaggttccatcgtcccggtctgcgggatagcccccgcgcttcttcacgtagcaaagcgcctcctgcgggacaggaacttcggctgtcacctgaatctggacggttttgcggctgcgaaaccagttttttttatggtgaaccgcatatctgattttagcccttcccgtactcaactccagttggttggctccatcttgctgacggatcacgtaagtatctccatcctccagaacagccggatacacggtataccgtacgcgtccaatgccttcaattcggtcacgatagctgccagcagccttatactcctcgcgtgtaaacagttttaggcttgaaaaaggcggtaaaacttcaccctcattttgcccattcacacctgcatcggctgattgtttcgcaatatataccacggctgcgccttcaggccactgccagcgcaacacaacccggttgtcgtcaattttgtggctcagctccgaaataacaggatcaccgggctgtgcttccctatactgcataagttccagcctcccgttctaaaatccactgctgcgtcgattgcgcgtcgaggcttccggtgcccctctccggcgtcctgacgacgctccctgacttcctccaccggaagatcggcgagtattttccgcaatcggtagaacaagcgaaaagacagcgataagggctgccagtacgagcgctgccaccaaacgaatcatcaagtcgcctattggcgagccagataatcccttttccagaataaagccagcgagcaagcctgccgggactcctccaatcgcaaaattccgcgcgagaaaacggttatcaaacatcagcccaagagctaatcctaatagagcgccgataatgaccagagccgttacgcgataaatggcaaaatacagactgtcggcatactcacctgtccgctccgttaccagtgtgcgatcaccgattttgttatatattttaccgaacgcctgagtaagtccttgggcattggctacattagaataagttccgcctgtcaggtcagcaatattttgcaataagactataccatccgactctgccagcttcagcccgatcgtattgatcggaatctggcgggcgatataaggagccaatgccgtctgggtatccagctcgctaaagccgtcagagagcataataacgagagaacctttttctgcattgccttgggtttcaatctccttgatcgtctcatccaaagcaagtccgatctctgtaccgcctgacattatagtctgcatgctatcgattttggaataaaccgcttgcttctctgcatctgtgcgaattggagtaaacggctgaaccaactgggcagtagaatcaaatgaaacaatggctaccctcttgtctccatccatttggccaattagactcttagcagccgttaggcgttcattatcaggatctgtttgctgcatactcccggaattatcaatcacaagcacgaggtcctgtacgctcttgcgcccttcaggattaacctgatagcccaactccaatagcagacctgccacgaacaacatcactagcgtagcaggcaccagtaacttccaggataacccggagtagcgctgccgccatgaatgtccatttaactgtggcgaaattagttcgccgatcagacaacctaggccaatacacagtgccatgatgccaaaatacagcccgatcacgacgatatgcggccagtgccctatcaatttgtgaagaataagctctcccaagatgaagcctactacagcgcccagcaagccgaacagcaataggagaacgttaaatttacgctgcttcataagaatcgttgcttccttccatcattaaagtaggatgaatatgtggctaccgcaattccggcaaccgatccacgtcgattccgtgaaacacgaaaccattcgcagtatatgtctcataatacgttttgccgttgcggtaaaccatcagatcctccagatggaagccgcccatcaaatgcagcttttccaccccgctgctgcgacgctcatgtacaaaacccagcttgtaaatacgcgaagtaatgtccacatccattgcataaggaagaaattcgccttcgtagtcaccaaagaagtacttttcttcataccgatgctcatgggtatagtcgagcaaacgtacgttaattccgccatgttcctctaacgtttgatacagttttttaaacagctcatccttcggaacgaccagccgattttcatatgcagcagctacattggcacgccgcaataattcttcttcgaaggtctgattaaacggctgtgaactgagaatcaaggtgcgacaggtctgcgtaagtcgatccaccaatgcggacaggcccccgtccagcaatccggatacaggccccatatgccgggtatcaaaaaatatagatttcccccgcttgctttccagctcacgcatgacatcctccgtcacacgctcgtaatattcgaacaggttttgacctgtgtaactatcggcctgccggatactgtccgttgcagcttgatgcagttcacgctccaggctggaaagctgtactgtaatatgcttcgcctgcgcatgccatttttctagtgccagttcatagcggcgaagcagctccaaatcggcttgaattcgcagcatgtgcagtttgtgcccgtaaaccgtctcggtcaggtaacgaatcaagcttcgaacattatgcttatccatgagtggcaatcgttgaaaaggttggtcctccactcgtccgctatacagggtgtccagttcagcggcactaatctgcaagtcattggacgtatcccgaatcagtccacgaatggctgtaagcacattccctgttttattttcatccgtccagtctgtcaactcgaataagccgatttcaggatattccttggcagctgcattcacagccgactgtagacctgattccgcctgaaaatctcctaaccgtttgtgcacaatccgttcacagttatcgcggaaaaaggcttcgcagccctgaccaaacaaggcttcctccgcctcacgtaatgtcattcgcttcaacgagccgtagctggatccgctggtcatcagtgcgctcatatccgtgatcgcttcattaccaggaacgagatcatttcgcgtgcgaccgcgctcagcagcatctaacccaaaataattcagcttatcgcgtatgtcccactcttgctctgttctcatacgctctaacagcttcacataaaagtgatacagcacagtcagtgcgattgactggttagggcggttgactcgggaaaatccagccgacacataaccctgccgcccggattccgtcatgatgttgtttttaaacgatgtattgttgtaccccccatcctgtgaccgataggaatctcctgcctgatagcgatttttaagaagctgaatatggcaaatgatgtcacagctttctcgcaggctattcggcaccgttacgccgcgttcgttcttgtcggacagcacatagacgaggtcgaacaacggtgatggagcatgggttactggaatggtcaatttgtcctcggtcatatgaagcggtgccgtaaacgtatactctggactctggatatagtccagctcccgcatgaaagcaacggacgttgcactactgtagccgaattggacagcctgatcgctttcattcaccaacacatacagatccatttgtaccgatttaaaagactgtgcaaaaatatactccgccaacagcgtaatttcagggattaatacgttcatggggtcatccgctgtcgtcaaaatcgacaaatggacacgctcgaacgaagaatacaaccgaccgtaatctgccagatgtccactagcccggcgcaacgcggtgttaagctcaattagctgcgattcatgtgtataaaaagcctgatgcaagtcacggcgtatcgtttggtggccactttcctccggtaccgctatcgtatgaacaatagcatccaccgaacgatctacagctgcatgttcttcctgcgagcggatctgaatatacgttactcccatgctgttatcccacttggtccggttgatatctgcaatggtgttcatcaccgggttcatgcgatcaccgataaaaagaaacacggacgggaaatggatgctgctgcgtccatccccgcttccgattaattggtcctctgcggctgcatagtcagccgcataacgtaacagctgctctctcatactttatttcaactttctgcggatgtcgtttaattttccagccatttgagcataaaatgcatatagttccgctccgttagccagctccaccttttcatattccaattgattgcgggcctctgtgtaagtcgcagccagttcatccagcttcgacagcagtggtgtaatatcctccgatgaagtcaatacagcatcacggcgatcggccttacgcattagagctgcaaatttcttttcttccaaaccacggaagtttgtaaacacttcaaactccacataattacggctcttcatgacattggcaaacggctcccaagcctcttcctcttcgtcacgatcatagacgtacaaagcaccttttttcgtaatcgtgtccgtatagagtgcctgaatgaactgatccagccatttttcttcatcctgatatttgcccagcaaagcttccagttcagctgctttcgcttcaatttgtgtatatttcgctagttcttcacgaaccacctgtgttaactctggtgaacggatcaggttttccttcgccatctcttcattgatgctgccaaagatgtccttgcttccggcctgctccagcccttcagccagcaaacgtttcaactcagaccatgctcttttcacctcacccaaattcggcttggattcctgcaagcgcatatcgtagcctgccagcatcgcattcagatctagcgcatgtgaacggattacagtgaagcggctgctcgtattttgatcgacatccttttcccgaatcacgccaagtgacttggcacggtcaaaatcattacgaatgcgggcattgtaagcttgcacacgcgaattgacgtaagtttcgccccatgacttttcaggaatcggcgacggaagattagtccagttgttctgacctgtttgtaccagatggcggccaataccttcgcggtcaagaatcgttttttcatagctttcttcatacactttgagcggcgtatatacaaacagaggaacaccattacgcgtattgagccagaaaatccggttacgaacttcactctctttaatagtaaagtgtgatttgccaattgcattattttgataattgcgaacgcctttcaggatattaggtgactgtacaggtactgaaacgaatccccatgacgggaagtacaagttgccagagctattactcagatgaaacacaggtacagcttcctcatccagtttgctcgcaatgtagcgctccacaaatttttcaatggcttcatcttgcccgtatttcatgacgaggaaatcttccatggaacgggtaatgagatcaccgaacttatcagtcaagaaattggagattgagctgatgatgtccatatcctgatccttcacccattgatctgaattttcgagcaattcttgggcaaaatcacgaatcaaatcatcaccgttgcggttatccagcagcttggtcacaacttcagaaatatccggtacacttaccagattccaatagtacgttttgttacctttgtgatcggactgttcctcgccgttaatcagcagatcgccattcttctcgaaaattgcgctcagcgcgttcaaaatttcagtaaatacattataaatgcggctattttccttgttcaacaagtcatacaggtcttcataaaactcaatgagctgctctgtacgttccacatcagcccgcagccaatattcattaattttcgcttcgatgtacgcatttttctttttatccttagacacaaacgcgctcttggcatcgcccagcttttcgttcgcctgctcacgtgcccattcaatgtccgttggaatacggtgcagtgattcacgcaacgtctcaacatatgaaagcagcattttcagcaagctaaatcctttttcagtataaatcatgcgggatacataaaacggcccttgctcaggatggagaaacatccggcgaatttgatccgtaaactgtcctgtaatttccccaggaagctgcttcttcgctttgatatactcttcgcgggcacgcgtcaggaacgtttgctccagctcggtgtccatattgaccacttgcattttaacgacattgctataacttaaccgttcactgttttcaaagcccggaagcggctcaggtacacgggattcaaagtttttgatcatgctatccagatccacgcccagcttgcgggcaaacttctctacatcctcttgatttggcgattgctcgaacattttggacattttgccaaacattcgataggccagatatgtcgtcatttcctccattggcagtaccgccgaggaagccccgataatattgtaatcgtagtttgccggatacgccttattcatttgtgcgatgttggtacggatattgctgatatagtcatgaatggcaaactcttcgcccgactgtttttcctcactcgccataaagttagtgatgttctcagcggtgacattcatgcagtaatcataagcattttccaacagcttgccttccgtattcgtggccgaaatgaggtggcacagattaaacggcggaagcggcgagttcacggtcaaaatgttgccgtactgctgcttaaagcgctcaccacggctgtctacgttcatccagtagtccagttctttcagtgcagcatagccgttctttttaatatattcacgggtatgctcgctcaggcttttgttcgccaaattaatatccggtgtaaacagataacctaatgtatttacacggtctacgcctgcagagccatagtcgcgctcaataattcctcggacgatatatgaaatatcgaggaaagtaccgcttcctgtaccgccggacaaaccggacagcaggaacaccataagcttcttgttggtgccttcagacagggttttgatttttttgtcaatgctttgtacgacctgattgattttggtgaacagcagcaatcgtcctgcctgccgcacccctgccgcaccattcataccatcggtaatgcttagttcgggagacagccaatcggtaatgtacggctcaagaatgctgcggttttgcagcaatccgccgatttccgcattggacagcaatacaaactcattgatggggtccaaaccaatccccttgtattttttgttgcggtcttgttcattcgtttcaaaagcgagaaattccacattgtccggtttatcgctctttttcttggaaatcggatctgctggaagcttgaatctacgattaatttgatatttcaagcggagaagggcatcgatccccgtgcctccgagtccgataattaaaataggattatcaatagtatcaactctgatcttatcgcttacgatccctccgccgagtgatacgtctaattgttggatatgctctctaactactggtttcatagatatgacctcctaagggttcgtttagctgtttactgaaataaactccagtaaaatggttttgtccacactggctaacggaatcgtcagacgatcaccgtttttgagttcaagaccgttgcctgtgtcaacagcccgtccggatttttcaatcgtaatctcgggggtactgcgcacaatgatacgatcctgattggctggtgtgaacacgaccttgtcggttccagcaaattccggtgccagttgcagcaactggtgcagattaaatttgccccggaaggtgttcagcttcttgtattgcggatacgttttttcgccggtattctcatcccggatttccagtacgatttgaccgacaaagccacggttggcctttttgacagccttccagatgaaatacgcggcaaccagcagaacgagcagtcccagccctaaaagaatgagtggcattagcttggacttttcagcaggtgttgttggctgcgtcgtgcccgtattcgtaccgctcgtcgcccctgctttagcactgatggttacaggctgtgtttcacggtaaaagctcttctcctctgctctaacggttagttcgtagtcatgctcatctggaatcgtataggaaccggtaaaagaatcccctgcattggttaacggcacctcattcgttgtaccggaatccagatccttgaccttcagaacagcattcatattcgcatacaattcctgatcctggagctgctggctattgctcgtcaggtaggaacgaatttgaactgcatcgccttttttgtatgatttggctgacggtgcgtccattttcagctccaaatcataattaaacaccagattaatatcaatctgatcctgctggactcccttgacttggagcttccagtcaccagccacaggcttaagcagtttaatcagcgagtagcttttggacttggacagcagcacatcgctcgaaggaattggcttggtgttgcccgacgggtctatcaatctcgcatccaccggttttgaggacatgatcgaaatgttagcctccagcacactatcgttcggtacggttaccgttacatcctgatagtcgccgtttgccgtaatggactgcaaaggcaccactttcaacttcaaattgctggcgaaaatttcactcaaaatgttcggcaggtcatccgctgagcttgtaataaaagatttgccgcccgtttgctgcgctatgtcggcgagcttgtttttattcagctttccatctgcattcaagccgatggtgtagattggaacgccgttattcttagcctcggctacagcctgtgccatatcctgatcggattggctttcggttttgcctgtcgtcttattaaaatcgttgttaccgtcggccagcatgacgatcataggcgcatgtccagctgttttaccatcttgcaaaatgcggatcgcttccttgacacccacggaggtgtcagtatacgcccctcggttcagtccgtcaataaacgtcttcagttcctgcttatccgcttcggatgtaatattaagcaaggctttctcgcgctgtacgacatccgtatacgctacaatcccgactttgtcattttgcgtcgacagcatatcaatgaacattttcatggcttcattgccaattttcccaggatcactggtgttcatcgaattacttacatcgacgaccagtaccgcatccaccttagaagcagagggtgaagcggcattcgccatctgtggctgccatgccaaaatcgaggtcatgatcattgtacatatgattccgatgaccaaaaaccattttctgtctctactaaacatcgcttgtacccctttgccagttaattctcattctaaattacagttgtactcccctactattaaattataatgagttttacatgagcgccagctgaaaatactgtccgaatggtctgaagccaaccaaaaagcctgttataccgcgtgattttaccaatatcctgcagtaatgatataattataccccaacaagggcaatcgggcaccagccttctcctttatacgacaaaaatgacagtagcgaaacccgcccatgtaaaatattgaagtaaaaatccaagtagaaagaggaagtacactatgatctcatacggatgtctggcgattatgtttctttttgtcgccatcaaatcactaatttactatatacataaaaaacgggccccgtcgattacacaaatcgacaccgagcttctagcactgctgaaccggagaagtgaacgcaatgaatagttccaaacaagctgtacaatttcgcccatttacccgcactgagcacgccttccaaaagctaagagtctgcaagcgttgtggacaattcactgccctttgggaagagaaatgcacatcatgtggtcgggatacactagttcctgtagagcaatatgccagactcagagccaaacgttattttcgtaaagaccttgctgtcagtgtcatattgctggccgctactgtctttttcggccactcaccgcaacaaatgcttttgtgcggtatcgtcggtgcgcttcttctgctgcccttagtacttctacagcagggtatttatccttatgaacagcgtaggcagcttatacgtctgttcagaggtcgtatagagcagatccaggaaggactaaacgttaatcataaaaacgcggttgccctgcggcaactcagtgagcgtgtctcctatgaaatgctgcgtgagatggctgtactcattcacaatgatcggataaggctccagcaggtcgccctgctgcaatctttcgttctccgcaaagacatggaattaacgctcgatcccctcctgatcaagagcttcgagccgcttatggtcagatatatcggagagattgccagactcaatcgtgagctgatcaaggaccggacattccgatacgtagtcttttatgaacgccgaattctggaattggcagggggcgaagatattctcgtccgcgtagccagtgcagctgtccgtaaaaagcgctacgtagtcacccatgccgctttcatttccagatatgtacgcaaactgccaaaggaacgagtccagcgtttatatcatatcattcaagagaatccgttagaaccctttggagatttggccgatgaagtaaagatcatgtacctgatggagcagtataaaagctaagctgccacaatacccttctttatatgacgtcatctcgatcacaaatcactgcaatgaaccagcaaaaaaccgtcaggatcgccaacgtgcctccagacggtttttttaattatggattattataacattgttatcttttttattggccttgcagtttctgctgcgcatgtcgaatggaagtaaagttaagagcacgcactcccttgctatcatacacaataatctctttattcaaatatgggtgtagaccattaaaatatccaggcataattagtctgcgcataaataggtttttacccagtatacggggtgaattggtcgctacaacaagcatttgctgggttgcagaccatgggctaggttgaatatatgacagacaatactcgcctgccgtaaagtcgtcgcccaatgtatacccttcctccgtacatgtaatttgcagatcggcctggtgcttttgaagcagctcatgtctggacaagcccgaagtgatacaaatcacgttgctatcagccagtgcttcctccgtaatatcattagaagacaccacgggataatgaacaccgatatacggattccaagttgctgttcgtgggctagccaaggcgttcgccgtccgtctcaccgcctgctcttcctccggtgtagcatagctggatggaaggacaatgtgaagacgatccatataaacgtcaagcacacccataccgtggctcaaaacgtttcttcccacgcttttcgagcccaccgttttcattttggcatccgattcttttgtaaagcatccactgctttcttcctcccgttcggcaatcaaacggtattcaggtgaggggcgtttatgtgactgtgttttaacaaagcgaaagcggctgtattcccgcaagtccaacacgaaaatacgggctccgatacgaacctgggccagctccaagggcatgacctcttgagaaagatgaatgataaattcttcggcgtgaaccgcctcgatatccaactcacctgtggcactcatttcaccgtacaactcagcatattcctcattttcatccattcgcgtcagttccagccagtaagcccggttatgtctcccccgttccgtccgataggcaatacgctgaggtacgacatctcttctccattgcataagccaacccagtacgccgtccagaagtctcagctcatgcgtatcccagtgattagactgccgctctacaacacctctaaaatgatcagatagaagctctgttacaggggctgtgtatgcttgtgcaaataagtaatcctgatctccgcatacattcaatattggcatattcaacagatttatcagatgcttaggatgtggcgctccagagataaccgcaatagccgcaaaccgagaaggataagcctgtgccatcgcccaggcagcatatgctccgttcgaataacccgtcagatagatccgctcttcgtccactcggtatgcttgcagtatgacatccagcgcctccaaaaaagcagcttctccaatataactgcccaacgttacaccacggcatgaaaaagtaacaaatatagcttcctcttcccagccttgcccaaaacctcgattctgaaaatccggcaaacccagctcatatcgcttgcctggcatcaggacgatcagaggatactgtcggtcagtcgagtagcttctgggaagctgaatggtatagcgttgcaaactattgtccaagcgggagacaaaaaatccttccccaattccgtcattagacaaaaaaatgtgttcttcttgaagtaaggatgggggctgtgactgttcggtatgtccattagtgaagatctgttttaatagcttgatatattcacgcacaatccggtaatcccagatttcaaaaggatcttccggcaaatccgttaacctttttaattcttcaagcaggccctctatttgtattttctgcgtagaaggaagaatatctatagcgcgggcttgaatgtaccggtcatactcttcctgcaagccctccacgacgactgacaaaggccgcacaagtgccgaatacacaaaatgatgctccacagcctcatgatcccgatatgtaacggtgaagtgcagcattcccgtattcctggccttttcctcatcccagtcatagctttgctcctgctcccaatgtgctggaaagcgatccaactttatgccttcatcattcgttacctcgacccataacgtttgatctaagggaagatctatccgatccttacgcagtaaataaaataagattgggctgtcttcaccctccctgccagcactattctcaacctctagccatgccatatgaaaacgtatattacggtctacaaattcacgatgcagttctgccacatctggttcgttacatacctgatttccactgatacgaatagagcgggcctcctcaggaataaacgcagcaatgataactaccgtgtgatcgccttcctccagatacaagcgaaaaggaccggattccgcatataccagtgtgccatctatccaaatttgtcccgttccttcaaagggtctgaaaatcacttcctgtccagccgtacaacgaagatttgaaaccagcaaaagcctttcttgttcggccaaaggcggaaaaacacctagattcagttccgcagtccgagggtctagctcggtcagtaatcggcacgctgcctttcctccggctgaaagctctattccttcttcaccacaagccttttccaaattccaatcctcatgggcaaaataattggaccattccctgcccacaccgcaattttccgggagcatgaccggaccgactgcataagcagacctcagacgtaccggatgatccgacagcacagttgttgctttttccagatgtgtgaacctcataacattccccctccaggtttttgtttcctcagagacgtagtcgcggttatatatcccgtttaacattcaattgaactatataaaactattcgttattacatctacgtactcctctgttcttctcaaaaaagtagctatgataaaaaaacaaaaaaaagaggcagcctcagctacctctcttgatcattacacttattttcttacaatgctgcctgcaagtcttcgatcaaatcttccagatcttcaatcccaaccgaaatccgcaccaaaccttcggtaatgcctaactctgcacgacgttctaccggaatagaggcgtgcgtcatacgtgccggaacgctaatcagactttcaaccgctcccaagctttcagctagtgtaaaatattttacctttttcagaagtgcaaccgcgttagcgtcactacctacatcaaaggaaatgatgccgccaaagccttcagcctgggttttggacagttcatgttgtgcatggctttccagtccagggtagtacactttgctaaccttcggatgtttttccaaaaaggctgcaatttccttcgcattttgctcaatcgcttccatacgcagacccaatgttttaataccgcggatcaataaccaagaatcctgcgggccgagaatagcaccaatggcgttttgcagaaaatgaagttgctctcccagctcgtcgctgttcacaacagccagaccggctacaacatcgctgtggccgcccaaatacttggtagcagagtgaatgacgatatcagccccaagtgtaattggcgtctgccaataaggggtagcaaatgtgttgtcgacgatcagtaaaagatcatgtttttttacaagctccgaaacagcacggatatcagtaaccttcaaaagcgggttcgttggcgtttcgacatacaatgccttcgtattcggacgaattgctttggagatggcttccaggtcagtcgtatccacaaatgtggattcaattccgatacggctgagcactttgcttacaatacggtaggtgcctccgtatacatcatcggtcagcaaaatatgatcccctgcgttaaacagtgaaaataccgcatgaatggctgccatacccgaaccgaaagcaaaaccacgctttccttcttccagatccttgatcagctcctccagagcaaaccgggtcggattgcctgtacgcgaatattcgtatcccttatggacgccaatttcctcttgctcataagtgcttacctgataaataggaacgttaaccgcgcctgtatggggatcggtaggaagcccaccgtgaatcagttttgttttgcgtttcattttatatcccgccttcatatatttttttgctcagataacgttcgctgctatccgggaaaatggtaacaatatgtgcgccatccggtgcattttctgcttccagtaaagcggcatgtaaagcagaccctgaagaactgccaacaagaagaccttcacgtgcagccagttccttgacacggtcaaaagcatcgacatcgctaatggtgtgaatggctttgaaatatcctttatccacaaattcagggattaattccatgccaattccttccgttttatgtgggcctgactcgccgccattcaaaatggacccttctggctccacgatgaccgttttaagggctgcattttgttccttaaggtaacgcgaggttcccataaacgttccccccgagcctgcacctgccacaaatacgtccactttgccgtccagatcgttccatatttcaggtcccattgtcgtatagtatgcctcgggattatccggattactgaattgccgtggcaagtatgcatcttttatttcagcagccaattcttttgttttttcgatagctcctttcatcccctcacttgtcggggtatgaacgatgcgtgctcccaatgccttcatcaggtcctgcttctcttggctgaacttctcaggcacagcaaaaataaccgagatattataatgaagcgctgccatcgcaagaccaatacctgcgttgcctgctgttgcttcaattaatgtcccccctggcttcagctgacctgtttttaatgctttttcaattagagccttccccacccgatccttaacactgccaccgggattcataaactccaacttcgcaaacaggcgaattcctctcggtagagaatagctgttcagctccactaatggcgtgcgtccgatgagttcaagggtattttgatatacattcataatttcaagctccttttaatggcgaatccaaaataaaccaatggtcaaaaattaacgcctattgtcggagaagttcgctatcatctccgagaaaacacagtaatacggtaagtattgatgcaataagattttatgtgtatttgaagcttttgtcaaatggaccagccacagtacccacaccccctgcctgcttgctcgatatgatagagaagatgtcacaaaatatccttgtgcaacataaggaggagttcatatatgggaaagcaatttctgaagatagctgccgtatattttgccctcagtgtgctgcttagtgtaattattggcttgtcgggtgatcacagcctatccaatgttcagtctcatacccatttactgggttggattgcacttggagttataggtctgatctatgtgacctttcctgcactttcagttactattctggcacatatccatttttggatgcataatatcggtctgcccgtgttgatattggcgattataggtgaaaattacaaggttccagaggctggagtttggatcgtcataggatgggtgttactcgccggggggactatgctgtttatggtgaatgtgtgggatagactgcgctaaagtaaataagttctcttcaatgggcataaaaataaggagcctgatcatgtcaggactccttgatatcttcattatatgttagctatataccagctttgctagctaagtgttctatactattacttcactgtttcatcctgtacatgttctttacagaaggtctcaacagcttgcaactcatcatcttcaagttcaagatcaatgtaacgattcgttactttttcaattaattcatactttagcagtcccgtcttttcttcgtctactaaataaagacaacggatatatagtccgttttcagtgtatagctcgtcgtcctcctccacctctacatcaatgataaattcataacgctgtccagtcaaaataccaaaagcatctttaatctgatctactgtgtacgttgtaaagttcaacatgtttttattccccccgggtttccttcaattacggtgcattctacgcccgcaggcagtagttgttcaacttgtgtacgtacttcttgacgactcaaatcctgacccatgatggatatccagccccgatcattacgcgagcgaattaaacgccctatgccttgtctgagtctaagtgccatgtgaggcatatctatctgaataaacggatctgctgcatccttgcgcagagccgtaaaaaccggatcattcggaggaaatggcagtgaccagataatcacgtgcgacagagaaggtccaggaatatccaatccttcccataatgtaacagcgcacaacacactttcctcatcattctgaaaagctgagatcagatggctgatttcagccgaaccttcgtacagaaaacgataggtagacgcctccgggtaggcaacgagacccgtctggaatgcagccagttcttcctgtgaaggaaacaggataagcgctcttccctgtgatttctccagcagtgccagtgctctcgggattggatcatcccccgcttgcaacgggtacagtgcagcttgcatctgatcgctgtagtcataaggtgaagcaacagaaaacgttagcggattttcaataccgagactctgcgccatatagtcaaaagagttctctacggaaagtgtagctgaagagaatacgatcggtatatgctgcgcaaatactcgttctttgagaatctcttttaccatcttcggcataaccacaagcgttaatccatcctgatcctccatcacccacgaaatgagaagttcaggacgcttaaacaaagccaacgcggtttgaatcatttccaaatgttcttccacaattttgacttgatactcatccaaagagaatagcccgctttcaaatacaagctcttcttcgatcgtgccgatcagttcaccaaagcggtttacctctcgaatcagtgactcattcagaatgaactccttgcgattagaaccctgtacaggctgactgttcttatcaagcgcagcgaacaaagcctcactttgggagatcgcatcttcgatcgtcattgccaaagattcccgtacttctccctccagcaatcgggtaattatagattcaaactgagcgtgcttaagcttgtaggtaagcgcattttgtgccgctgtctccagcaaatgcccttcgtcaaagacaacagagctgtgctccggcagcaacggcagctgaccctcgcgctttctcgcttcgtaggtccatacatgctccatataaaagtcatgagagcagatgaccagatctgccgctttacggtaatgatcacgagacaacgtctgaccgcaacgatgccgctgatggcaaacgagacagtcttgaaatacatcccatccgagtctgctccactgtccatctgttagctcgggatattcctttcggttcccgtaaggagtaaaggattgtaacgtatctggaaaatgaacaaaatccggcagttcctgataaatatcacggaaaacatctgcgtcctcatccagtccgcctcgtacctcatccagcttattcagacaaatatactgatccggcgacttccccaatctggcatcaatcgtcagattcaaatgctgtgccagcttggcaatatccccttccggctttaccaattgttcaattaacgattcgtccgcacaggcgataatcgccggttttctcatgtatcgagcatatgcaatagcgtacagcaggtatacgagcgttttaccagtgcccacacccgcttctgcaaaaatggtctttttttccttataggcacgttctagctggaatgccatataaatttgttcatcccgaacctcaaagccgacttcaggcaaaacttcataaaatacatccgcaatccagtcacttgcctgctcaataaacggcttggacggatcaaaggcaaaagggtaagtagtcaatcgggctgtgcctccaattcgttcataatgtgcatcctttcattataacgcaaaacaagctaaaaagaacatgaaaactgtaagaacagcttacattttttatttcgctataagaatccctttaaaataaagggacatacttttgtctgagtgagacgctacgtgtagcatttgatcctacgatcgctgttgccccgggattctcagattttcataaacctttaaaaggtaagaatcccatggcaaaggcgaacgctacgcttctccatattcaaatcctccactacgctgcacaccaccgtagtatcgttattttataaatgaaaaatgtcttgctttcctgacaaaaaaagtaaaacaccttaacaaaataaaaaaacaaataaccacctaatgtattgcaagcattagctggtttcttgttaattgaagaatatgcattaaacagaagctttggtgatctcctctaatacttacagaaaagacgattgctgctcatatcgctgcaattcttttttatgtacaacaaaggtgttggtacaaagatcgtggagtccctgttttttggcagtaaaagcaactacaatataaataatatgagcaattacaaaagaaatggctttaatccaataacgccctgaggcgtgtaaaaatccaaggcgttttccttccttgtccacgacaactaaagagaacgcaagcttacccggtgtagcctaaactttagatgattcccataaaccacaatacagccatggtagcaggagccaaagaatcagcggccacaacataagcagtacttgtatgaaacccgtctcctttatgcccagaagatctgggataatgtaaattgcgccccctattaaaaggactatggcagtaaggatgatcagatcaatcaaaaacgctgctgctcttatccaaaatcctccgtatattctttttgtactatcacttgttgctgtcatgatatgtatgactccttttgcaaatgagatttaaaatccagtttatccctttatccaagaagatatcatacggttacccacctatattgtcaatttacgagcaaatgctcttaaacaagtaaaaggacctatttccatgcatcaaaatgaaaattttcataggaattaagagcttatatacaatgatttttcttggattgggtacaaaacaagcgcagctatgatctcttaactacccataagtagtactttggcatcgaaataaatccagccttttcatgcataaaaaaacagcgtatatgtaaatgaaattacacacacgctgtctcacaattcattccgtaaatctgacaaattataggacgattaaaaatgagttcgttcttgcacgcttatacactatatttttttgcattcaacactaaacaaaccttcttcaccgcgcagctttgccaatgcctcgacaaagaaataatcgccatagataatgggaacgttgatgtatttttgctcaggataatgtacggtcccgttcaacagcaatccctcatgctcctcgccccacgctgtacacgtatgatgcaagccctcgaggatagattctgcagcttctgtaaaatgctccgcacgcgccgaatattttgctagctccagcaaaccactggccgcaattgccgcagccgatgaatcccatgccccgcggtgctcttcctctgctctaaaatcccacacaggcaggcaagcatcacccagctgggatagaaaaaaatcagccgtgttctcggccaccttcaaataacgcgaatcgcgcgtgtacccgtacgaaagcgtaaaaccatacaaagcccaagccgtgccgcgtgcccaggcagaaccgggagcaaatccctgtccgccatgctcggcgaccttttttccaatctccggatcgaattcgactacatgtgcgatagagccgtccgaacggacaaattcacgtgctatggtatctgcatgctgcacagcgagagcggcaaaacgcggatctccgctttcctccgaagcccaataaagcaagggtagattcatcatactgtctataatcgcaacgccccgtgtatccatgtccttcgaggggaagttccacgcgcgaataaaacggccattcacgttaaaacgggcagccagcagattggcagccaacaacccacgtcttctggactctgaatctccggtcatccgatgggcggccacaccgctgagcagccaaataaagccaagatcatggtctacagcttcgctattatagagtattttttccaaacgaccctcgcaccgctgtgcaatcccggcagccacactgtcaggacgcgcccgattgaccagccacagcagccccggataaaaacctgctgtccaccacgcttcttcacgattatcataacgtccaccctcagcaacatgtggaaaagcgtctcccagtcttgcggccaaggcaagcgtcttatccaaagccagctcccacgattgctccagccaagcttctgctttcgtcatttctttttcctctcctttttccacatattaaatcatatttatggctctagctctatttattcaggtaaccgaatgataaaggaaatgcggttgccttcacattccatacgcgctcccttaagtaacccattccgacaggccacggaagctaattcttccggccataccacgttcgttccttccgtcgtcgggatgacttcgaggcttgcacctgcgtattctactcgaatgctttccgtttcttccccggctgacatgacatgatgaataacgctgcgctcccgaccgtcatacgacattaagggaataagcgcccctacattctgaatattgccttgaagctcatacgccacttcaattttgccgggtacctgacgataatgcgttcggatttccctcactcccgggaacgggccttcccacaggagtgtaaaatccgttgctccgtcagacgctgagctttgttccatctgtacggttcctccaccatcctgcgggtcaatccctccatcccggtcgaactccagcgtaccgggaataccttccgacaagctgtgccactttccgtcctccgtttgccaggccggggtatagcttagcgggaaaatatctccctccgcgaagcctgtaaagccgcggtctgcatgacctgctgaggacggaccgatcagcgacggcagcgcagactgctgaatacgcacgatgcccggaacattgtacggatcgttgaccgatgtttgcacaagcatttgctgcccctctacggctgcaatgacagtctggaaccaaccgtccgttgccaacacccggctgccgatctccgccgggatgaaggttggggaaatgcgatccatctcctcaccatatagaagggtgtgggccagaacagccgccgtccacagactgtagcaggtatgattcgagtacacctcaaagccatgccgtgcctcggacgaataatggttgcggacgatatgcagcttgccgtcatcggtctgccaacggctaatcgcttgccagcatagatctgctgcccgtcggaacgcacctgcaagcccatgctctcctgccgtaatagcctgctgagcatgtgttgtaaagacaaaggcagcagccgcttcgttccactgatgctgcgcgcttcttccacgcggcggaatttccccgtgcggggatagcgccagtaatgtgctgagcgcccccctgcgaaggtggtcacgcagttcgagtgcgcagctgccatcatatccattctccagcatcacgcccaaatgaaaacgtgtaacaatatcgtaggcaaatgggctattgggccgatccagcggtccatcctggtacaggcccaaacccgtaaaacgaggcagatggtagctgcggatatatgtctccatccattccgaatcggctgcaattccttccgctgcacgcaaaaactcgccggaaatcataatcgcattccagttgatcatccgattcgggtttttcattttgctcatcgtaaaaatgtaggtctgctccggctgaattctgctcagttgttgcttccatgccgtggcttgctctggcagcagatttttaaggagccgatacgcgcccatcatcataattggaaaaaagtctgggtggtgatctggagctttttcctccactacacaagctatgctatgcgtcaaggccgcagcagcagattccagtaaatcatgccggccttctttgaccaacaccgccgctgccaacgcataggacggggtggagtagtaccgttcactttcagaatgggggtcaatgatagctccggtatcatcctgatgcagggcatatgcgcgaaccagcttttccagcacggccagcttacgttggtgagtccatccgtcattcactcgatttggcgcgctttccacctgttctataaatctctccaactccgtctgccaagggtacacgctgcctgtctgcagcttattcatcctgtctgcctcccattcaaaatgaaaattaatgtatggtaaaaaacagattgcaatctacgcttgcagaatcgctccagtgattggagtctagttgcagcgatgttttataaaacacaaagggagctccgtcatgatctatgtgcttcacagcctccaaccccgaccgcagcacgccggcatcataatctagcctgacgactgcgttcgctcccttccattctacgaagcctgttcccagattaggctgaatacagctgatgaaaaactcctccacattccatgatttcatgctcacgccagacgtttcaaactcaaagtgatcggtgacggtaagccttgccccctcgtttccctccagcacattccatataaaggagcgggtgaagaccgccaattcttctacgggataagcagatgtcaagtcaagcttaagccttgtgcccgtctgtacctcctcctgcttatccaaagcaatatccagcacaaccgcctttgcctttgcgcccgattgctgtaaagtcccattgatgacaggcacggaatgaccaccagaggagatattaataattgactctcgtcccggtgaaaaataggctttcgtgtacaagcctgctcccagatcacacaatagattttcgccaccgccatgaaggataaaatgtccaagatcgttatgattgtgcggttcattgttatgcccagccttcgctgaaaaagcaagcatgacacctgattcacccttttggcttctgggtccactatggctggaactgcggctacggcacatcagccaaccgagttggggcaaataattggcaacggtctcaccgctcccaaatgccaaagaattcgtccacaccaggttacgcaatacatgagcccagcggcgacaggggtcttccaacagaccaggtacgcggaaagggagtatagatggtcgttcttgcaatgaattcaaatgagagatgagtccggaaggcaatcgttcagtttcactactgtccgaataattagcgaaaattccattcgacagatgaacccgctccccaaaggctgcaatttgcctaatctttttcgagttcagaatatccacagctccctcggtaaactcacgcagcatatcggcaaaataaatgaaataaccaaagccgtacacccagtatcctacgccttcggggcatcccccgtcctcactatagcctgccaaaaaacaatccagcgcgcccagcatactctcgatggctaccgctctggaagagtcatcttctaccagcagcagtgctacaattccgcaaccggaagcacatactgccgaccagttatgatctgcggtttcccatccaaaatgacgaggcttccaaaaaacaggttccagtacacgacgttcgatctcttcgtgcacctgagcgaccacatggctagccagttgttctcctagcagcaataaaatttcaaccagcgtttgtgctgtttcggacgcgaataaatccacctgctgccaaggcggtgttacggtgtcctcttcattgacatgtgcaggaagcgcccatgtgtactcactgcatatgtccagcagactgctttccacctctttcatcttttgaggctccggcttgacaacagcttccagcactatagcaaccagtcgtccacgccgttcaaagtacacatcctcatacggcttgcgctctcctgtattagcaaattgccgaaacagagacaacggcagttcaggccatgatatttcccgattatctctacagacacgctcaatatccatccaaagctcggcgtatatcggctcagagacagtcgtccgtagcctttttgtccaattactccttaaccgttgccttgctgaatcctgcatgccgccagccagcgccttaacgagccgcgaagcaggccaagcctccctcagaagactcatctgcatttcctcctcatgagaagcatttgtttcaccttcttttttgttaacgctttcattgtatctaacaatcattgtaaattcaaaggggtagcaaaacaattgagaaaaaataaaagaacctctatgccccgttgccgtggtcatggaagttcttgttttacactagtgccaatctccgtccagattcgctttgatcatgttttctaaactgtgggtttctcttgtttccactttctaatcccgtcatcctccagaatacccagtgctgcatctgagatattaggatcacgcagcaaagcgtcctcgactctaaatttaatatcgtcagcatctgccagcgtcatgcccggcgtaagctcaatcaacccttccacgtgataatagcgtccctcctgtaaaatacgcatttgataaatatccgtaacatgcgtatctgcgagaataatggaagccacacgttcttcgatatcaggaggagcagatacaccgatcaaacctaccatgttgtcgtaaccgacccggaaagcaacacccaccatcagacaaccgatgagaatacttgaaatgccgtccagcagtttaaaatctgtcagcgatgtgaccaccactgctagcaaagcgagtactccacccgttgttgctaccaaatcttcataaaacaccagccgggttggcggtgcagcacgccccacatggcggaacgcagaggtgaaaatgcctacccccttcgcttctactctggattcatgcagcacttctttcatcgctttgctccatacaaatccgtccaccactagtgacaaaatcagcactattacattaatccaaaatccatgtgtagattcagccggatgctgcagcaaatgaatgccttccaatgcggtttcataggccataatcgttacgacaataacggcaaccatacagaacaggttaatcactcgtccaaagccggtaggaaagcgttttgtcggttttttctctgccagtacactgcccgcgaatacaaacatttgattcactgcatccgcaatggaatgcatcatcgtagcaaacatagaaccgctgcctgtcaaggcaaaagcaatccccttaatcaaggcaatgccggtattccctaacgccgccgagcccgaggatttgtttccttttttgaccatactccaaaaggagtcctctctctctttcacttccatcttgtagctcctcctgaggtatacataatctgatatattatcgtttgttatgtattatttttaacccgtccatattctacctaaccatctgaggagaatcaatacaaacgataatattttccatggaaaaggaatgccccatgtcccctacgacatgaagcattcccgttacaaccttctatcagacataccctcaggttaacaacacagataatctccatgcgctgacgattgacataagtgcctatttaccagcttgatttcgtaattcctggaatttggcctttatgtgccaactcgcgaaacgcgatacgagacagcttgaatttgcgcaagtatcctctgggtctgcctgtcagctcgcaacggcttttcaggcgggttggagatgagtcacgcggaagcttttgcaaagcttcgtagttcccttttgctttcaattcacgtctcaggtccgcatatttagctacaatttcctggcgtttcttctcttttacgacttttgacttcttggccatgtaaagctcctccttgtgatatatgccaatcatgaaggttcaccctcactaccgcgagatggatgaacacggatatggacttgatttcacatattaaatagtaatcattacgattaatatttaatataacgtgctccaggtaggttgtcaacccaagcggtttgaatcacaacattaaaaagccgttgaaacagtagccccgttcactcttgtgatcggtctgccgtttcaacggctttaaaatttattgactagctatgttcattcagccaaatggcaagctacccagtgatctggacgagcctcacgatagagtggaatctctttggagcaacgatcgattgcaaaggggcagcgagtatggaacttgcagcccgaaggcggattaaccggactaggaatatcccccttgagcaaaatacgttctctcttcagcttcggcaccggaataggtacagccgacagcaacgccttcgtatacggatgcaacggattcccgaatagctcgtcacgcgatgccgtttcgaccatggagcctaaatacatcacgccaatacgggaacacaaatgttccaccacgctcaaatcatgcgagatgaacaaatatgtcagaccccgttcggcctgcaatttggcgaataggttaataatctgcgcctgtatggacacatccagcgctgataccggctcatcagcgataattagatccggctgaagcgccagcgctcgggcaatgccgatccgttggcgttgacctcccgaaaattcatggggaaaacggtcgatatgatactctgacaatccacatagcttgagcacgtccagcacaatctgccggacctcctccttcgttgctatatcgtgatccagtagcgcctcaccaatggcatcaccaatccgtacacgcggattcagcgagctatatgggtcttgaaagatcagctgaattttgggacgaagttcctgcatccctttggcagacaagctgtgcagatccacccctttgtattttacggtaccgtccgttttatccgtcaatctaacaatcgtgcggcccaccgtgcttttaccgctccccgattcccctaccaatccgaaagtttcaccctgacggatcgtaaagctgatatcgtctactgcccgcacatgtcctgaagtacggttcataaacccggacttcaccggaaagtacgtttttaagcggtctatttccaacaacggctcagccatgaacaaccgcctcctcatataaccagcaggatgctttctgctgagctgaaacttcctttaatgtaggctcctttacacgacaaatgtccatgcaatgcccacagcggtcgtgaaaataacaggaagtcgtcagctccagcggattagggacctgcccgggaatggaatacagttcctcttggcgctgattaagcaccggtttggattttagtaacccttgtgtataaggatgcttgggatgattaaacagctgtaccacttcgccttcctcgacgatcttgcctgcatacatcacaatgacgtaatcagccatttcggcgacaacacccagatcgtgggtgattagcatgagcgacatattggattgagctttaaactcacgcagcatatccagaatttgcgcctgaatcgttacatccagcgccgtggttggctcatccgcaataagcagcttgggaccgcaagaaacagcaatggcaatcataattcgctgtagcatccccccgctcagttcatgcggatagctttttaaaatctgctccggccgggatataccgacctgttcgatcagctccagtgcccgcttacgagcttcctttcgtcccatctttaaatgctcaatcagcggctctgacagttgttcgccaatggtcatgactggattcaatgaagacatcggctcctgaaagatcatggagatttcatgtccgcgaattgtgcgcatctcatttctgctaagctctagtagatcggtttcctcaaagcggatgcttccgcctgccactttaccaccaggactctggatcagacccatgatcgacatcgcggtaatacttttgccgcagcccgattcaccgacaatgcataccgtttcccccggcttcacacggaagctgatatcatccaccgctttaaccgttccttcttctgtataaaaatgagtgcttaaatgttcaatggaaagtaaattgtccatggtgtatgatcacctacctcttatgtttcgggtcaagtacatccctcagcccgtcaccaaaaatattaatagcgatgacagtagcaaaaatagacaggcctggcggtatccacaaccaaggtcgttgctgaaaatccagcacattgttggcggcatcaatcatattgccccaagtcggtgtcgtgggcagcacaccaagaccaaagaagctgagtacagattcactcaggatggctccgccaatattcaacgtagcaataacgatcaacaacggcaaaatattcggcagcagatgcttgaacagctttcggcgattcgatagtcccagtactgttgcggcctgcataaattcacgttcccgtaaactaagcatctggcccctcaccatccgtgcaatccccggccaattgaccagactaagcatcagcatgacaatatacatccgttgatcgggtggaaccttccagtccgatagcagcgcgcccataataaatagcaacggcaaactgggaatcgtcagcagcaaatcagcaacgcgcataatgatctgatccgcaatcccgcgaaaatatgcggatatgacccccagcgtagcccccaaaaagactgacaataccattgaagccaaacccacggtaagagaaatttgacctgcctgcatcacacgtgtcagcacatcccgccccagtttgtctgttcctaaccagtgatggatattgggcgccttgttcatcattaatatatttgttttattatcggaataaggagaacataacggaccgataaaacaaagcaaaaacataaataccacgacgagcagaccagccatagcaagcttgtttttgaacagctgccggagcgcttgctgccacattgaagatttaacagttgttcgcagtctgccgttgctcttgctcaaattactgctcacggatgacattccttagcccccttcttacactttcacacgcgggtccgcgatgcgatacaaaatatcggacaacagtgttccgataacgctcaaaatggcaattagcatcgtaaagcccataagtagcggataatcccggagcgaaaaggattgcatgtacaactgaccgattcccggccaattaaaaatcttttcaataatcagggacccgccaaacagtgcaggtaattcgaagccaacgagcgtaatagcaggcagtaatgcattcctcaatgcatgcgtaaaaagtacctttctttcctttaagccctttgcacgggctgtgcgtatataatcctgctggatcacgtcgatcatattgctacggaagtagcgggtcaacgaccccagtcccagcagcgtcataacgatcactggcaaggtcatatgctggagaacctccttcacatattccatacctgtagcgttactgcccgtattgagcatgccaccgggtggcaaccacttcaggtcaaccgctgcaattttaatcagatacaacccgataaaaaaggagggcacagacatggcagcgaaaatcaccaccattaccaaagtatcaaaccatgaatactgcttataagcagcaaccacaccgataatgaccgcgataaaccaggtcaggaaggtcgatacaacggccaacaaaaacgagttccagatatactcattaaataaggtcagcaccggcttctgctgggcaagcgaataaccaaaatttccatgcaacgcattgcccagccaatttccatagcgttcaagaataggcttattcaggccgtaaattcccctcagctccgcctttctctctggcgacagcttcagattgccgctaatgaaatctcccggtgtcatggcatacaggaaaaaaatcatcatcgaagcggccaacaaaataataactatatacgtcagtcttttcgttaaaaacgagctcatgacagactcctttcaattcaaggtcaggctactcattacgtttcccccatttgcgaggccccttgatccgaacctggtgttcttcacaaggggcccgcaaatgtggcttatttaagggaccattcgaacagattaccagacaagccaatgaacggactgacctttacatgttccatccgaccattgtaggcatacaccgtcttcttatagttggtaaaaataacgggcagttcatcgtttagcagcacatataattcttgatatattttcttccgttcttccatattcgtcgtagacaagcctttttcatatagctcttttacctttggattgttatatcccttgacttctccattgacgaattgctcgattccatctgatggatctgtcagcatgcctgtcgagaaggcggcaagatcataatctttaccttccactttggcgaccattgcattaaagtctgcaaagatttccggttgaaggtcaacaccaattgctttgtaattttcagccgcaagcgcaataaaggtgtctgtttctggacgtttagaggtcaacaggtgaatggtcagcttctgtccgtttttctcacggataccgtcactaccttctacccaacccgcttcatccagcagctttttcgcttgctccgggtcgtagttgtatggattgattccatcggtcgtgtaagaccagaatattggggaagctggaatgtttgcgaccgcccctgctccctgagctgcgtcaacataaatgcttttccgatccagtccataggtcaatgcttgacgaacctttttatccttaagcttttcattttcaagattcacttgcaaatatccgtaagtgctaggggtataaggcaaaatgtttaaaaagccaagcccttttagtttgtcgatattttcctgcgttgcggtgaattgagcaaaatcggtatcgcctgtttctatgaattgccaagcgtcgccttctgctgttttgtaaatgaaatgctgtgttttcggtttgcctttgaaaaagtaatcattcgcctccagacgaacttcttgccccggaatgaatttttctaacttataagccccatttcccagagggctactatgtaaatttttaaaataatccagctctccgaacttgtaatccttgccgtagtaggctttggacagtacatactcacccagaatcggcaaagcaagcgcgtttggtttttccaacgtcgcagaaatggtctgctcatcaatcaccttgattcctgcaatttgttttgccttgccttccgcatagtctttgccgcctttaatgttcagctttcggatttggctgtcaccaggataggctttgtcatagatcaacgtccaggtaaaagcgacatcctcagctgtcaaaggagagccatcactgaattttgtaccgggaaccagatgaaacgtatacgttagattatccttggaaatatcccagctcttagccaaattgggcaccggaagccccttctcgtctaccgtgaccagcggagtccacaactgcgaaatcacgttgccgtcatagccgctttggttaaaatacggagtaaacaccccagctgggtcagtcagaccaacaataatcgtgtcgcttctcttttgggacacttccggcaatttggttaaatcagaagcttgtaccagacttgttaatggctgcgctgtagtggctgtctgtgcggcatcactattttgcgaagtagcatcgctagcgctatctgatccaccactagagcaagctgctaataaggtagaacttgccagaagtagactgctgagtagaatgattccctttttcaaaataatccccccaagttaatttagtaaattccgatcgaacaagttgtaattaataagataaatctcattataggaatctattccggttctgtaaagagagaactccatttttatgtaaaaaaatagacgtccactcatctggattccaaatggtcggcgtctatttgtttaaagtgttaaagtctaactggtgcgtgcagcctaatttcgctccatatagccagtaatgctccgatgcatttcatccacagccgaaagccgtgcgctatagccgagcaatgtttcaccatcaaaatgtgcatggatgaagccagaggcacgaagcttaaaaatatggtcgtgcgtgattcccttggacagcttgagataacggacaatctcaataaaggtgcgtggagactggctttggtacaaatattttaaaatcttgagcctgctcttctcccccaagcttcggatcattcgatattcctgtggggataaaaaatcgtcctcctgaacataaattcctgccgagtaatggcacaacaggagcgacccaaatcgataaataatatttatcggctgaaaatgatattgcggtaccagcaacacctgcgttaacccttcggaaggctcgaatcggaagccattagttgtacgatccacccactccatagagctatatgcgcccttctccagatttctgcgttccgcttcctgtttcagcccgcttagaatccttgtatccacatgacgaaaatactctttatcccaaccggatagcagctgcaaagcaagtttgcgaagcttctccatgtcgtcaggcagcggtatcccataggctgatgcctgttcgtttaattcctgtacagttcggttctccagacggtctacgacctcttcaacgttcccctgatcagaaagcatacagacgagtccataaataaccttccaatctgcattgatttccatggactccagcaattcagacaaacctggagacagcgttccacgcacttgctccgcccacccggctgataaatcggtcttcttgtaagccttgcggcaaataaaggtgtgtaagctgctgagcaactcaaacaccggtccatatgctacatgtacatcgtaaggagcattcacgtcgtgactcatcgctttctgtcctcttttctttcatatctgatgtccattatacatactatcgtacacccgttcattcttagtgatccattcatacgagaatgtagcaaaacacagatacaaatatgaacgtaacaagcatcataatcaaggcgcaaaaaaagccggatctcatcagactctaactgttcagctatgaattagaaaaggttgtctcccataaataatcgcaggagacaacctttggacaaataatatgatgtttaaagtttgttagctgctactttccactctaatattcctgtggatgctgaacctttggataccatttcaattcttaatttcgttgtttttacaggcgtaaaagtagttgtattatactggtctgccgaagtacccaatccattagcctgcttgacattagaccagctgcgaccattccaatacttaatcttgtaagatttaggaacatcaacgccagcgccatcttggaaccaatagacatccgtttgggataacgtatattcttgatcaaaatcatattggacccattgtgtacccgtctcaggccagttaccatacacggcatgacttcgatcattagagctggttgggtcaaatccatcattaagcgcgctcacattttcccaaggcgaagtataagaagtgctgaccgttgcagctggtgcaatgtttacgttttcatcaggtgatggatcgatgggaccctcatcgccgttagtcacgcttgggaaacgagaagtatcttttttgagctgactccaggtataacgcagcatccagatatcccagtcggtgatatgatcggaattaccggcccacataatagtgttcgttgggaatccacctggtggacgctcatgttcttcataaaaatcgtttaatccaaatccatgcccaatttcatgttcagtaatctcaatctcatccgaattcaccgtactcagaacgtattcatcattcatacgctgtccccagtcgccgccggctcccccgccaaaattttctgtggcccagagatacatatcaaagcgtttatccaatccacccggatacgaatagttcgggtccgaaaaatgctcaaatcgcgatatttcattaggtgcaacgggaagcgcagcaggaatttccggtttttcagaagctagtgtatctgtaatggtatccgtataaatgacctcgtcaggctgcttgtctaggagcagtgaaggatcggcaacagcccagcctaccacttttactttaatattcttatagggccagccgtcatatccttgaagatgatctgtccaatggttcatctgccgatctatcattctagcaatatcctggcgttgcttcagtgtaacgggcttagaggattgccagcgtataacataattaagagtcccttttcccgcaaaaatttgatcaaaaatcgtatttttacgcgccgtcgagccttcggtcaacattctattcttccaaacccattccaccgatgatttgagataagctggcatgtcagccaatgtcgaatcacccgttgccgcaattacagaatccccgtttagatgagaatccgctgatacaaaactagcgtttcccatcagtagtgaactagcaatgactactgaaaaagaagccatcaccattccttttctgttcagcatgtatgtacctccatatccatttgtcttattgcagtagttttcttgaaacgatgatctctatcacctctcttttcgcatttacgaacaaatctaagagatcaagagtacactatcaaacctccttgtcgttttttgtaaataatcacaaatcatattatcactggattattgcatcgtcaatattttccttaatgatttaaattagtcattttaatcgtatcttggaatatacacataccctttgcatgtacaaaactagtattttataaaatgaaaaaaccgtttattcactaaatcaattccacaatccccgctggctccgccttatcataccctttcaactgcttattccaattattgatttgccgactcagcatggaagccatatctttacgctgctgaagagtgatatttttaaaggattgccaacgcactacataaatttagcgttccttttcccgcatagatttgaccaaaaatcaaatttttacggttggttgagctaccttttatttttacgagacatctaaaaggacaacgcttactctcttattacacccactcttgatttttaataaaatcacaaaattatactataattggaatgatacagcgtcaaacaaaaatatcccctctacaaggaggggatcagtatccatagactaggctcgcactcctactctatggatatcaatgccgaatctgccagtgaagccagtagcttcgctgttccgggcaacgcgcgttcgtccagatcaaaggcaggatgatgccattcctggcttcccgcagtgccaacaaagacaaatacaccggggatgttcttctgataaaacccaaaatcctcgctcgccgacgatggtatggaacgaactacgtccagaccgaccaattctgccgcctcctccgcgatgacggccaacttaccgtcgttcagcacaggcggcggaccctcgatccagcggatggtcgctttcgtgccgaaagcatcggcaacgccttttacgacctgctcgaagcgctcagtcacctgggcgcgaacattctcgtcaaatgtgcgaatggttccgtccaaatgggcacggtctggaatgatgttccaggcgttgccactgtgcagcttcgtgacgctaatgaccgcgctatccagcggattaacgctccgactcacaatggattgcagcgccgtaatgatatgtgacgataccacgatggggtcaatccctgcatgcggcactgccgcatgtgtgctcagaccctccacctcgatgtaaaaaccgtctgccgctgccattagcggaccttctttgatgccgaccgtgcctacgggcaggtccggcttgttatgcaggccaaatatggcctgcacccctgccaacgcaccgctgtccagcacttgggcagcgcctttggccttttcctcggctggctggaacaccagccgaaccgtgcctttcagctcctgctcccgctgcttcaggagtatggctgctcctaacagggatgcggtatgaaaatcatgcccacaggcatgcattttgccgggatgcaccgaagcataaggcaatcccgtctcctcctgaatgggcaacgcatcaatgtctgcacgaagcgcgacagttggcccttcctggtgtccgccgatttccgcaactaatccggtacgcagcggcacatccagaatggttatgttctgttcttccagcagacggcggataaaggcggtagtttcaacctcctcgttagatagctcgggatttcgatgcagatggcggcgaatgtccaccagcttctgctccaaatcctgctccttcgtcccggttgatccactcatccctattcctccttcgtgaacccaaaatagttacaattctctcagaccaacaacatctaggactgcacaggcaatccggcaaaagcttcatgcaacaactcgaacgatcgcacacgcttgtgtatatctcttattcctgtcgttacgatcagctcatcggcctgatacttcgcttgaatttccgtcagcacagcatagatttcgtctttattccctttgttaatttgcgcttgtgtagcttcaattgtatattcttcacccgattgcttgccaaactcttctgcactttccagcgtgcccaccgtagccgtcttgccactggccagatgaattttgtacagcttgtgctcacctgctaactctgcagcttcctcggaagtgtccgctacgatgactgaaagcgcaaaaagagctttcggctcacgtccataactataatcgaaagacgcccgatacgtacggaatgattccaatgcaacctgctcattactattgataaattgcgagaaaacgtagggcaaccccaagcgcgcagcaattccagcactgtctgtacttgtacccaaaacgtaaatatccgctggtatttctggaatcggattcgcctgtaacccggctaacggtccttcttcagacggaatattatgaatatagcgacttacttcatcaattttttcttcgagagaaggcgcatcatgaatgtttcgttgtaacgcctgtgtggatttcggcaacccgcccggtgcgcgtccgattcccaaatctacgcgacccggtgcaagagaggacagcacattaaagttttcagctactttataagggctgtaatgctgaagcatcactccaccagaaccgactttaatacgttcagtgcgtgccagcaaatgggaaatgagtacctctggcgaagagcccgcaacctgctcggaatcgtgatgctctgatacccagaagcgcgtaaatcccaattcctctacacgctgtgctagcttaatcgtattacgaagggcctgcgctgccgtttccccctcgtgtatagggctttgatccaatactccgattttaatactcatatctccctctcccgtctaaattgaatagttatattccggtgtaattcgtttcagaaattgtttggtacgttcctctttggggtggttaaaaatgtcgtccggtgtgccttcctcgataatatgaccgccatccataaataccacatgatttgaaacatcgcgcgcaaagcccatttcatgtgtaacgacaatcatcgtaatgccttccttcgcaatcttgcggatcaccgacagcacctcacccaccaattcagggtccagcgccgaagtcggctcatcgaacaaaatcacttccgggttcagcgccaaagcacgcgctatgccgacacgctgctgctgcccgccagacagctggcttggataatgattcagcttttcacccagaccgaccttttccagcacctcaatgctgatttttttcgcttcctcctgcttgaccttgcggacaacgacaagtccttccatgacattttccagtgctgttttatgcttgaacaaattgtattgctggaaaaccatagccgtcttttgacgtagagccaaaacatccctctttgcaggtcgcttgcagttcactgtaaaatcgccaatgctgacttccccatcattcggcttttccagataattaatgcagcgtagcagagtcgttttacctgaaccgctcgggcctaaaataacgacgacctcgcctttgttcacggtcaaatcaatgcctttgagcacttcatgtttgccgaacgacttcgtaatattttgcagacggatcatgatgctcgacctccattaaacacattgatttttttctccaccaagccggatattcgttcaatcaataccgtcaagccccaaaatagcagtgcagctgcaatatatacctctaaatatttccagttggtagatgccagaatttcagcctgtgcctggatttctgtgaccgaaaccgtgaaggccaaggtagagccatgaagcatcccaataacggaattcgtcaggtttggcaaactcaccacgaacgcctgcggaaatacaatccgtctcagcacttgccacgtcgtcataccgacggcatatgccgcctcgatttgtcccttgttgaccgattgaattccagaacggacgacctcagacatatacgcgccactggtaatagaaaacgaaatgagtgcaaataccatataaggaacatctttggattgcagcggccagccgaaatgcttcgctcccgcatcaatcaacaaaggcaaactgaaataaataagcagcaaatgcatcagcatcggtgtgccacggataaaggtaacgtaaccgtgagaaatctgggacaacacaggaaccttatagattcgcgccagcgccgttataataccgatgaccaaccctgccagtacggaaaccaccgtaataattaaggtgttgggcaacgcggagaacaaccctaaaaaggcagtatatataaagccaaaatccagactcatatgcctttacctcctttactaagacggggacttctcaggtaacgcaccacaaagctttttcgtttttcgggttctttctgtactacatcccgatgctcatgccggagaagcgtattttccagcaccttgaacaatttttgtaaaatcagactgatcaccagatagataagggataacgcgatataggtttcaacaaaatgttgggtagccgaccctaatgtctgtgatttccctgtcatctccatcgctccgatcgtaaatgccagcgaagtatccttcagattgccaatcaccagattggaaaataccggaaccacgacagccagcgcttgcggcataatgatacgtgtaaaggtctgatagcctgacatgccgacggactgtgcagcctcgatttgtccccgatcaacagcctctactcctgacctgataatttcggaaataaaggctccactattgagcgcgtaggttgctacggcaaaccacagcacatcccatctggaggaattgatatccaccagctttagtagctccggcaggccgtaatacaccagaaacaattggattagaataggtgttccgcgaaaaaaggaaacatacacttgagaaacacgtttgagaaatggaatgttatacatgcgaggcagcgcaaccaacagaccaatgataagccccaatacaagcgagcttgccacaataaacaaggtgatgtgtaagtaagacagcattttcgggataaagctaaaaacatagtcaatattgaactctctgctcatatgcctgcctcctttctatacatcagcggccagaatacatagagtaccctgaccgctgaaatgtccacgtctatccttacttcttactgctgctaccttcttttttcacatcttccagagacttagtgaaatcctctccaagccatttaatgctcagcttcgacagcgtaccgtcgtccttcacttcctgaatggctttgtcgaggtcatccgccaacccttgttcatttttgttcagtacatacagtacatccgattgagtcaaaggatcaccaacggttttcagagctacttctcctttttcatcggtgttaaaacggttcgcaaagtctgtcgtaacggtagcatctatacggccgctcgtaatttgttgcaccgtatcattggctgcaccactcgtataaacgatatttagggcatctgcgtgggttttgttatactctttcagcacatacgccgcattactggttgggctggtgagtacctttttccctttcaaatcatcaattgaatgaatggtattgttatccttcgctacagcgactctgttcagaaaaatgctatacggatttttgttgaacagatacttggcctcgcgctccggttttttttccatttgatgcgataccagatcaatcttgccggcatcgagacttagcagcaaatttccaaagtccatcgttttgaattcaaattcgtattgaggcaggcgcttgtccagctccttaatcagctccacatcaaaacctgttaaatttccgttttcgtcaataaaacatacatttttgaattgagtgcctgtgcctacgataattttcttcacgtctccgcttgaacctgacgcgctagacgcgttatctgaggaaccgcagcctgccaacaccaggatgattgccataacagacaatattgcaaaccactttttcatatgaatccccctcatctctttgtatatcagcagtttgcgacatacatggtagctacaacatccaataattaataattcctataagtttaattggttttaggatgtgattaatttaacacctggaaacctatacgtcaatccatcaagccatagaacttttctataacaaaacagcaccccggaaaccttctgtcagtgcatctgcaaaatccgaggtcactgcacagtcttctttggtcgctattatgctaatctgcatcgacaccccagctacctctggaacatggacacggaacagtttctgatcttttacttcacggttcacacagacatccggcaaaaaggcaatacccgcttcctccaataccagctttttggccgtgaccacattgtctacctgaaaagcaatgtccggtggctgctccagtgattcaaaagcgcgatggattctcatccaatctaatgatccgcattcaaaaaacaccagtgtttcacgttgaatatcctgtatgctggcctttcctgtcttcataaacggatggccgtcgtatacatacagggaaatcggatcttcataaaaagcaagcgtacggatagccggatgcatcactttacggacaaaactaatgtctacctcacggttcaacagtttatgtaccagttgatccgtcgtagccgtcacaattttgtagttaacctctggataacgggcacgaagctgctttaatatttcaggaatgatgtagttcgacaccgatatcgtgcaaccaattcgaatttgctgaggggctttcttacgctgttggagcttttgtttccctttttgcagcacctgaagcatctgctccgcataaggaagaaactttcgtccatcctccgtcagaaccgtttgcttgctttggcggtcgaacaacttgcattctagctcgcgctctagcgtctgaatccgggctgtaacagagggctgggacaagaacaaggcttctgcagccttattaaagctcccataatgattcacgtatacaaaggcttccatattctcgatattcatacgcaagtcccccagtaagttttatatacatttatccaataagttaacttggtttttgtatcataaaactcactgaacgacctgtcaatggaaatattgaaaatatctataattttaatagctcatttagttctttaacagaacgttccaaccgtgcaaccaattcttccgacaacccgtatgctccatctggcagacgttcgacccactgatccactgcatacaccccgccaagaatatgtcttccgcccagtgcattaataaccggcttcaaggcatagtcaatgaccagcaggtgagccagtgtacctccgataaataaaggcaagactggtttccctcttagcccctcctgcggaaccaaatccaggaatattttcaatagccctgaataggacgccttatagactggagaagccacaataacggcatccgctgctgcaatcaatgcaagtgatgctgtgacgtcggggctgttaaagttagctgtgaccagatcctccgctggcaagtcgaccacattcagtaatgtgacctccgctccagcctgctgcaactgctccgttgtatagttaatcaagccgtataaacgggattgtgtagacggactgcctgataggatgacaaccttggacatatttttccctccttctgttatgcgtcaaccttcactttggatctggctgctgtatagcggttctcaggaataggcacgcccaggttttcacgcagtgtgctaaattcataatcctgacggtaaataccgcgttcctgcaaaataggcacaaccagattgacgaagtcatgcagacccgatggcacatcagaaccaataatgaatccgtctgccccttttctttcgaaccactcctgcacttgatccgctacttgctcagcggttccgataaaagaggttctcggtgtagctgaacgcaatgcaacctcgcgtaaggtcaaattttgttccttggctactcgtttaattttatctgtaccgctgcggaacgcattgctgccaataccatcaagctcagggaatggctcatccagcggatattgtgagaaatcatgatgatcgaagaaacgtcccaaatactttaacgcagcctcaatcgtcaccagattcgtgatctcttcatacttacgttccgcttcctccgtcgtgctgccaataatcggcgaaatgcccggcaaaatgacaatatcctcttcggatctaccataacgtaccgcacgttctttcacatcacgataaaactgctgcgcttcctctaaagtttcatgtcctgtaaatacagcatccgcttccttggcggccaggtttttgccatcctccgaggaacctgcctggaaaataaccggctgtccctgcttggatcgtccaatgttcagcggaccctgcacagagaaaaactcacctttatggttcaatgtatgcagcttttcaggatcaaagaatacgccggcttccttatcacgaacgaacgcatcctcttcccacgagtcccacagtcctttggtaacctgcaaatattcctctgcaattttatagcgctgcggatgcgacgggtgctcgcctttgctaaagttaagggcagagccttccagcggggaagtcaccacattccagcctgcacgacctccgctaatatgatcaatggaagaaaactggcgtgctaccgtgaacggttcgctataggaagtcgacagtgtgccgaccagtccgatatgcttcgtcaccccagccaaagcggacaaaatcgtaattggttcaaaacggttcagaaagtggggaatggatttttcgttaatgaacaggccatctgcgataaatacgaggtcaaacttcccttcctctgccttttgcgcctgcgttttataaaattcaaagttaacactcgcatccgcaggtacttcagggtgacgccaagtcgtcatgcttcccccaacaccgtggataatcgcaccaaatttaatttgtctattcttagccataactcttccacctctcttgaaaataatgatttcccgtcggcttataccacttgattgtaactttccagcactttacccaactcttccagatccgggttgagcagtgcttcatatttattatccccgcctacctcgacgacagggacataacgaataccatatttggtctccagcacgtcacgcagcacatcatttccgtccacttggatattttcatacggctgattttgggattccaggtacgatttgatctctccacaaaaatgacagccggttttactccacaatacaactttaggtttggacgacatatacatacctccgtgagcttaatgtttataatcccgattaattaaataagaattatatttataatgtatcctgctgccccttttccgtcaatcgcttgtgtaatagacattgctaattcaacgatagaaaattttaattttatatcgtaattaatcggttaattggtagtcaagttatctaaattcagataatttgaagtttaaatggaccctggtgcggacatccttggaataatagcgcccttgtggtgaaatgaaatgaggttgaacaaatgcaggaatggtccattgtagctttacgtacgttattagctatcgttattctttttgtgattaccaagattcttggaaaaagacaggtatcgcagctttccttgttcgaatatataactggaatcaccatcggtaacttggcggcttcaattcctttggaacgtgaatcctcctggtacttggggactgtgtcgttagccgtatgggtacttacaacacttggtattgaatttttacaaattaaaagcaagaaagtcagagatttatcagatggaaagacgacaatcctgatcaaagacggcaaaattttagaggataatatgaaaaaggaaaggctaacgctagatgagctcatggagcagctgcggagtaaaaatgtattcaaggtggcagacgtggaatttgccattatggagaccagtggtgcgatcaacgtgctgctgaccaaagacaagcaggccgtgacgcttaaggatctgaatatacagcaattaccggagaaggaacccacagccgtcattatggatgggcaacttatggagcaacaaatggcatatatggggatcactcaacaacggctggatgcaaagctaaaggaaaagagcctaacggtcaaagatgtgtttttcgcacaggtggacccgcaaggagaactatacatcgatcaatatagtgataatgtacagctaagcaaggtgcaggattcgaatcaagccgtgctgactttgctggaacaatgcacaacggagttgcaaaaactcgcatctggttccagcgagcaacaaagaaaacagctatatgagcaatgctcacaaagcttgaaagaagctatacaggagatgcagccgctaaatacatctaagtcctaagcacatacgcatatgccataagagtagaagcatgggaactaaaaaggagcgtccttcagccgtttatggctttgaagacgctcctttttaacttactgtgccggtgtacatttcacagttgctgctgccttccattactttctggcgcagcggcagcataactgtaaataccgttccttctcccaccttgctggatacagagatagagccagtatgcatctctgttattttataagcaatggacagtcccaagccgctgcctcctgcagttcgggcccgtgactggtctgctttataaaatcgttcaaaaattcgctgctgatcctggtcgttgatgccctgtcccgtatccgcaatgcagataaccgcctgatcaccgttacttgaaagagaaacagatatgcttccaccctgcggtgtaaatttaatggcattgtgaagaagattcacccaaacctggcccatcagatcctcgtctgcattgacctcaactatatctacttcaacagtcatctcgatttttttagcctcccattgcggttcgcaggcgagaataagcgaaattagctgcttgtccagccgataaagggacggacgaaacggatgccgctccgaatccagaatcgccaacttcatgagattatcgcttagcttggatagacgaatacactccgtctcgatgatcgtcaaataccgatctcgctgctcacgattcagattctcgtccttgagcgctttggcgaatccgattatcgaggtcagcggtgagccgatttcatgggatacgttcgaaataaactcctctcgtagcttttccatagccttcagatttgcagccatatcattgatgctgtccaccaactgtacataaggatgcggcctccgatgttttccgttccgcccgccgaggtcccaatccaggttaatgtgaaagtctccttgcgaaatacgttttaaagcatcgatcatttcggtaaaagcgtgctgttctctaggctggaagaaacgccttaccgtcatactgataataccgaagaagaaaaagcctagcgtcgtattcataagaaagacgaacaaaccatggggagcccatgacatgtgcgaatagatcgcctccataataaagtacgcggcagcccagctaagatatagtaccaatactaccagcaggactctcgcaagaatatggagtaaccccggttccctcttcattgccgtacctccagccgataacccaatccccggatcgtactgatccggaaggagtggcttgcctccggaaatcgttcccgaaggcgtttgatatggacatcaaccgttctttcgtctccctcataatcataaccccagatctgttcgatcagctggtcgcgggtaaaggttttgccaggatagctggccagcttgaagagcagctcaaattctttgagcggcagggtaatctccttctctccagcccgacactcaaatgtatcgctgcgcaggacaagatctccgacagttactgattttgaagccatgatacgataacgttttaataaagccttcacacgtgcgacaagcaccattgggtcgaatggcttgacaagatagtcgtccgttccgagcgcgaaacctttcacgatctgtgacgtctcgcctttagctgtaagcataagcagcggcaggtcggtttgctctcgcagcttacgacacagctcccaaccatccattcccggcatcatgatatcaagaacaagcaaatcgaccttgatttgatcaaaaatgcgcatcgcgtccaaaccatccaccgcctcgactacctccagtccttccattctcaaaaagtgtccgaccagttcacgaatatgcggatcatcatcaacgaccaatacacgtgccatttcaatcccccctaactaactctgccttaattctctcgtcctcgtcaagaagactgccatcttatgctttacgcatataagcacgcaccgtaagcggcgcgaagatcgccacaatgactgtagcgccaagtagggagatcgccagttccccgccaatcgttcccgtattcgcaagctctctgactgcgttcacaagatgtgaaatcgggttggcgttcacaaaccactgcaaccaaccaggcattgtgcccacaggcacaaatgcgttggaaacaaaagtgagcggaaacagaacaatcatggagatgccctgtacactagaagcagtgcgggcaatcacgccaaagaaggcaaaaatccagctgactgcccaggaacacacaatgaccagaagcgcggcgatagctacactcagcagtcctccccctggctgataccccaaaatatatcccatggcgaaggtaagtacagttgcaatagtataccggatactgtcagccaaaagagctccagccaaaggcgcaatacgtgcgattgggagtgacttgaacctgtcgaacactcctttgtccatatcctcacgtagttggacgccggtaacgacggaggtcgagatcacagtctgcacgaggatgcctggaataataaccggcaaataatgctgcacgtctcctgagatggcgccgccaaagatataggtaaacataagggtaaaaatgatcggctggagcgtgacatcaaacaattgttcgggagtatgccggatctttagaatgccccggtaggccatcgtcatggaattggagaacgcctgcctgaaactcacagacttcttcaatgtgcgatcagaacctgtcatagcagtagtactcttcatgctctcgccccctccacagcatgcgctccttgggacgtctgctgcttgtttacttgtgctccatgaccagtgatggacaaaaacacctcgtcaagcgtcggcttttgcacactcatctctgctaggcgaatctctccagtacggagggcaatcagcaggtccgttacccgatctgcattggccatcggagaaataatctttccagcttccactgacacgctggacttgactgaaagcacctgttcaacgatctgaacagccctctcaatgtcctgttgattttgtactttgagttgcagcgtcgacgcccctactgccgctttcagttcatccaccgtaccctcagcgactacccgaccacgatcgatcaccgcgattcggtcagcaagttgatccgcctcatcgagatactgggttgtgagcagtacggtggaaccggtcttgaccagacgccggatcgtgtcccacatctggacacgcgtgcgcgggtctaatccggtggtcggctcatccaggaagattagcggcggcttggcaatgagacttgcagccaaatccagccgtcggcgcatacctccagagaaatgctttagcggtcgtttggccgcttcagccaagccaaattcctccagcagctccgctgccttatgacgcgcctcggcacgtcccagtccaagtagcctggagaagatgatcaggttctcggtagcgctaagcgactcatcgaccgatgcgtactggcctgtaactccgatcaattgacgcacaacctgcggttcctttactgcatcgtgcccgaaaatacgggccgatcccctatcaggccgtaataatgttgacagcattcggatggtagtcgttttgcctgctccattaggaccgagcaccccgtagatcgtgccagcacgtacattcaaatcgacaccgtcaactgcatgcttatcaccaaaagctttaacgagtccccttgcttcaatggccaaggtctcttttctgtctgtataatccacattcatatcctccctatacggtttctatagagaggataacccacgtttatgaactgaatatgaatagaaccgtttacgttttgcaaaattgatgataatttctttctttggctttgtccttttaatgaataatggaaaacctttatttccagattcggcttcatgctaagcactaacttggatattgaacctatttacactgtaaaaaaataatctcgttctaccttgctcactcttaaaccaaatgttttataccactcggatttccctttttcctgcgctaccttgtgcagctcgttatgtttccaattttttatagcgtccagagactcccaatatgagactgtaatgcctactccattgtggtcacgaacactttccacacctagaaaacctggctgttgggcagccagttccaccattttgtctcccatcactccgtacccgtcatctccttccgtacgttcagaagtaaagatagccgcataatagggcggacgaggagttttagcaattgagttcatatgcccctcctaaaacaaaattaaataacctttctttaatttgattataatcataaatattaaataaaaaaatgaatatatctgatatgatacatgaatatatttcataaaaaaataggagtgaatacgaatttgtttaaatataagatttttctttgcgtagttgaaatgggaagtttcacaaaggccggggaagttttaaatcttacacaatcagcaatcagccatgcgatctctggattggaacatgaactagggctgactcttctgatccgaggtcgttcaggcatcaaattgaccaataacggggaaagattgatgaagcgatttagagagattgtacaaatggacgaaaagctctaccaagaggtagctttaattaaaggattggaaatcggaaccgtaaagatcggcacattttcaagcgtctctattcattggctgccccgtattctaaaaaaattcaatgagcagtttcctcttattgaaataaaactgctcgatgggaactaccatgaaattgagagctggatagtcagtggggaagctgatttcggctttgtgaacctacccacgttagacgcattagaggcgttgccattaaaagaagaaagcatgctttgtctacttccttccgatcatattcttggaaagcaagcctcaattcgagtagaacagctcagagatgagcctttcattatgcctgttgcaggctgtgacacggatgtaagaaatattttttcacagcataatatgtcacctaaaatcaaatatgaattagaagatgaccatgcgattatggctatggtgcagaatggcctaggcgtaagtattcttcctgaaatgatcctgtctcacattccttacgacatctctattcgacctttggacgaaaggcattcccgtactatcggtatcgctaccgcttccttaaaaaatgtttctccagccgctaaaaaatgtatggactttattactgaatggatcaactagcttcatcatgtcggccaaggaagcggattctcaaaactggaccagtccatatccatttcgttatcgttcagtaggcattcatctagctcttcttccaagtccggtcgattcattccgatacctatcatgacgatttcgttcatgcggtcgccccattgttcatcccaatggtccagagcctcaggatcggctgccacgatctcctgccgttcttcttcagataacgcagcaagccagcttcccgcagggccaaattgaatagatggtcctgcctggctaatactcgctgcccaatcctgcggggttgcaatccaagccaaacctttggcgcgaacgacctcctccggccagtagctcataaattcagccaatctcgcaggatgaaatggccttctacggcgatatacaaaggaattgatcccatattcgtctgtttccggtgtatggctttcaagctccagctcccgaatccatccagcggattgactagctttgtcaaaattgaacagccctgtattcaaaatatccgaaggagcgacctttcccttggaagttcgaatgattcgggcttcaggctgtaatctccgcagcacaccctccagcttgtctagctccacaggctgaaccagatcgcacttatttaaaatcaatacatcacaggtttcaatctggtcaatcagcaagtccgagatatcacgcgtgtcgtcttcaccagtagcctgcctacgatccagtagcgtttctcctgattcaaaatcatgccagaaacggttcgcatcaacaacggttaccatgcaatccagttttgccagcgaagccaaatcaatgccagttccttcatcggcgtacgtaaaggtttgagcgattggcacgggctcactgatacctgtagattcgattaaaatataatcaaactcgccttgttccgtcagcttcttgacctccagtaataaatcttcacgcaatgtgcagcaaatacaaccattagacaactggaccagtttttcttctgttctggacaagccgccctcttttttaaccagctcggcatctatattcacttcactcatgtcattgacgataactgccaccttcattccgtcccgattgtttaatacatgattcaaaatcgttgtttttcctgcacccaaatatccgctcaacacggttaccggtattggtttcttattcatcgctggtacgctcccttgaatattaacttttcattcttttaaatcgtaataattactattaacattaactttcagtaatatacagcatcccttttgccttgtcaactgtgaagaaactcttgaaatgaataatctatccattaggtaatcgcaaaatgatggaagtctgtgcggggcggttagaagcctatcagcgtgtgctcgggatgactttagccagtttgcccttctggttattgctttcgttatatggagttttcagcgcgggaatgccaagtaaggatcagacgattcagtctgctttggtagctgtgttttcaggggtggtcgctacggttttattttttaaagctacaaatcaggttcgtggaaatatgcaaaagctggtgacggtagaagcgacacaatctctggaagtgctttttgcattaatgggagaattaatctttctgtctattctaattccatctcctttatcatggatctgtatgttcatcgtcatcttcggcatgattctacacagttatgttacagatgctaaaagctttatgtaacttcaggcattaaaaaagaccgcaaaatagatgcggtcttttcaaatttcttgaatcgaacaatcttacttttctacattttttttgaattcgcttataaagtctttaggatctgattctacagtataaggaaatacgccttgtttcgtatgcaaataaagaacaccatgaccctgcccgatacttttaaacgatatatcatatacctcattgagagaaaactcccggtacgctgatacaattttagttgtatacaagtgtaaaactcggcgatgaatgactgtttcctgttttaacggagttacgatcctttccgctttgtaatacggctggactgaaataatattgtgcacatgatccctccacatttattatcaatccagacggatatgacgcaaatcccgcactatgggttgctttcattttggttgttttgaagatgtattttgttccaatatcggtgccagatcatcctgaacactgttcccccataaagggactcccgaacggtaggcagcccttccatttagatgtccggctacgggagaagtgataaagacaaacacaatggcaagcagtaatttgatgctgaccacgtctacataaaacaaaaaataaaggaaggctcctgttaatacgcaaagcacgccaagcgttgcacttttggttgcggcgtgagaacgtaaataaacatctggcagccgaatcaatccaaacgcgctcaatccacagaacagagcgccgaataaaacaaggatcgcaataagcaactcaccgatcaagttcatcccccccagtatctatgacggcgtctctttctatatatctcgccaacgccgttgttcctataaacgtcaggattcctataacaagaacaatctcaataaaatcctgtgtcctcagctgcatgcagatcacagcaatcatagctagcagatttatacctatcgtgtccagtgcggctaccctatctggacgggtcggtcctttaatcaaacggtacaagcaacctaatatggctaaggagagaatagccagtgatgcagccaaaagtgccgaaactatcactgtgtcacctccatgatcgctttttcaaatgtccctctaatttgctcagaaagcagtgtcgcgtcctgtatgtccatggcatgaatatacagcatttgaccttcttcggatacttccagagtgagcgttcctggtgttagacaaatgaggcacgataaaatagtgatctcccaatctgactttagggcagtctcatagacaaaaatgcctgggcggatggtcagcttcgggcggagaatatgatggataaccgcaaagctggaaacgatcagctctcgcataaacagaagtagcagcttcaggatggcccatatgcgcttcaggtagaaaggttctggacggaatttacgcaaaacaagcaatatggctatccctagcagaatgcccatggtgaaccgcgaccctgaccagtcgttgttaagtagcatccacagcaacgcaatcatcagatttaataatatttgaaagaccatcttcatctactcctttattacagcttcgatgtatagcgcgggatgagccagcacatcaccggcttgtgcaacataggaatagacccaatccgccccgatgcccatcaatataaccaggacgagcaaaccggccgccacagcattcacactttttagccttatcttcggcaggtcgccttcgggttcattcccccaaaatgcaagcttgaatactttgatcagcgaatacagcacaaggaagctcgagcctagcccaatcaaggataatgtcaacattccggcatccagtccgccccgagtgatcaacactttaccggcaaacccgctaagcggtggaatacctacaagtgcaagggccagtataaagaacatccagccgattaagggatagcgtttgatgaggccccccatatcttttaattggtccgttcccgctgcagtgataatgatgcccccaagaataaacattaatcctttcgccaacatatcgtgcagcaaatagaaaaccgccccattcaatgcatctggtgtcgctgcagccagaccgaaggccacaaaacctacactgataatgacgttgtaattaaagatacgaggaatatcgttataagctaccgctcccagtcctcccagaatcatcgtagccgccgccagccaggcgatccacgtatgcgtgagtccgggatcattcacaaaaataagagtaaaggtccgaatgattgcatacagtcccacttttgtcagtaacgcaccgaacaaggcccttatagcagacggcggcgcactgtaagaacccggcagccagaaaaagaggaataaacccgctttcaatgcgaacacaatcaggaatagaacagcgatcacattgagtacgccgccctgccccgcttcagcaacccgctgagacaaatgagccatattcagggtgcctacagccgcatatagataagcaactgccgccacaaaaagtgtggaagacacaatgttaatgagcaaatatttggacgtttcccgaagttggagcttcgttccccccagagaaatcaaggcataggaggaaatcaacataacctcaaagaaaacgaacaaattgaacatatctcctgtaagaaatgatccatagacacctacaagcaggaagtgaaaaaaggtatagtaataaaaacgttcccgttctgccccaatactgcggaaggagtagagaagaatacccaagcttaccactgaagcggtcagcacaagtagagccgcaaacatgtcccccacgaacacaatgccatacggcggcacccatcctcccatttgcaaagtttgtataccctcgctatgaacgcggtaaatcagcacaagagcaatcataatattcaaaatggtgctaactgtactaatgaaccgctgaagcagaatcttctccttcagaaaaatcaatataacggcggtacataagggaattaaaatcggtagtgccaagagattgctcattgttcttcccccttgacactgtcgatttcatcggtgcccaacgtctggtatgagcggtaagcaagcacgaagaaaaaggcagtgactccaaaactgataacgatagaggtcagaattaacgcctgcggtaaagggtccacataagtttccgctttacctcctaatactggagcagctcctgtctttagtccggccatcgtcagtagcagcagatggacgccatgtgttaacaaggaagtacccaaaacaatacgcaaaagacccttagatagaatcaggtacactccaattgtaaataaaataccgactgctacagccataatcagttccatttcactcatccccccctatggtaaaaataatactcatggtcacacctactacagccaggtatacccccagatcaaagaggactgctgtagccagctcggtatcccccataataggcagatcaaagtggccaaaggcatggctgagaaaaggggctccgaaaacaaacgagccagccgcagtcagaattgcaatgagcagccccaccgccgtgatcatgcggtaattcaccggaaggactttacgaaccgtgtccattccgaaggagatcgccatcaaaataagcgcagctgaagtcatcagcgctccgatgaagccacctcccggattattgtgtccggcaaagaacaaatacattgagaaggtgagaatcacaattatgataaccttggacagggttcgcaggatcacatcattactctgggacggaaaggcaattcttcctcccttcttatttttgttggcgggtgaaatgccgggctccattttcaagttaatcaaggcataaatgccgagggatgcaatagcgagaaccataatttcgaacaaagtatcgaatccccggaagtcaacgagaatgacattgactacgtttttccctccggccaaggaatagctttctttaaggaaaaactccgaaatgggagcgaatggactgctgcccatggctgccagcgcaatgagtgttatcgtaattcctacacccacagcgataatcaaattcggcaatctaaagctcggacgctccttctccttctttaactttggaagatacttaaagcacagaaggaacagaatgacggatactgtctccacgatcatttgtgttaacgcaagatccggtgcgcggaagataacaaacagcagggtcaccatgtacccgactgcaccggtgaacaaaatcgcgttgacccgcgacttagcaaagggtacggcaaacgctgctagaagcattacaacaacaatgacagcctcataaaaggttaacggagcatagtggatcatacccagcgatatcccttgcgtcccaagcatcacacttcccaaggcaatgacgaaaaagccaaatatataaagcaaatagtgtctgtttgatcccgtcatatagagatttgtgaagcggttcgatccacgttccagcacttgaagagatccatcatacatgagattaagaaaattgctaccgttccattcccgatccagaatccgcagtcggctgtatcttctatagagaagtgtcccggcagcgataacacccagtgtcatgaatatctcaggtgtccaaccatgccagaaatgtatggagacaccaaaggtttccactggcgacaatagctcgttatagatcgagcccatagccggctcaatcagagaataagacaagagatcaggaaataagccgaataccacagcgagtgaaaccagcaggactggggaaatcaacagacccagcggcgcttcatgcggtattttatcgagcttctccggctgaagtttaccggtaaaagtcttaaataccagaatcatactataaacaaaagtgaatacactggcaatccatgcaatcaccggaattagaatcatccacgactgtgtattcagaacatccaactcccgaatatttaacacagcggtaaagaacatttctttactcagaaaaccgctgaatggtggtaaccctgccatggagaaagcccccatcaacgccacagaaaaggtgactggcattaaggacattaaaccaccgagcttgcgcagatcccgagtgttcacctcgtggtcgacaataccaaccaccataaatagagagcctttaaagacggcatggttgatcagatgaaagatggccgccgcagtagccgtcgtatagaataacgactcctctgtaccagaaaaaaaggcagaagccgatcccagcccgagcaaacacataatcagaccgagctgactaatggtggaataggcaagcagagctttaagatctgtttgtttaatcgctttaaacgatccataaaaaagcgtgaccagaccggaaagtgagaccaaccagaaccattcggactgaccagcgaatacggggctaagacgcgccacaaggtataaccccgccttaaccattgtagctgaatgcagataagcactgacgggtgtcggtgcctccatggcatcgggcagccagatatgaaaaggaaattgtgcggacttagtaaatgcccccagtagaatcagcagcatcgccggaataaacaacggggactcggtcaataagccgacttgggctataatctcccgaatgctgtacgttccactcattacgtagagcagattgaaccccgcgaacatcgacagcccgccaaagacagtgattagcatcgacttcagcgcgccataacgggatctttcccgccggtgccaaaaggcaatcaacaggaatgacgtaatactggttaactcccagaatccatatagaaccatcaaattgtcggacaaaacgacaccaagcattgctcccataaacatgagcaaatagatgtagaaatggcgaatcgcttccgtccgcttattaagataataaatggaatacaagatcaccagcgcgcccattcccgtaatcagcagagcaaacagcaggctgagtccatccagatacaacgtaatattaatcccaagcgatggcatccaaggtatagttgacatcgtatcatttccagcctgaatgtccgatatccttgtcaggaaatacaggaaaagagctgtgggtaggggcaagactgtccaacctgtatgaaagcgcgaaatgcccttggtcaacgggattagaacagccagcagaaatggaatcaaaattgcagcatgcaacacagtcgagcactccccctatataaacttatttttttgtatatgaacttctaggaatgcggctttatccattcactttgtagaattctcaaatactgggcttcgccatttctaacgattttgaatagaccgctgttgaaatcagtatccagctcacggaaaaatatcccttttatcgtatcttctccaccaggctcttcactcagtacataacttccatcctgcttcaccaaataagcggaaaatcccttctcatgtgagtgctctaaaagctcgggataacgctgtacagccacaatatgaagatcaataggacccagttgttcaatcaaatcgttgacaaaattaccacgggtaatctcttgccatagcgtttgactggactggccgatgatgatttgagtaacctttttttcccgggctgtctccacaatcacctcagctgtctttttcccattgcatttacgaatcagaaacgctcctccagcatttttagtctgctcttcccatcccgagaggtattgttccttgttttggttgtattcatgatctgtggttgcatccactgtaagcacatataaaggagccccgagaaaccgggacaactcgctgcctctttgaattaaccgctgtccatgcggaccataatggacacacaccataatgctctcattgttcatctccgccatcattttctctgcctcctgtttccaatttacgaaaaaaacacaaaaagagcccgctgttggcaggctcctccgggtaaaccaatatacaattagttttaattatatagtttaccggggagattgtaaaggtaaatccttttgcgtatagcacctagtataaatggagaatcttcatacaaaggagtggttaacatgttgatgcgcaaagtgatgatctgcaccagtctctttagcctgttgcttgtcgtgggttggagacttgaatataatatccatgcaaaaacagtgaagagcaaccaaaagttatcagcaaatgaaagttacaaattccgatcagccaattttgctgaacctgttctaataagcattccttttctcccccgggagtatgtacggatcgtacgaaagattagcgaatagttgttagcttttccaattagctttaatatgagcccttgacatagccgttttaccaaccacgatttaggatgagagactagtacaaaaacagcagatcaaggagactattcccgatctgctgctttttgccgattatttctcacaaagaatgatgctttataacgagtacgaagtatgattaccaagcgtaggcttctggcgcaggttttcccggaccggggaaaatctcattcagcttggcaagcacatcttcgctcaatttgacctcaggtacccgtagagcatcctctaactgttctaaggtccgtggtccgataattggagccgttacggccggatgggacagtacccaagccagtgcaatcacgtcttccttttcacccagctcgcgggacaatgctgcaaattgctccagcttcgcacgattctgctccaccttttctttggcgcgtgcgctgcgagaaccagtacctgctaacgcattccgtcccagcagtccgcccgccagcgggctccatggaatcacacccagacccagctcctgagctgccggtaatacttcaagctcagcggaacgttcgttcagattgtacaaatgctgctcggatacaagccccagaaaacgtcgtgccttcgcttcggcctgcgccaccgcaatatgccagcctgcaaaattactagaaccgatataatcaacctgtccgcgatccaccacggactcgaatacgccccacagttcatcccatgacacattacggtcaatgtgatgcatttgatatagctctacatggtcggtttgaagacgtttcagcgacgcgtccaaatgacggcgaattttgtaagcagacaagcctgatcctgcattgggtccgtcatgttcatttttcatatctccgtataccttcgtcgccaacacgactttttcgcgtcttccgccgccctgctggaaccaacgtccgataatttcctctgtccaacctttacgatcatggccatatacattagctgtatcaaaaaagttaatgcctgcatccagtgcggcatccataattttaaacgcatccttttcttcggtttccggtccgaaattcatcgtgcccagacataaccgactaaccttcaagcctgactttcctaagtatgaatactccatactatctcccgcctttgcttaaggattttaaaattccgcaaaatgacatgccaaaaaagaccatacttcgtttattcaccaaatcaaattcctttgaaacacctcaaaatcaatttaaagggatagcgcatgcaaaaaagccccacgcaccgccgaagcagcaagcgcgaggccatctccccttatactacccgccaaatattaaaagaagtgactttacgatggttaccagcggagcggagaatttgaatctggagaagcgaagcgttcgcctttgccacgggattcttaccttttcatgtctatctaatccaaagaatcccgtggcaacagcgatcgtaagatcaaatccttcgcggagcggctcacttcaaccacagtaactcattcttttttttacaatcaaggaatcaatttcgtttcttttgctcgctcggccatttttttcgtatgcttgctgagcggcttcttaaacaccaatccaaacaggaagcaaacaccgataaatacaaacagcatcaccacatcccgtgtcaccgttgaaggcaacatccctcctactgtctctcgtaacagactaaccgcataggtgaatggtacaaacggattcagcgcctgaaagaacggtgtactcgtcgcaatcgggaatgtccctcctgaactggagaattgaagcaccagtaggatgactgccagtcccttgccgatattgccgaacacagaaactagtgtataggtcatcgccgtaaacaccagactgatcagcatagaggacagtacaaaagctactttggcatccacatacgccccgagcaggaacaagtcaccgagagatacgctcaacgcctgaaaaataccaatcgtggagaatgtcataagccgtccgaaatacacttggtagcttttaaattgtccttctgggtcatccacatctaccctaaacatcgagaccagtagcatcgcacccacccaaatcgacaatgtagtgtaaaaaggtgacatcgccgaaccatagttggggattgggtatatccgctcctgcttcaacgataccggactgccgagaaaatcactttcctttttcacatcccccttgagcaatgcaatagcgcgtccgagtgcattttcgcccttaagcttgcgaattgtgtctgcagcctggcgtatggaatcctcggcagctggaagatcggtccttacaaaattggctacttggtgtaccgctttttcagcttcaggaaatttattttcaattaaatcagccattttgacaaactgttgttccgctttgggcaaatcattatgcacaaaatctgctgcccgatgaattttatttttaaccgccggcaaatcgttatttacgaagtctgccgctttgttcacagcattcgtaaactcgcccatacgtccttgaatcgtcgtcgccgcttcatgcagtttttgacggtattgtggcagatcctgctggagacgtgtcagctcttgctgaccgaattctgctgcagcctgtgcgtcatttaatagcttttcaatattcggtagctgctcttgagctgtagtcagcacattggcagaattgcgggcaacggatttgatctgatccagcgccttttgaatggcgggtgcatactccgtatcataattgcccaaaatgctgtcaattccgctactgatttctcctgccaggcgatcagtgtcatccagcagattttgcgcaggcttttcaccgcgctgaatggcatccccgatgctagttactgtgctattcagacgacggaaacgatcctccaccccgctcacacgggaaataagtgaatccagaggttgacttggcaagtatccgttcacacggttcagcaattgagaaatatgatccagcactcccacggcaattgtcagcctaccgctgacacgtttcaccgcagcttgtgctgctttaggatcaaaatccacaccacgaatgatgtctgtaatctgagaaacttcattcgcgatttgttgtaccagctgtaagtcttctttaactattgtaccaatcgaatcaagcgcaccctcatttttgtccagaaattcaagtaaaccggttgtaaagtctttgcctgtgtccgctattttctgtacttctggcagtgctttctgagcagcattaatgaccttaagggccgtttgcgtgtcctctaaagcggtagccagtgcactttctaccttgctgaaattttgatccagttcaacaattcgatcaccggccttttgaatatcaggtagtcttttttggatatccaaaataacagtggctaccttgtccagctcaggcatgtttttgtcaattttgagcaccaggtcacctgcacggttaatttcaggaattttctccttcaatgcaatgatcttttgtccctgtgcctttattttcggcaaattttgctccagttccaatgcctgtttgcccaacctttcgatatccggcaatcgatcattcagctccaacacccggttctcaatgttacgaatcgtcgggagctcctcctccaacttgactccggcttccttcaacttcgtcaatacggcctggctggcagtttcaataaagttttggctaatctggttcgtcagagaggttgcccccgaagatgtaattttcggagctactgcattaattttttcatttacggcgtaatcaatttccggcttttgcggattttccgtcagcacactcgtaattttctctgaaaaatctttcgggatcagcaggctggcataataatcaccattcaacacaccttttcgtgcttccgcttcattgacaaaagtccaacccagcttcttgttattttgaaggttatgcaaaacctgatcgccgatattaatctttttaccattcacttctgcaccctgatcttggctggttactgcaattttaatcccagatgtattcgcatacggatcccacatcgctttcaaattcacccatgcatagacggaaggcaaaagaatgatgccaatgactaataaagtcccggtcgatactttgaatacatttctccagtctgttaagtagatttgccatatcttccgcaacttcatcactcctcgtatgtacattaacctgtcgtccattgttgtatgcacacgtattgtaaacgattcgagcgaatgaagccaatcctgttacaaaatatgtaaaaacgtatgacacttatttatagagatcatacgcttttcaataaaatcaatctgcttaatttcgaactccattcgcgggcatagccaaagttccgtttaccgtccaagcgtcaaaagaggtgtctgcacttgtaaactctatcgtttgtttccccgctaatgtgttcagcacatctgttaaacgcttagtggcggttgggtccaagttaacagaagtttgtgcgttttgagctatggcagcggcgggctgctgtgcccatgcaactggaactggagccgttcccaaaagcatggatattgccgcaactgttgcagtgacagagctccattttttcatgggtcaattcctcctgacatctcaattgagattttgtcctaactcaaagaagcccctcaagcctaatttttaggctcaaggagcttcttattcactacattatccattcttcagcagcctggccgccgaaaatgctgcaccatgacgcaacttccgcttttccaaccgtttgtgcagcgaacgattatacagaacctgaatgacaaaatacgagataatgcccagcaccacaccgaaaatcgacatgccgatcaggatgtgcaagcctccgtgcagcaagtctctgaatacagaccagttgccgtgaaacagctccataaaagaatgctcgtgaagtcgtccgcccctgacatgtaccggataatgagatggataaatccaagctcccacttgcttggcgaatggcatcagtacaattggcaaaaaggtcagcttacctacaacgttacccacaatggccgcaggcagcgagccgccagagagacgaacaatcggataaaaaacaaggtataccagagaagccgtggaaatcacgatcatctccaacgcaaagccaatggcgaagcccaaagaaatctttttaactccaccaggggcgcgcaacagcttgatgaaattcagccgaatcgcacgccatatattttgaaacatattatatttcttcttcgatttatgaggtttgagccttttcggattgagctttatcaataggaggactccttcaacagtactattcaagttcaggaatgagtcaatacagctcccatccttacttatgtctatactgtcattataaccctcagcgttcgaaaagcaatgttattccgcctgtttcgccgttttaggacagaattcgcttgttgacatcgttttggagaggtacaatgtcccaaatctcagccgcgtactgctgaatcgtacagtcactagaaaatttcccagaatgggccatattcacaatagcacgccgagtccactccgagggattccgatacacttgttcaatgtgaacctgtgtatccacataggatgcgaaatccttgagcacaaagtattcatcattatgatcaatcagggattgataaatggcctcaaattcccgttcatgccgcgtaaaaggagcatcgttcacgagttgatccaacacttcacgcagtctttcgtcactgttggctgttttgcgcgccgaatactggccgtctcggtaatatgcctcgatctgatccaccttcaatccaaaaatgaacatgttggcatcgcctaccatttcatgcatttcaacattggctccgtccaatgtacctattgtgagcgcaccgttcatcataaatttcatgttccctgtgcctgaggcttccttgcctgccgtggaaatctgctcactgacatccgccgcaggaataatcagctcggctagcgagaccgaataattttcaaggaaaacgactttcagcttgtccttgacatctacatcccgattgatcgtgtccgccacgttgttaatgagcttgatcgtctgtttggcgagaaaataaccgggggcggctttggctccaaaaacaaacgtgcgtggcgtcacatccaggccaggattacttttaagctgactgtataaatgcatcacatgcaaaatgttgagcagctgtcgcttataaccatgcaaccgtttgacctgtacatcaaaaatggaggacgtatccagccgcacgccctgttttgcaaaaacatgctcagcgagcctgactttattatttcgcttaatcgcctgtatccgttctttgaacgactcgtccccactgtaacgaagcaggtcgatgagctcccttggacgggtcctccaacgtgtgccgatggtctcatcgtacaagcttgccagctccgggttggcatgtattagccagcggcgatgggcaatcccgtttgttttattattaaaacggtcagggtacagctcgtgaaacgacttcatctctcgttcctttaatatttgcgtatgcagcgcagctaccccattaacgctgtagctgccgacgattgccaagtgagccatacggatttgttcaccgtgaataatcgccatttcaccaattttgatgtcctgacccgggtaacgctccagtagcatagcgcaataacgtttgttaatttcttcaatgatcaaggaaatacgaggaagtagctcccgtaccatattgacaggccattgttccagcgcctcacttaatatcgtatgattcgtataagaaacggttcgcgtcgtaatatcccatgcatcgtcccagcccaagcccttcacgtctatcagaatacgcatcagttccggtataaccagcgtcggatgtgtatcgttaatgtgcagtgctattttatcgggcaactggctataaggtaaacgaagcttctcgaacgtacgtaaaatactttgcaatccggccgagcacaggaaatactgctgcttcaagcgaagcagctttccctcataattggagtcatccggatatagaaatgccgagatggattccaccgatcgattgtagtcgagaaagcggtaataaccgccctcgcctcgaatcggtcctcgaacgggatcaagcgctgattccgcactccaaatccgcagcgtattcacctgcgcttgaccatagcccaccagcggaatatcgtaagggacagcccagactgtttcggcatcctgtgtctcgaatacaagacgtccctcctgttcacgggtttccactcttccccaaaaatgaacctcgacctttttgtcaggacggcgttcctcccagacattccctttctgtagccagtaatccggcagttcaacctgatttccatccacaatacgctgttcaaacagaccatatttatatcggatgccgcagccatgtcctgcatagccaagggatgccagcgagtccatgaagcaagccgccagacggccgagaccaccattgcctagccccgcgtccgcctcctgttcttcgatttcctccagatcccagcccagttcacccaatgcctgccgaaccatatccagtacgcccaaattcagcagattactgcccagtagacgacctatcaaaaattccagtgaaaaataataaatctgcttctcttgtccttctttgtaggcttggttcgtttctgcccaattcttgccgacttgttcacgaatcatgccacccaaaaccttatatacgtcttccgactgagcctcctgcatcggtttgcccagccttccgaccagttgctctcgaaaagcctgcttaaaagcttctttattgctgaacaaagttgtacctcctgttatttccgttttaatggctaagtatatcctttaaattacgctattcttggcaatgacatagggaactctaatgtctccaatcagagttcgatctggtgaaagctgtacatctttatctaaaaccacattctccacaactgcccctttacggatgacacatttttgcataataatcgagttgcttacccgcgcgccctcctccacctgcactccacggaaaagaatactgttctcgaccttgcccccaatggtgcagccattagcaacaagcgaatgatccacctcggcgctgtgcgtataacgagtcggggcttcatacttgattttggtgtgcaccggctgattctggaacagtgcttgatactgctgctgatccagcagcttcatgctatttttatagtagctctcgatagaattaatgactgcatgataaccttcataacgatacgcataaatgcgcagcccacttgggtttttctggatggcatcgcgaaagaaatgattatcctgatgggcaatgcaatgcttcacctgatccagatacaagcctttgtccatcacgaacatttccagataaatattatgatgatcctgctcctgatgaataccagtcacccgtccgttctcatcaatctccagtcgtgcacaaggagcatgttcagattcgagctggtctatgggtttatatacgagggtaacatctgcatttttctcccgatgataacggtatacatcctcgatatcaaccttattgacatgctgagttcctgcgtgaacaagggtttgccccgatgagcgatgaaaaaaatccagattgttgtgcacatgctgcaaatctccacgtgatgcatccgtcggatcattccagtccggtggcaaaataaacaacccgccccgtctgcggtctaaatcccaaggccgaccttcacccagatgatccagcagcgaacggtatttgcggcggataaacagtgcaatatcatgcacccctgcatgcatcatgttagataaggtaaaatcaatgagccgatatcgactggcaaagggaactgcggccccgcaccggaaataggtcaactccttcaactgatccagttcgtgatctaggttgataactccaatgagtcggctcatagcagacaccgtccttatccgggttaaattcgtgcatgaagctggctttcctgatcgaacaaaataatctcatcagaactatcttcaggtccgataaacgcgttgtcttcaataacgatgttctcattcacgatagcccggtggatacgtacattgcgcccaatttttacgtttggcatgatgacagaatcggtaataacgctcccttcacctacttcgaccccataaaatagtacagaatgccttacttctccatccaccatgcagccttcatttacaatactgtttttgagaatcgcccgttgggttatatactgggccggttgattgggactgcgggtatagatgcgccagaaaggatcgttcagatccaaaggcggatcctgaaccagaagatccatgttggactcccacaagctctgaatggtacctacatccttccagtacccggcaaacgggtacgcatacagcgaccggccatgctgaagcagtaatggaatgatatccttgccaaaatcatgtgaggattcagaatcgcttgcgctttccagtaaatagcgacgcaacacctcccatttgaacaaataaatgcccatggaggccaatgtacttttcggctgttcaggcttctcctcaaagtcgtatattttcagatcatcatcggcgttcagtatcccaaatcgttgggcttcctgaatcgtgacattgatgacagaaatggtgcagtctgcttccttctccttgtgatagtggagcattcgactgtagtccattttataaatgtgatcccctgacagaatgagtacatgctccgggtcatactgatccaagaaatgcaggtttcgataaattgcatccgccgtgcccctgtaccagttgtttccattttctttctcgtgcggaggtaaaacgaacactcctccatccaggcgatccaaatcccagtcgctgcctacgccgatataggaatgaagcaccaacggctcgtattgggtcaatacgcctacggtgtctataccagaatgagtgcaattactgagagggaaatcaataatgcggtaagtccctccaaaaaacactgccggtttggctagtgtacgggtaagtcctttgagtcttttgccttgtccgccggcgagcagcatggcaaccacttccttctttctcataacaaagacctccctgtcatgtgcgtctgaagcaattgtggcgggatatttgataatatccattaaacatgaaaagacagtcgtaatcgtttcattggcgaaggaacgggtaagatgtgatggagaagggtaaaatcatagttatgcggaacgagtgcaaggaatcactaaatcgtaaaatcccgttcatcttttcacattttggatacttttaaagtattcgtgtatgacaacatgatcataaggaggcgttattcatgaagaataaaaaatgggtggtagcagcattgggaatgggtgttacgtatctgatgaaaaataaaggggcacgcgataaggtattgaataaagtacagaccattgtcaatcgtgcgaaaacatctgcaaaatcgtagaatgttaaaggtagaaaaagcgagcctctctgaatcatggttcagggaggctttgctctgacttttttttgcgtctacgaacaaaatatggttcgaggctgtatccgtagacggtcaggcattctccttatgttcttctacttccatgatatgttcaacggtaaaggttcgatgcgtccattcggaagaacggtaagcctctaggagaccaaaggtatgaattttctccttgtccacctgcttaaaggtatgagtaatccctaccttacccctgaaaggaaaaaaggaaagacctacagtctgatccgatagccactcggcccaaactcgcccgctttcatgtcgaacagccgggaagcttaaaccttcagcaaaccattcataatctgctgtaggcgtacccggctctcggctgcataaaaacagactcaattcgtcgcaaaacaacattctccgtacatcggtccgcacttgatggtcgaaggttacgccacatgccagctcctgtttgagcctctgccgacgctgttcctccgcctcctgataagcatgcgtaatctgcttgtcctgagcgttttgatgctcggtccgtccgactagctccttgtacatcaagctacacaataacgccgcatacatacttccttgttcgacttcatcaatcccaagacgatagaaaacaaaacgtggactgagcggaaaatcaataaatgtataaggtgcagacacatgatcattccagaaaggagcagcgtctaactgtatccaaccccgatcatgctcccttgctgcatatacaaaatcctgcttatgacgtctattcttgaaggcactctcttcccattgtgaagccaactcacccgaaatatgggcatggtcatgctgcgtcgtcatgatataagcttggtccgtttcataaataaccatatgctctccccttccgttcggcgattcgtgtgattgtgtacaaactctctgatcgaaggccatggttatgcttacgtttattatatcaggataagggtaaaaaggcaggcaagttttccgcctctttatatctaattacccttttgattctgcactcgaaactgctgtggggtcatcccctccagctcacgaaacactttgttaaaatgctttgcattgtcaaaacccacgttagccgcaatttcataaatcttgcccccttgacacttcagcagctttttggcttctgtaatgcgcagcctttttacatattgaacaaagctaaggcctgtataggctttgaaagcctgactaaaatacgtataattcaaggatactgaattggatactactgccatatttaaatcctcgctgtaatgagcatggatgtattggatagcacgtgtcatgctaccgtttctatcggggatgacactcgcgccaaccagtctatctttctctacgctgacaacactatcgtctatgaggtggttcctctccttcaattcctcattcaaaactgccagcgcaccaaacagctcctcccttacaatcggcttgagcaaatactcccgtgccccgcagcgaatcgcttcgcgcgcatactggaactcgtcatatccactgagaatgatcaccaaaggtctgcgttccggctccagctcgcgaatatgctgcatcagcataatgccatccataacaggcatacggatatccgttatcaccaactcgggcaaaaactgcttcacatgctgccaggcttcccttccgtccttgaccagtacacattcatagagaccggaaaattcccgttcgatcatagcttgaagtcccattcgaatatttttttcgtcatccgcaatcaacagcttggtcggcatggtccgcccccctcatcatgtaacgtctaggcaaaattagggtcactgtcgtcgattgtccggggatgctgtccagtcttatgccatactcttcgccatactgcatacttaaacggcggtgcacattatacaaaccgattcccccattcatctcaggctcgtgggaatccatatccgttcgcgctagaccagccatgatggcgtttcttctttcttcagatatccccactccgttatcctgtatacgcaattctatgatatcctgcttagagtaggcttcaatcgtgatgctgaatgagctttgcaatgtactccaaccgtgcttgatagcattttcgactacaggctgcagcgacattttcagcatctccagttccataaacgccgacgatagatgaatttccaatccaatttggttatcgtggcgaatgttcatgatggccacgtaatgctggatatgtcggatttcatcccgcaacgcaacacatgacccggaccattggagattgtaacgcatcatcgacccaagggaggtaagggcatccgacagcggatactgccgttctatctccgccatcatttttaaattttccaatgtattatagagaaaatgggaatcaatctgatgcttgagcgctagcagttcagcctcctgagcagcggcctgcttgtgtactgcctcggcaatgagtccggtaatccgacttagcagactgcgaaaatatagagccagctcagccacttccccccgcccatatactggaattctaagctgaaagtcaccctcctgctctactttcttcatggattcacgcagtgtatgtagctgcttgagaatgaaggcatgcagggtataagaaatgacggacataaacacaatcagcatactaataatgagcagcatggcattgcgtttctgacggagatcacccagcggaccgtccagcgctaccacatttagcaaataggcgtccaacccttctatatagcgatacataccgagataaggcttattctcataggaaaaatcaaaagcaccacccggtccctgaacctgggactgaaacagatggtgcacatgggacagagggatggaaattgaatctgatagagaggaagctgtagctatatcgctagaagacattggtttgtcagcgttccttgcgctggaatcgccgtccagaatgaacatttgccatgcacgatcacgttgtgggattccaaatactctaggtgaaaatagctccagcctcatgtttgtttctaccaaccctgcgtgtcttcctccggtagactgaatttcacgcagcagtgccatatactgcactgtctcactttcctgccgggattgccccagaagtaagcttttcggccccttgtacatttcccaccatattttcccttgtcggagttgggacgttttcagccaggaagccttaggcaatcgtgattctttgaaaatcatcggccatatttcatgcgtctggggattattggtatacagtcgaatgttctctacattgggattactgtacagcaagtgctgcaaatttggaaacacattcaagttgaattggactagctcatcgctgcttatttcacgttcctcggtcagataacgaagtacgttgcgatctgaaatcgcaagctgtgcggttcgctccataatttccatattgctatgaatatgggccagctctgtatccaacacatactgattttgtacggtgatgtcgtgcatggtattctcgtacagttggtgaaaggtatatagcgagaataataccaccgggattaaaatgactccgatatacgcaacaatgagcttaacttgaagggagcaaccgccaagccgatcggctgtacccttcatccactgccatatagtgcggcgcagcaggctcttcatctgtgaacgtgcacggcctggcatgaaatcacatccttaggggttcaatagattaaagcattgaattaaatcatttggtgaactgttcaattttcttaaggttttcctcataggctttttgctgatagaccataactttgtcatatcctgcttttctgcggtcttccaaaaagcgagcaaacagctggtcgaattcctcatctgaggaagccagtagcagcttcggcaatgtcttgccccaaattttatctatctggcctgacgcaatgccctctgccgaagttccagtcggtttaatattgtcatattgggagaagcctttcgtctttcctttcgtccaatcctctggctgcttatacggctcgacgctgggcggcgcccactgcaaattcatattcgtatccatcagcatccagaaggtgaaggaggcgccatattttttatcaaaagcagaacgatccttgttcagcagctcctgtacctccggcttgaaggctggcttaccgttaaccatgtcccatagcttgccctgctcccccagatacaggtcacgatttccttcctcgctaatcagataagtcagaaattcaatagctcgctccttgtctttgacatccttcgaaataagcgtcaccgtccagccggaaatacccggcccggccagcgtcggcgggtccagcttactgttcgaaggtccatccaccgcgatatagacggagttcgggtccttcgcatataacagtacctgttgagtggcaaagtcagaacgctgatatagcatggcaaaatatcggccctgtgccaccttttcctccatttgcggacgtttgtcgataaatacgtccttggcgatcaggccctgctcatttgcttgacggaatgttttgagccagcgaatatactcttcgtccgaacgacgatcgtatagcttgccgtccttttcatgaggaatggctaggaaattgagtaaatagtcttcaaaagaataatttccgttatctgtaaattcgtgaaatcctatcgggataagaggctgaccgttcacctccggaaatttctctttcactttttgaagcgctttcaaaaatccttctggtgtcctcatatctggtttgccgatcgcctcgtacatatccttccgaaccataaacgtctggttggacacaaaattttggccgtatttttgataatcctgtggcgaagaagaagcgttaggatacccgtatacattcccgtccgtttggcgataccaggacattttcgccggatcagctattttaatcagatacggatcgtatttctcggccagcttgttgagcggaagcaccatcttaccctcgatcatttttttgaccgcgtcctctccccaacccagcgtgacaaaatcaggtagcttgccggaggccagcatggtattgagcttttcattttcattccctgcgggtacgataaaattgacgctgaccccagtcttttgcgtaacatactttgaggtcatatccgtcccccacttgttcgggaaccaggaaaagttcaaataccagtcaaacgttatcggctccttatccgccttccatcctggtacatctgccgtagccttggtcttctcgtccttcaattccgtgacagtaccgcctccaccggacgtacatgccgcgagcaaacccaccagcagaacagaagccaacagccccttctgccatttgcgaatgttcatcataaatctcccccttggatgatgtgctatcccttaatcgagccgatcatcagacccttgacgaaatatttttgcagaaaaggatataccagtacaatgggcagtgtcgtcacaaccatcgtcgccagcttgatcgattgcgaagtgacggactgggcaacgacccccggtgcagcagccatcatctgattagagctggattgggcaacaacccggtacaaatacgtttgaatcggctgaagatccgtattattaatatagatcattccagtaaaataatcgttccactggtataccccatgaaacaacgcaatcgtcgctactaccggcatagatacaggaagcacgatccggcaaaagataccgaaatcgttcgcaccgtctattttcgccgcctcttccaatgcatccggcagttctcggaaaaaagccataaaaataataaggtcaaaaaagctgaacatcgcaggaatgatgtacacccaaaagttgtccagcagtccgagatcacgaatcagcaaatacgttggaatcaatcctccaccaaaaaacagggtaatggtgccaatcagcatatacagcttgcgaccgatcagctccttacaggaatatgcatatgcaatcatagcggtaaaaaacacatgaacaatcgtgccgattaatgtcttggcaatagtcactcccatcgcagtcataataccgttgttggcaaacacagcctgatagctgcccagactgaagaccctcggccaccagtaaatgccgcccctcatcgcgtctgctccttcgttaaaggagttcaccagcacataccacacgggatacaacgtcacaaaacaaatgatcagcatgaagacgttgttcacgaaatcgaatatcgcttcgcctgctgttctgcgttgcaatagctgcatgcagccgtcctccttcaaaatagggatgtattattcacccgcttggtcaccgaattggcaattagcagtaaaatgagagcaagaaccgattttagcaaacccactgcggtagaatacgagaaacggccctgctgaatgcccacctgatatacataaatatcaactacattacttgcactttcattcagcgagttacgcaggacgagaatttgatcgaagttggagttcaatatgccgctgaccgccaaaataaacaaaatggatattgtccccttgatagcgggaagtgtgacgtaccacattttctgaaagcgtccggccccgtcaatggtggccgcttcgtacatgtccgtagatacccccgccattgctgccaaatagataatagctgaccatccaagctccttccagatatccgagctaacgacgatagcccaaaaatagctcggctctgccaaataactgatcggctggtcaatccacccccaggctagcaacagttgattaatcatcccggtatctgccagccacgtcgttaagatcccaccaagaatgacccaagataaaaagtgaggaaggtacgaaatggtctgaatagattttttgaaccgagtagatcgtatttcattcaggaagagagcaaatacaatgggcaacgggaatccgatcgccagcttgagcaggctaatgcccagtgtgtttttgacaatgtaccaaaagttatcatcctccaaaaaggcccgaaaatgctctaaccccgcccatggtgcgcttgatatggttccaatgatgtcaaaatgtttgaacgcaattaaaataccgtacatcggaatgtaatgaaaaataatcatccaaaccaccccaagcagcgccatggtctgcaaatgtctttgttgaacccatttgcgcgctagtgatgatgcccctctacccgatcgaaccggcggctgtggctgtggctgcggatttttccatcctgtactcatacagaagacctcccttctctttaatgtaagcacttacatttattattttagaggcttctgcttcgaatgagtagtactggattttttgattttggtatctaaatttcaggtggggatctaactatacgcacaagttttcttccatcctttggatttttacatctattaatttacgaagaagactatcagatggtacgataagactatatgtaattccaatcattacctatatacctagatcaggaggattaagaatggaagaattggttcgttcgattcagaaacaggttcgaattaaaaaggttgcctgctgggcggggctcatcatgtttggcctgtgtactttagttggcattgcagctcaggaatggcttatgacgctcttggcgctcgcgatgacaattttatccgtctatggattaaccatgatgcgtggtatgacaaagtttactaaagagtatcaaccgggaaagggctacggttattatcgtcgtacggtacaacaaaagctgcgctatctaacttggggacagtggttagtaggcggccttattgtcctgatgtactttatatttaacgtccgacttagcgcttttctcattgctatcttgggtatcctaaccattcagttcagtatcaaaaaacgaattaaaaatcaccaagagcccgatatcactgagttggatgagtttgtacgaatggggattgtttctccgcatgagcagactattggggtatataaagattttctacacctgagccatacgtttcgggggaaccaaattgttatcgttacaaacaaacgcctgatttctgtatttgtggaggaacaggggcgtgcggtgaaaacggaaatgctgctctcgggtataaacaaaatacgcgcaatcggtacgggttttcagggtcaaggtatattgctgtctgtaagtaaccgtgaccataacgagcttcacattcatatggtcgggaaaagcattttcttttctccagagcaattcataggctccttgctacggacactggatgcagtgttaaaaagcagatcatacagcacggaagaaccattcccgtgctaccaacagacaagaatttcattgcacccctcagaacaaggtttgctgcataaacctacgacagcttaaataattttgggacatgtaccacgttatatatatgcgttatgatcgatcttcataatacgccaaatagcaagtaagccctgatcttaatgagcttacttgctattgggtgtacttccacatcatattttcaaatgaactgcctacctgctaaaacaactaattctctactttacttctgccttcttaatgattagctccatgatagaataccgtgatgaggtcatgacttgtaacaaacactagcaagctaaacagactgagcgacagagggcgtgaaatcaattttttcatcctttaacactccttttaaaatagttatatattggtcttgctgtgttgctgtagcttgcgatctgaaaatttcaaatatagcggtacatttcctaaactcatgctcatgttccatacccagggtatcggacagcatgagagattgcaggatatagcccaacgcaactgtaaactgttgttgcttgatataataaagagccagttgatagcagaagcgaaaataataagatacattcacaggctcttcaaaatatttaaaaccttcaatttgttcggcaaatgatttaagcacagcctctaaaggatagtcgtatctcgacgctccctcaacgatggaaagaagccccggtaacagttcttctggattgttacgaagaaattggatgtattcctgcaacacttcggcatgacctgtcaaaatatcaagagcatacaaattagctctggcagcatagcggtaatattcgacctctgcttccccatattgatcgagaccattaaaccagcccaattctgcatatttttcgatgcaatcgcgagcggcctcatacttgccctgtttttggaaggccatgcctttcatgagatgactgtagccgtagtagtagactagcggccgtttggtatgtatgggttgtataggtttcttgcgcgctttgtagagctgtatttcctgatacttttggttgacctggctatacagccgatcgcataaaacaatcatattggcaccatccgcaaatgaaaaagacagcttaatcatgttaacaagtgtgtctagatctgtgatgtcggagtgaacaagatcatccaccgttcccgcctccttgtccgactttttctattcaccaaacaaaagtaagatctaaatcctaactaaaaataacttaattacgtatttattacgtaattaagttatatcataaaaccaaacatatgacaagtgcattatgataatatattccagtttttaaaatagcgatgaaagtggagcgttcacttgttcaattccatgtgaagcaaaggaaatgccctacctgatccatccagtgcagatcgccccgtttgtacaaagccgtaatgtctgtagaaagcatacgctttctcgttctgctcattcacgtccactttgagatgcttcccttttattttttcagcatgctggatgagtcggctgcctatgccctgctcatgccgttcagggtccacaaacagcatctctattttcaatccgtccagcccgataaaacctgttggttcttgacttgtattccattccatccaaacttcaagttctcttaaaacaccattgcctacgatatgatgataaaattgaatgtcctcttccgacaaaaatgtgtgcgtccggcgtacagcccgctgccaaatatcaacgagttgatcatgattttcttcccgataagcaataatttcattttgcacggtacttcccccttatttaaatatcgatattgcatgttttgcagtaagtctaacatgtctatttagaagcatacaaactcaaaaagggaagcggaataattccgcctcccttacactacagcctttacaacgtaacaccgtttttaaaaatagcgagctctctgaaattgtttttctcgttgttcacccaggttccgctggctacatcgacaatgtaatcgacaaagttgcggagcgcatcttccatactgacatcctccaccaatgaaccagcgttatagtcgatccaatgaggttttgccttatacaacggcgagttggttgagaccttcatcgtaggaacaaaggagccaaacggcgtaccgcgtccggttgtgaaaatgacgagctggcagcccgccgcggcgagagctgaagatgccactagatcgttgcccggtgcgctgagcaggttgagtcccttggtcttaagacgttccccgtactgaatgacatcagtgaccgtggaagacccggatttttgcgtacagcccagtgatttatcctccagtgtcgtgatgccccctgctttattgcccggcgacggattttcgtatactggctgcttgtaatccagaaaatattgtttgaaatcgttaatcagatgtacgatcttattaaatacttgctcatcggcagcgcgctccattaaaatcgtctccgccccgaacatttcaggtacttctgtcaataccgttgttccaccttgcgcggccatataatccgacaatcgtccgagtaatgggttggcagtaatacccgataagccatcagatccaccgcatttcaaaccgatgttcagctcagacaaaggtacaggttcccgtcgatcttcttgcacggccgcaaaaatttcatgaagcagccttaccccttcctctacttcatccgacacatcctgggaaagcaaaaactttacccgctccgaatcatattccccgatggcttccttaaattctttcatctcattgttctcacagcccaaacccagtacaagtacgccacctgcgttcgcatgtttcacagcatcgatcaaaatcgtgcgcgtatgtgcgtgatcgtcacccaactgagaacaaccatagttatgcttaagcacaagtgcattttcaaaaggtgaaatatctcctgcttcctgcttgaaacggtttaaaataagttcagcaatcccgttcacacagccgaccgtcggcacaatccacaactcattgcgaatccccacacgaccgtcccttcgccgaaaaccttgaaacgtacgactctcctgttcatataaatgaggagctggcttaggcttataagtgtactcctccacgcctgtcaggttcgtcttcgtattatgcgtatgcacatgctgtcctgcctgaatgggctgaatggcatgaccgatgggatatccgtatttcagaacatgcccaccttcagttatatcctgcaaggcgattttatgcccgcgtgctacatcctcggctagctccactcgttgttctttttgtgctccccacgccagtgtttctccctgcttgtaatcacgcaaggcgacagccacgttatctttatcatgaatttgaatgaattccagcattccggtctcctccttgcttatgctctgggcacgctgttcccggttagagaatcgagcgtctccttcattcctctgcttgtaatttcatacacatgctgtgccgtttgttcagccagcccttcgatctggttcaggtcttgaccccaccatgtctgctggccaagtaccagcgcagtcaattgcttcgccccggcgagagtaccgtcatatcgactccacagttcaccaaacgtacccaacacttcagcttcgtctgccaacgcaatcgactcaccatttctgtctccccgataaaatacgatcagggacgccagtgaaaatacgattctgacaggcagagccttacgttgtgccacatactggagcaaggatggcaagttccgtgtcttgaacttggacaccgaatttagtgcgatactcataacataatgacttacatatggattacggaatcgttcaataacatcgtcggcatatacattcaattccgcttctgacgagtccagcgtcggaataatttcttctcggatcagcgactggataaagttgcccataatctcatgctcgaccgcctgccccaccgtgtccaggccatataaataagctacaggtgtaagcgccgtatgtgctccattcaaaatgcgtactttccgtgtacggtatggcgccatatcgtcgacaatcagtacattcaatccggccaaatgagcaggtaattcttctttaagccactgtggcccttcaataacccataaatgatactgttcgcccacaacaaccaaattgtccttgtaacccaattctgcttgaatttcatgaatccggtcttttggataaccaggtacaatccgatcgaccaaactgttgcagaacgtattcgattcctccaaccatgcaataaactcagccccaagcttccattggtccgcatatttcagtacgatttccttgagagcgtctccattacggtcgatgagctcgcacggaatgatcaccagtcccttgctctgatcgcccccgaagaattgaaagcgcttgtacagaaaggcggccaatttgcctggaaagctcttttgcggacgatcttctagttgatcctctggggcataagcgattcccgcttccgtcgtgttcgacacgacaaaacgcagctccggcttttgggataatgcttcatactccaaaaagtccgaaccgtacggattaagcccacgagtgacgcactccacaacggtatgctccttcatggccttcccatccttaatcccttcaagaataaccgtatacaggccatcctgctcgttaagcttctccacgaggcctcctggctgcggttgtacaatcacaactcccgtattccattctgccagcttattcattttgtcaaattgccagtctacaaaagcacgcaggaagttcccttccccgaattgcagcaccctctcgggatatggttcagtaacgataaagctttttctgtttaattggtctaattcatctacttgtttcatccggagtaacctcccacaattaccataatgatttcatcattattttatcacaatgcacacgttaacaaaatagttttatcaacatttttagtttaaaaaaataataatgacaataatatgaacacgttaacatatgcgtttatataaaaatctgcaaggataccgccctttttctgttgtttcgcatctgatccaagacggttaaggctaactatcaccctatcccgaaaccttgttcttatatacatttcaggagaatagacgcaagaaagcacgggcaggataacactacctactaggcaggaggaacatctatgaagacaatcgcagatactattgtacaagttttggtcaatgcaggggtcaagcggatttatggcattgttggagattctctaaataatatggttgattccattcgcagcaatggtcaaatcgaatggattcatgtaaggcacgaagaagtggctgcctttgcagccggagcggatgctgaccttagtggcagcattgctgtatgtgctggaagcagtggtcccggaaatttacatctgattaatggtttatatgattgccaccgcaatcgggtgcctgtactggctattgccgctcatattccaagcgacgaaatcggaagtgaatattttcaagctacacatcctgagcatcttttcggagaatgcagtcacttttgtgaggtgattacgacaccgcgtcaaattcccagaacggtgacgatggccattcaacaggcaatttcacgttcaggtgtctccgtcattgttcttcccggtgatgtagcagctttggaggcggaaaaggtacccgtccctgaacatgtctaccatcccactgcacctgtagtacacccgtcagcttccgaaatttcccgactggccgaatatttgaataaaggcaaacgaattacgttactatgcggcgccggctgtgcacaatctcacgacttgctcatgcagttatgtgacaagctaaagtcccccatggtatccgctctgcgaggcaaggaatatctggagtatgacaacccttattatgctggattgacgggactgatcgggtattcttccgggtaccatgcgatgatggattgtgacgtcctgcttatgctcggaacagacttcccttacagacagttttaccctgaagatgcgattgtcctacaggtagatatagagccagcccatctcggcagacgtactccgttgacgtatggtttatgcggggatgtaaaagccacattggaaatgctgctaccgcatttaacgtcagagcatgattccaagcatctagagaaaaccgtctcccactataccaaggtacgccaggagttggatgaccttgccgtcggtaaaccaggtcatacgccgatccatccgcaatatctcgccaaggtcatcagtgacgccgcgcaggaaaatgctattttcacctgtgatgtcggtactcccactgtatgggcggcgtgttatttgcagatgaacggtcagcgtcggcttctcggctcgttcaaccatggcacgatggcaaatgccctgccgcaggcgatcggagcgcaggccactgagcctgaccgacaagtgattgccctctctggcgatggcggactcacgatgctgatgggcgacctgctcaccctgaagcagcatcagctgcctattaaagtcattgttttcaataatggcgctctcggttttgtcgagctggaaatgaaagcggccggattcctggaaaacggcactgaactggtgaatcctgattttggtgctgtagcgcaagccatgggactcaagggcatccgggttgaagatccgaccatgctggaggatgccattcagcaagcattggctcatgatggccctgttgtggtagacgtggtggtgaaccgtcaagagctatccatgccacccaaaattaatcttaaacaagcagaaggatttacactgtggatgatgaaagcgatgctgaacggacgcggtgacgagattgtagaactagctaaaaccaatctctttcgttaaatacagacgaagcggagtacattttaacctaaaagaggcagaaaccatacatctagcatggtttctgcccctttggcctgcctgttaatcaaacgagactcagcgtggtctgcctgccgttgatttccgcttcatgagcgcggtctccataaatataagctcaccctcattggacggtgactgaattcgttccaaaatgcaggcggctccgcgctcgctaatctgctcaatcggtcttttgaccgttgttaacggtggagtcgtatacattgagaacccgatatcgtcaaaaccaatgacagagatatcctctggtaccttcaagccgttttcgaatactgcattcattgccccaatagccatatcatcgttagagcaaaataccgctgtcggcggctcctgcaaggaaagcagttgcttcattgcctggcttccgctttcagtatcataatggccttgcacgatatattcatgtcgaatcggtttaccactatcaatcaacgcattcataaaaccctcgcggcgttgctgggtagacttgaagccttctaccccttcaatgatcgcaatgcgttcatgcccactctcaacgagaaaggaaaccgcttcataggacccttccttatcatttgaaatcacatttacaatccccgccccggatacctgccgattcagtacaacaagcggaatgccttgaccgagcacatgataaataaaagggttgtccgcctcgctctggctcatcagaatgataccatcaaaacgcttgcggtgaatggccgaaaaatcggcgtaatcgtcaatccctcgcacaaacagattgtaatccaccccgatgacatgattaactccacggatggtatccgcaaaaaaactggagctggtgccttctgaaatactggtgaaaaacaggccaatcgtatgcgagcgctggagaaccaggcttttggcattaaaatttggaatgtaattgagttgctctgccaactccataattttgcgtttcgtatcttctttaatcagcgggctgttattgagcgcccgggagacggttgtatgggaaacattagccaatttggcaatgtctttaatggtagctgccatatacgtatcctttccttagtgaggctctaaaaaaattatatacccaccataccacaggagccgcccggaaaagaagactttcacaaattatacgcggttatccgcatgtcgacgttgtaactcttgaaccatttctgcatgtctgctgtcagtcagcttgtacattttaccgatgaccagcatggccaaagccagggcaacagccggatagagacaaagcaatgccttgatcccaagcagcgttccagaggactgaaccacattcggaacatacccgatgagcgctagtccaatacccgatagaaaaccagacaaggattgagccaacttacgtgaaaagttaaataacgagtaagtaatcccttccttacgctccccggatgaccattcgccataatcaatgatatcggacacgaatgcccaggtcaccccgttaggaatactaataccaatgaacgaaatactggcgaggattgtaaaaatatatacattggaaggcataaaaaagttaatggagtcggcaatgacactaaccagcatccccagtatggctgtttttcgtttaccgaagcgccgtaccagcttgggcaggaataacacacccagtagcgacgaaccgataataataaaattcatataagccattaattctacatgccccaagttatattcggcaaaatagatcagtagtgcggacttaatattgtacgcggatatggtgaaaatcgtcatcaaaacgagtaccagcaaaggcttgttattcgtaaaggtatgcacgataacgcctatagatagcttctcttttggcccggactggctaataatacgttctttcgttcctcggtaacatatgatgaaagcgatcacaccaatgagtgacataattcccatcacaaccggatagccaacatggtggttaggaaacagtaaaattagcggcatgacaacgacactggtgacgaataatgcgcccagagatcccgcctgacggaaagatgacaatgaggcacgctgatgagtatcctgcgtaatagcggcacccagcgagccgtatggaatgtttacaatagagtagccaattccccagatcatataggacgcgtaagcgtaaatgagttttccagtgggcgaaatattcggcgaaataaaggtaagaatcgtaagaattgcaaggataacgcttccaacgataagaaaaggtctaaattttccacgtgtaccgatatgtttgcgataatcaacaaaggacccgacaatgggatcacagacggcggcaaacagcttgctgaccaggaaaatgcctgcggcggctcctgcagaaaccccagctacatctgtaaaaaatttcagcaaatacaactgccccaaatcaaacatgaatccgtttccaaagtcacccataccatacgaaatcttttctttcaggctaatatgctcgcctgtcttgttgtcagtttggacgctctcctgcacgataggcactcccatacctacacactcctctatatttgtaattattttcacataattagttcaggattttgcaaaattcgattccagtcgctccgaagtgcaagatacagacgaactaaaccatttcgatctatatcttgttcattggaagtcgcttatgggatttttgcaaaatcctcagttgataactattttgttttcaattgctcttaccgggagttttgaaacaagctcctggcaagagctctttttatgaagttagtgagttctcacctaggcaataacttcacttactatgaacaaccgttgggaaattaaaatattgctcggcgttattgtagcaaatattttgtaccattgctccgagcagctccagatcctcaggcgccttaccctcctgaacccacgttccgattaagtcacaaagtatacggcggaaatattcatggcgtgtgtaggataggaagctacgggaatccgtcagcataccaataaagcgggacagcaccccgtagttagccagcaacttcatctgctcctgcataccttcgatgtggtcgttataccaccatgccgtgccaaactggattttccctacagttccaccggattggaagcagcccgcgagacttgccagtactggataatcaaccgaattaagcgaatacaaaatcgttctcggtaatcctcctgccagctcctgtgcgtccagcaatgccgccaatggacgggcgatcgagccatcatttacggcatcgtaccctgtatccggtcccaaatgactgaacatagacgtgttattgttacgcagcgcgtgaatgtggtattgcatagcccagccatgttctgcatactgtttgccaagaaaaaccaaaacgtacgatttatatttcgcctcctctaaaggagtcacatggccttcctccagccccttgctgaatatggctgctgcttcctccagtgtcgtttcttcatagacaacagtatcgagcgcatgatcagatacccgacctccggcagcatggaaatggcgcacccggcttgccagcgcattcaaaaacccttccaggccagaaacatccagtccgctgacttcacccaaccgagccacccaaggctggaaagtttcgcgattaatttccaaagctttgtcggggcggaagcttggcagcactgccactgggaaatcgttcagtttgctgatttgtttgtggtattcgagatggtccgtcggatcatccgtggtgcacaccactgttaccttcgagttcacaatcagatcacgtgcgccaaagccctttccctgcagcttttggtttaccttttcccagattacaggtgcgctctgttcattcagcagctcatagacaccaaaaaagcgttgaagctccaaatgcgtccaatggtacagcggattgccgattagtgtaggtacggttttggcccaagccaaaaacttgtcataatcctcaccatcacccgtaatcaggcgttcctcaaccccattggcccgcataagtctccacttgtaatgatctccgtacaaccaggcttccgtaatatttttgaactttttattttcataaatttcttgtggacttaaatggcaatgatagtcaataatcggcatatccttggcatactgatgatataaggtttcagccgttggattgctcaacaaaaagttttcgtctaaaaacgttttggtcattactttctcatcccttctataatcgtgtttcctagcaatttgttaacgttaacaaaaacgttcgagatactacttgccttttaacaattacattccccatagcagtaggaaatccatatgatttgtacaggacaatacaattataatatgatacctgtacatcatgtcatactggtttgcttcaccttaaatttaatgtttacgttaacaacaattacattgtaaccgctatcctttgtagaggaaagtgatttttatcatgtgagcggataaaaatgatctgcctccatttgggacagatctgttctatatcttctcggtgaccgacaccacaagaaaattccacaattttaattttccgtgatagatcaaactttgaaaacgttttatatagttttctctttttttctgaaaatttctttcttgaaaataccagttattgtattataattgcaatatacatccattgatttacattaaaagtatttcattagttatttcacagagaagaagaagaggtggtagcattgagtacaaaagtgcaagctgttcaaactaaaactatatccgatacaaaaggagccgaccttgttgtcgattgcttgatcaagcaaggggttacccatatttttggcattccaggtgccaagatcgattctgtttttgatgttcttcaagatcgggggcccgaattgatcgtatgtcgtcatgaacaaaatgccgcctttatggcagcggcagtcggtcgattaaccggtaaaccgggcgtatgtattgttacctcaggtccaggcgcatctaacttggcgacaggacttgtcaccgctaatgcggaaagtgatcctgtcgtcgccattgcgggtgcagtcccaagatccgaacgcttgaaacgcacgcatcaatccatggataacgccggactattcgaacccatcaccaaatacagtgtagaagtagaacatcctgataatgtaccggaagccattgctaatgcatttcgaattgcgacctcagcccagcctggagccacattcgtcagcctgccgcaggacgtgttgacttcgtcatctgaagtaaccgtcattgagaaggtctctcttccccaactcggaaccgcacccgccggactcatcaaacaagtcgcagagcaaatcaaaaaagccaagctgcccgtacttcttctcggcatgaaagccagcacgcctgaagccaccgcagctatccgtgctctcatccgagatacagatctgcctgttgtggaaaccttccaggccgctggagccatctcccgtgaactagaagaccactattttggaagagtgggtctgttccacaatcaaccgggtgatatgcttcttggagccgcagatttggtactgacgattggctatgatcctatcgaatacgatccaaaaaactggaacattccggcaaaccgaacactcattcatctggatgaccatcaagccgatattgatcatgattatcaaccggactacgagctaatcggaaatatagccctgattgtgggtagccttgcagaagaattacctaccttaaagctacctaaatcctcctgcgaccaattgaatcgtctgcgccatgatctaaacgagcaagcggctgttcccgcacacaagcatgattttctgattcatccattgcaatttattcgtacactgcgcagcctgattgatgataacgtcacagtcacctgtgatgtcggttcacactatatttggatggcacgatatttccgttcgtatgaaccgcggcgccttctattcagcaacggaatgcagacgctaggcgtagcgctgccttgggggattgctgccacactcgtcaatcccggtcacaaagtcgtttctatttctggagacggaggatttcttttttcatctatggagctcgaaaccgccgtacgtcttaactcaccgttggtgcatatcgtatggagagatggttcctacgacatggtcgcttttcaacaacagattaaatacggaagaacgtctggtgtaaaatttggagatgttgatgtagtgaaatatgctgaaagcttcggcgccactggattacgcgtgcactctcctgaagaactagaaagtgtattacagcaggcactttataccgacggtcctgtggtcgttgatattccgattgattatcaagataacatccagttgggacgtaaactgctgcctaaccaattaaactaacctcgaccatgcctcactcgtgacggctttatgacaattatggagtataacgttttttttatgatttttttgagttattcatgttatttactgaaattttacgtttattattgaaaaagaaagaaaataaatgcatacaattataaaaggaagtgtattgccatgaccgttgcgcaattggaaaccaagcaagaagctgatcatgatatttaccaaacatccactatgcttgctctattagatggtctttatgacggagttgttgcctttgaggagttgcaaaagcacggggatttcggaattggtacctttgatcaactgaatggcgagatgatcgcgttcgatggtgaattttatcacttgcttccagacggtacggcccatcgcgtaaaaccggaagaaaccacacctttttccaccgtcacctttttccaggaagatttcacatatactattgaccgccctatgcatcgtgaagaattggaagctttgctgttaacgttgtttccaagccgtaatctgttctatgccttccgtatggatggcacttttcatgaagtaaagacacggaccgtgcctcaccaagttaaaccatacaaaccttttatcgaagcgaccaagtcacagcctaccttcacttttaatgaggcttccggcgtgattacaggtttttggacacctgcctatgctcaaggtattggggtagccggatttcatctgcattttattaacgatgaacgcactggtggcgggcatgtctttgattttattgtcgaaaagtgtaccatccgtatttgtcaaaaatccaatctgcatctggtcctgcccgataccccggattacttgaaggccaacctgtccagagaaaacctggagaaagaaattgccgttactgaaggtgcacagtaatcacagttatataactcatcaagttacggaccctatagctaaacaataaacagtaaaagatcacagtcagggaagagaattactgctctctgactgtgatttttttatgtacgagcatatatatacgttactgcttatgctctcactccggttcacctatgcctcgatctgatccagtttatctgcataatattgaatagcacgtgagtactcctgtgtagataaatccgaggtcgtctcagccacctccattagcagctcctgcatggctttcccatattcccccagattgtataacaccatcgcgtaaaatacccgaaacggtctgtaatccggaaattcgttcattcctgtgtccaaccacactttcgccttggtgtaatctcccaatacacgatatgtactgcttaatcccaggatggctcctttccttgattctgcggataacgccatacctaggcttttttcataataggcaaccgcttccctctctaagcccaatgaatcatgtgtccaagctgtctgataccacaattctgcatcattttgctgctgttctaatgcctttaaaagaagcttacgtgctttctctgcttgccctgttcgtctaagctcgtcagcttgcgccatgatatcgttcatattcatcctccacttctgactcatgcctatctttgaggtatatgttacccgacatttgaatgcaatgtaaatggagttttccctaggatttgaaatccaaaaaaacgaccctccctttaggagagccgctatatatccgaagctgaagttacggtttatttaaccttcaatgatcctgtagtgagtattccagctacacgttgtgcgtcgaaaatacgggagagctcctccactgccgtcaagtacagtagaccgttgccctccagcttaggagaattaccgagtggaatcgtgcgtttgatgagttgtgcgtataattccggttctgtaagatcacgctcaaagctcgcattcgccagctgcttaatcaacgccaatgcacctgctacgtgcggagtagccatcgaagttccgctaaaggtcgcatatttgccgcccggaacggtggacaaaatatcttctcccggtgcaaccaaatccacctcattatttgaattactgaattctgaggcatgcctatcaaagttgatagcacctacgctaatcacttcattatagcagccggggtagccgagctcgtccgttctgtcgtcaccgtctccctcatttccagctgcacagatgactaagatttggctagctacagccttttttactgcttcatgaagctctggcacatcctcaggaccgccaagtgacatcgatatgatatctgccttttgctcaatcgcataatagatgccttgaataatccagtcatattgaccggagccctgcttgtttagcactttgatgatgagcaggtctgcctctggagcaacacccacgacaccatccgcattttctgctgccgcaatagttcccgccacatgcgtaccatgaccgttgtaatccttgaaaatttccggattaccttgatcatcatccgtgaaattccggccgccaataatgcgcgccttcaaatcaggatggtccgaatcacagcccgtgtccagcaccgccaccttcacgcctcggcctcgagtctggttccataccgcaggagcctgaatcagctctacccctcgcggtatttcattcacttgttgctcctgcttgatcacttggtaaggaatgatatgcactttacgttccatcctattccctccttcatggattcaatcggaaaccatccgtctttgaaactttgaaaacctctactacgttcgaggttactatattctagcaatttttgaaaagtttgaacatccccattttgcttatttttgtaaaaaaacagacatcctccaatttgcttggagaatgtctgttgtagaatctctttcagccttagactgattccgcctgaagttcagccttagataacagcgatttgtgctgccatttccgacccttccagcgtaaatagtggaaaatgcctcgtacccactcatcgcaggcatgtgcaatccacacacccagcacaccatatcccatatgaatgcccagtacatatgctagcgggattttaatcccccacattgaaataatggccatcattaacgggaactgaacatctcccgctgctcgcaaggagttaatgacaacatgattaaacacacggcccggctccagcagtatacagaacagcaaaatcgctgcccctaattgaatgatcgccggctcatctgtaaagatcgccatcacttcatatcggaaaaaggatactaccacgatcacagcaatcgtaatgaccaaagaccatttcaggctccgtaaaagttgatgataggctttttccttgtctcctgctccaattaggcgggcaacaataatttccgtcccctcacctacagccattccaaaaaccataaaaaagtacacaattgtattcgtataaaaatgggttgcgatcgctgttgtacccataaagctgacaaaccgggtcaccatcatttggctaagttgataagacaaccattccagcccggcaggaataccaatcttcaggattgctaccagcttactccattggagctgtacataataccggatgcgaatcggcgcactcacacgcttgtacagcagtagaaaaatccagacacatgctacagcacggctaataaccgttgaaatcgctgcacccgccactcccatctgcggcagaccaaaccaaccataaatgagcagcgcattccccacaatatgcaatatattcataccaatgcccacgatcatcgtatctttagtaaaaccatgcgatcgaataaccggacctgcggttagcataagcgcttccagaaacagcgaaccccctgctagcatcatataaatctctgcattttccttgatcgtcggggtaatatggtaaaaggatagtaaaaaatcccggctcacaataaacatcaagctcagcgccagaccaaacaccagattaaaggttagtgccgaagccgtaacacggcttgcatccacatgcttttgcgcccccaatagctgagcaatgatcacacctacaccaagaccaagcagattgaaaagtataatcgtaaattcaatcaactgtcttgacacacccacagccgatacaacctcatcagaaacatggcttagcatgaacgtatccacgctacccatcaaaatgtgaaacaacatttctataaagatcggccaagtgattgcaaaaaccgtcatcgttttaacgacttgtgcttgcttggaaccgttttcctgagaaagtgacatccttccgtattcctcctaaatgcgacccaattattacttaatagctacacgtcaattaatcaatcataaaaagtcatatgctttttatcttttttataatattccaagcggtcctgcaattgtcctgtgtggaattcaaacttatgtccgtctggatctgtaaaatagaccgatcttttatcctgttcattccgctctcgtccgtgcaaaatggtaacattaaaagttctcagcttgttgagcatactctcaaaatcagcttccgctatcgaaaatgcaatatgcgtataagaatgatgaatttcatttctcgggatatcctcttccacattgagagctaaccacattcccaaacagtccagataagccaacttacgtcctttaacgagcagttttccgtctagtacattctgatagaaatatatagacttctccaaatcagacaccgaaaagcaaatatgattccacccttgtatgctcatgttccctattcctttcagcgtaccctgtctagccagtaggtccatgcttctgtatatatatcgaggtctttaggatgatggcgaatgcaggtagctatacgaaagtataaccccagtaacacttccctgttcagctcgtattcccctgtcatctccggctcaagcttctctaaggcaggcaaaatagtatcgacagtcagcctatccggtgaagaacaaaaggcgtatatcagatcatacagaggttctcctaccactggatcagggtcaataatacccgtcaatgtgccgttttcggtaaacacaaaattatgtaccccacagtcaccatgaagcaaatatttaatattacgttgcggcaatccagccacaagggtatgaacgaaccgatgattctctcggggtaaaacgccttgtatgatcattccagattccttcgttctgtgcagcagaaaatctctccattccacaaacgggtgatccgaatatccataatgacgttcctcaccacaaggcttgtagtacgagatcacctccgttgccagacgaagcaacaaatcgcttttgtttcttccatgatactgtgtgaaccctgacctgaacgtgtataccaaataacggtgcaacggatctacataaaccaaacgcgatagtttctcaatctgtacataggtatgtaagaattctgcctcggcttctacgacagcgggattattttgcttaatcacgtatcgcggcttagttccgtccatgacaactaccactttgctcgaagttccgccagtcagtggtttgagatttcgcatatggctttcaagcacgcccgtttcgtgaagctcattcaggatcagttgaacattcatctcacgcctccctccatgcgtctgatccacaatacggctggcgatttggatatttcatttagctcccacacgttcgccagccactcttcttttaaaaataaatcttttcatgctccgcatagatttcaagcgcacgctccatcttatgcacataggcctcatcctgactagaacatagaaatgtaatgtgtccctcctgcgatggaccggattttggcgaaggttccagcaaattacgctcagacaacacctgtttcaaccgcctaactgttccctggctcccgtcaattaactgaatatgagaaggtagtagttcccttaggatttccttataaaaaggataatgagtacatcccaataccaccgtaccatatatgtcgagattgaacggagacagctcacggttaaaatattcgaacatttctgtccggtcaaaattcaactgttcgcaataatgtactagctccggcagaggtagtgagtccacgctcccatggtcgtcaaccctggataccagcgctgcataacaggattgtttcaacgtcaatggtgtggctaacaccagaactcttttaccattggctcggttcatctcgaccgctggcttcacagctggctccataccaataatcggaataggatattccttccttagctccgcaactgcgatacttgtagccgtattgcaggcaatgaccaatgccttaacatcttctttaaggatcgtttctactgaagccttgacataaccaagcacctcttgaggagttttcgtcccgtaaggcacatgaagcgtatccgccatgtatacaaaattttcgtttggcaaacgtcttagtgcctcggacaatactgtaattccacccaatcctgaatcaaaaaaacctatcttcaagctactcaccttttttcgttcaactattgtgccatatcttacaggcaccatgttcattttcttcttcgcctactcaaaccattctcttcattaggctttacatttaaattttaccgcaaaactgatattttgcaaaagaaacgcgtaaaattcacagtgtaaaaaataaagtagcttttcaaagtaaatttaatataaaagtgttgacagatattatctttatattgtaatattacgtggtaacttactaacttaacttacttattcaacttacttagggggaaataaatcatgtctaaagtattatttgtcaaagctaatgatcgtacagctgaagaatctgcaacagttaaattgtataacgccttcgtagaaagctacaagtcttcccacccaactgatgaaatcactgagctggacctgttctccgtcgagcttccttatttgaacgctaacatgatcaacggcacgttcaaatccgctagaggcatggagctgaacgcagaagaagctcgcctggcaaatatcgctaatggctacctggatcaatttctggcagcagacaaagtcgtatttgctttcccgctctggaacatgacgattccagctgtactgcatacgtacattgactacctgaaccaagctggtaaaacatttaaatacactgctgaaggtccagttggtctcgtaactgaaactaaagtagccctgttgaatgcaagaggcggcgtttataccgaaggaccagctgctgcagctgaaatgtctttgaactacatgaacaacatcttatccttcttcggagtgaaagacatcgtgaaagttgttctggaaggacataaccaagctccagatcaagcacaagaaatcgttgcttctgccgtacaacgtgcagtggacacagcaaaatcgttctaatcatatattatgaagagaagaggatatccgcgccctatatgggctggatatcctcttttttgttataaagtataaaaaacacgtgctcccctgatctataatcaagtgaaagcacgtgtttgtgaaatgagattacttctattttaaggaatgaattgctgcacgatttttacaactttaccctcacgaagcgtaacatggtatggaaattgactgaggtccagaacgtcctttttagcaaaatctttctcaaactgtgccagaggaatcgattcattccattgcacgtctgtatcttctatgttacccgtgtgatcataaatctgcacctctaccgaagcatctggtgcaacctgatacacgtcattttgcacggaattgtttacgatgtagtagccatctggagctccatccaatcctgtatttccttcatgctccaataatgctttgtcagctgccgcgccttcataccattcaatcgggtctgccgacaaataaatctgtccgtcacgaatctccatttggtttatatatacggtctcctgattttcagcagctgctacaggcgtgtagccttgcgctgttgcccctgccgtcgtaatcagcatcatcattaaagccaatacggtccatttcgaagctagtttcatcatgtctgatctctccttgccgtttgggtatgtacacggtgtttgtaagcttcattacccttgtgtacttatcataaacgttgcacggttaaaaagtgtatcagatacataaaaaagaagttacgattttttaagacttggtcttaaaacttgataataagtcctatttatctttgctatcttaataacccgacctgacgtgcctgttcttcggtgagaataaactcttcattttgccatacttcgtcctctttggttacagcaaacatccccataatctctgtccatattcctttgtcgacggcttcctgttgtgtaatgataattttcatttcgtttcctcctcctgtaaaatatgtgcaatccaaggctgtcgatttgtgtatcccacttcgcgatcagatggtttctccgatcgctgttggagcctgattttttgaattatatttaaatggttaaaatcaggttccaaaggcgaacgctatcgcttctccgaaatccatctgcccgcttcgttacccagcttatccttgccattctcatttttcatgagttcacttctaaaaagccaacgacctaaactgacacttaggccaaatataatacttttatttaaagcctctaacccttatatggaactcacaatgcttgtcctagatttgcattatcggagtgcttgaggggttcttgtcccgcttataacatatgtacccttttcctaccaagattattcgtatcttatttgtaaccataaaattttatattatttttgtaggtagtgacttctttagaaatgactaagtcctaaaataaaaacggctgtaggttattctacgagccgttttcactaaaaaattttatatgcttggttaatctgtcagtaccatcaacatataacgtattcgtttattgtttctgcataaaaaatggtcgccaaaagcactgaagaagcggagcgttcgcctttgcccccggatttctacccttgaacatacaaacaagaaatctgggggcaacagcgatcggaagaatgatccgtcctcgtagcggtcacaagccgcataccgttacttagtcactctgcatgatattaatgtagaacgatttttacacggaaaagtaaaatggctgtacgcatactggcttggacacggttacttgttgtccggtgtaggtcaaacgtccacttgccttgtccactttgaacgtaacgatgttgttggtgtcgcggttggccacgagcatatggtcaccatttggagtcaaagcaaaatggcgtggatgctctccttcagcagatacatgctcgactaggctcagcttgccagttgctccgtctacagcgtatacgacaatgctgtcatgcccacggttggaaccgtacagataagctccatcccccgaaatcgcaatttcagcagttgtgttttcacctgtaaagtcagatggcaatgtcggaacgctctcaagctcagtgagcttgccagcctctgcatcatatgcaaaagaagtaatggaagaatccacttcgttaatgacaaaagcaaatttaccattcgggtggaacgtcaaatgacgtggacctgcacctgcatgggttttcgtttcaccatgaaacaccagttgtcctttgctgtcatcaatagtgtaaacgcggatcagatccagaccgagatcttgtacgaacaggaagcggccgtccggactaaagaaactggaatgaggatgtggacgatcctgacgctcaggatgcgctcctttgccctcatgctgtttaacatccagcaactcaccgatacgtccgtcctcagtcagagataccagtcccaccataccaccgtggtagctgactacaataaggtaacgatcagatggatcacgctgaatgtggcaagttgttgcacccacgttttctgcacgattcagcaatgtaaatgttcctttaactgggtcaatttcgaaagcagaggcttcgcctactttcgctcctgcagcagaagtcgtctctccaatggaatacagcttccgatttttgacgtccacattcaggaatgtaggatttttcaagccggagaactcatcctgtagtgtaagtgctcctgtctgttcattaaaagtgtacgaataaactccgttaccttccaattcggcgtaagagcctgcaaatacgagcaatttttgttgtgctgtcatggttgtgtcctccttggattaaaaaaatgatgggcaattggaatgattgctcctgttacaaatatcgctttaagaggcgcgctccaccacgggctctgtggacaacgccacatttcccgctacggcacgcgagatcatgcatgaggtttctgcctgctctgccagtcgcaatgcttgttcgatctgcgattctgtcgcatcggcggccaattgaacctgcggacgatgcacaattcggcgatatgtaaaaatattgttcgttacatcgacaatcccttcggattccagcgccagtgatgccaccgggagactcgcgcgctccatcatcgccgccaacgtaatcaaatagcaggtagcggcggcaccgagcagcatttcatctggattggtgcccacaccagggcctcccatctcagccgggatcgaaattgcagtccgcaactgtccagcctcaatacggccgtcgctgttgcgccccccgttccagtctgccttgagcagaaaggtatgctccatttcaggtcactcctctctcttatattatgaatctttacacaggtgaatgtaaaggttagtcaatctcctgatttttggtttccgtacccagcaaccatacagccgcagctccgatcaagatagctacgaagaaaatcacaaagatagatggtagcgctacgtcctgtcctacgagtataccgaccgcaaaaggcccgataacgcctccaatacggccaaacgcagccgccatacccacaccagttgaacgtacagctgtcgggtacaattccggagtataggcgtacatggctccccatgcaccaagattaaaaaaggacaagcagataccagcagctagcagcattcccgccgtttccgaggtgccaaaccaaatggcggacactgctgtgagcagcaagtagatgatcagtacgaatttgcgccccagcttttcaatcagataggcggcggtaaagtaacctggtagttgcgcaagcgtcatgatcagcacatactcaaagcttttaaccagttcgaaacctttcataaacatcatgctcggtagccacaagaacatgccgtagtatgaaaatacaactgtgaaccataaaatccacagcatcagcgtagacttgcgatggggtcccgaccaaatcgaagccaatcgtgcacgcagcggaagtttgacgctttgctgcttataacgcggtgaatcatcaatagctctgcgcagataaagagcgtacagcgcaggtactgcgccgagaataaatgccatttgccaaccatactttggaataacaaaataagcaataagagccgaaaggatccaacctgccgcccagaagctttccagcagcacaactgctctccctcgttctttcacaggcactgattctgacaccagcgtcgaagcaacaggcaattccccacccaagcctgcaccagcaataaaacgcagcaccagcagcattccgagacctgtcgccaaagcggataagccactggcaatagaaaagatcaacaatgtccacactaatatggcacgtctgccgtaacgatcagccaaaatccccgccaaagcggccccgaacaccattcctatcgaattcattgcagttagcagtccaatttgctcagatcccagatgccactcctttgccaacgctgcgactataaatgaaagcagccccacatccatagcatcaaacaaccagctgagccctgcgctaaacagcaattttctttttttggctggtggtaatgaagttaattcactcatgatttgctctcccttaaaaatatatcgtatgtagacgtatattcaggtgtcttgtcacctgtagcctagcatctattgtaccgtaagcttccttaatctgcgagctttttaacacaaaaaaacggaagattgcctacggcaattctcccgccttctggaacctgccacttaccggttttggaccagaccgatgatcgtcaccatgagcaccagcagctggatgagtgtatcgttactcattccaatcgcctccatcccatatgagatactccttcggccgtttcccctctccccggatcatgacgcttgttccccaatacatacctatgcaggcggcgggaagcttatgatcaatcatggatgaaaatctccatacgttttaaggtttaatccaggaccactgcaaatccatttcctgaatgcattcacggttatcatgttcatcattggccaccagtggggtcaccggatagatgctcatgtctccttgctcatacgtgcgtagtagaggtagcagctcatctatgttctgtacagacggattcagccatgaatctatatgatcagcttccaaaatagccggcatacgggtatcgaattcacgtatatccgtattggcctgaactgtcatcatcgtacaggtgcgtaaaggctccttacgactatcctgccatacttcatatagccccgcgaccgcaaacatcttctgttccggcaataccacccgtacagcacacatgcgtttacccaattttcgccaataataaaatccattgcatggaatgatacagcgccgggtttccgccatcttgcgataacttggatttacccgaaccgtattcaagtctgcattgacacaatccttgccccagtagggaataaatccccagcgaaattcatcaagtactcgttctccatcctgatacagcacaattggaacatgctgggtgggactcatgttatagcgtgttttgtaataatacatcacccgttgtataccaaaatgatccctaacctcatccaaatcagccgataacgaaaaccttttgcacatttgctattcatccttccgcctttttcacctattgtgcggatatacaaggaaaaatatgcatatgcagcttttgcaaaaatccaataaacgacaaaacatatagcaatatccccgcagttgtgaagctacggggatagatactaacttatattgttattacttcttttctaccgcgtgaccgccaaattcattgcgcaacgcagcaaccactttcccgttaaacgtgtccgcatcaagagaacgatagcgcatcagcagggacaaagcgatgactggagttgcagcctgaatgtccaatgcttcttcaaccgtccattttccttcaccagaagagtgcataaccccacgaatttcgtccaggtttgcatctttggaaaatgcacgttcagtcaagcccatcagccaagagcgaataacagaaccgttgttccacacgcgcgctacttgttcataatcaaaatcaaagctgcttttttctagcacttcaaatccttcaccgatggaagccatcatgccgtattccacaccgttatgaaccattttcagaaaatgtccgcttccggatttacctgcatacagatatccattttccactgctgtgtcacggaaaataggctcaacaaccgcccaagcttccggatcgccaccgatcatgtaacaagcgccattacgtgcgccttccatcccgcctgaagttccagcatccatgaagctgataccatattcttgaagacgggcatgacgagcaatagactctttgtaatgagaattaccaccttcaataatgatgtcccctttggacaacatcggttgaagctgatccagcacagaatcaacaatttggtgaggaaccataatccataatactctaggggattgagttgcctgtacaagctcttccaatgtagaagcacctgtagctccataatccttcatttcttggattgcggccgcattgacgtcgtaagcgacaagttcatgcttatgatcgatcaaattttttccgagattcaagcccatttttcccaaaccaattaatcctacttgcattgtaaaggcctcctgccgtagcaaacatattttgtatatactttcttattggtgttaagaacgaacgactgctttttcagtgctttcggacttttcgtccagccaccatgtaaagccttgttcttccaacaattgatctgaagcttctggaccgtaagagcctgctgcatacgtgtgaagtggaacctcaccacgagcaaaagcttccagtacaggttgaacccacacccatgaaagctcaacttcgttccaatgagcaaaaaaggtggaatcgccgcgcagcgcatcaaagatgaggcgctcataggcttctggtacatccttggcctcggaatgataattcatcagaaccgtttccagttgaccagcgtttagcgggtctctgctattcagacgcagcgttaccttttcatccgggttaacatggatgatcagcaagttcgggtcagtcggttgcccttgagcggcataaggatctgtgctgtcctttttgaattccacgacgatacgagtagatttttctttcatacgtttgccggtacgaatatagaacggcacacccgaccattgttcgttgtcaatccataggcgagctgaaatgaaagtatcattttgtgaatctggaccgatgtccggctcttctttataggaaggaactgcttttccgttgatcttaccgttggtatattggcctctaaccacgttggaagcaatgtcggaaggatcaagcgcacgaagcgcgtccatcaccttgcttttttcgtcacgcacctggtcagccgtgacatgtcccggcttgttcatcgccgtcatcatcaacacctgtagcatgtgattttgtaccatatcacgaatagcaccggaatggtcgtagtatcctgctcgctcctccacccctacagtctcggaagcggtaatttgcacattggcgatgtattgattgttccatattccttggagcaatggattagcaaattttaaggcttccaggttttgcaccatgggcttacctaagtaatggtcaatacgataaatctcatcctcagcaaaggttctgcttaggcgatcattcagctcacgtgcggattccaaatcatgtccaaatggtttttcgataatgagccgtttccaaccctttgtttcagctaaaccactttctcgaatattgagggcaatcacatcaaaaaattccggtgccaccgataagtaaaacatgcggttccccggaattcccaagtcattttcacgttgctcagcaagctgtagcagctttttataatcttccgggtggttgacgttcaatgcgctgtaacggaaagcacttaagaactgatccatctgtgcacggtcttcattcacgtgtctggaaaagtccttaatggactgctttacattactttgaaattgctcgtccgccacttcacgacgccccatcccaattacagaaaaggaagccggaattttaccttctacaaacaaattatacaaggcagggtaaattttgcgtttcgccaaatcccctgtcgctccaaataagacaaatgtcattgaatccatgaattattccttcttcccattataaagatgaggttattaaaagttacctgaggaattaacgtaacccataatacacccaaaataaggggcaagtcaatcaaattttagcgaaatcgtgaacattcgatatatcctgtaatgataacgttttctgtggtatgattgacgaaaggaaagagaaaaaactgttaaatatgtcacagttgatacaaagtgttatagttactattggtatacagagttacttttagtatactgtttaaaacaacaatgaaattgaggggattcagatgagcgacgacaggcagcctaagcttttgtgcggtaaggtggaacagtcctttcagatcatcagcaaaaaatggaccgctctcatcattcatactttgatggaacatcccaaacgatttagtgaaattcacgtctctatacctgatcttagcaaacgcatgctgaacgaacgcatcaaggaactagagctttccggcctgatccttcgcaatgtcatcacagagcggcctgtgcgtactgagtattcgctgacacgcaagggtaaagagctaggtgatgcattgaatggtgtggagagctgggccgagagatggctttaactgctaacaggaggtcgccacacatggtctcctgttattgtgttaccccatgtggatcataatacaaactatagtacgaaaataatgggacaaccgctcagcagctcataatttcagaatgggccaaggaaggatgagaacgatggcatttggcattacccgccaggaacttatggcctggaaaagagaggtcagtcgtggtgaaattgcttttctgacccattactggctggatgatcgctttccaggcattacaactgtcaccaaggtaggatgttctgatttggacaagctgcgcttatggtgcaaccaaaacggattagacccccaatatattcatcagcgtcagccctatccgcattttgatctcatcggtaacaaacaagcggaaattttacgtaagtatggcatgagcgatcaatttaaacgctttgaacttcaactcccaacgagtactcgcccatcgttctaaaccgcagctctcagagctgcggtacttttgttttcataccagttaataccttgtgtatccaaatcgctgacatagctccttctcccattgccacagtcgcttgctcggcatgagctcctaagtccccggctacccatacattttccacatttgtcattttgctgcgcggatgagtttcaatatgcttattgtgcagcagatgtacacccagttgctctgccagctctgaatgaacatgattgctgccaaaagctaaaaagccccgctctgctcgaaccacttgtccatcagccagccgcactccttcaaaacagcccggttctccggttataatctcagaaatggctgcttccttatagccaatccctttttcccgcagcttcacaatcagctcgtccggcacctctgaacgctcatgattgacataaacaagttgatcggtacgcgctgacaagatcagagccatggaagctcctgctttaccggcccccatgacgaccgtgctgcgatcctgaacctcgtaaccgtcacagtccgggcacacatatacactgttgcccaagcaggcttgtaacccttccagctttggaaaacggtccgttagccctgtagctaacaacagcgtcttagatgaatacacggttcctgcctccacttgaatgtcaaaaagctctcctctttgggcggcttttaccgccttcccttcaataaactcagtacctagttttgtggcttcactacgtccaagccgtcgcagctcttcaccagaaattccgtcaggaaagcccaaaatattatgatactgatggcacagcgtagatcggccatagcccgaatctatgaccagcacccgatgactgctgtatctccccaattgaatcgctgcttgcaatccagcaattcccccaccaacaataatgcaatcatagttcatcatttttcctcctttgaatgcgcgttatcctagacatctgcataaaaccgcaataacaccaatgtaaacttctcatccaattttaaacataatatcacccactaacggatgaattaacccctgtgtccgtacatatcaaagcttatatgccttaaagatggaatgacaaaaagcactgtggatacccacagtgctttaccaggtggagcctgaatcgtcattttatcgtgaaaattataattatttaaatgtttttacacgttcttcaacaggctggaattctttttcacctggttggaatgtcggtttaccaaatggcatttcagcaatcagtttccaatgctcaggaatgttccattcgtttttcactttttcatcaatcaatgggttgtaatgctgaagggatgcccccagtccttcttgctccagagccgtccataccaccaattgcagcataccattagattggttggaccagattgggaaattgtccgcgtaggcttcaaattgttgttgcagaccagctaccacgttattgtcttcaaagaacaagactgttccgtatccgctgcggaaaccgttcattttctcggcagtagacttgaattgctcctcattgcctacaacctcacgcaaaatatcttctgtaatattccacagtttatcatgatgctctccgagcaacactacagcacgtgaagtttgggagttgaaagaggtaggtgtgtacttaacagcttcctctacaatctcttgaatccgttggtcagaaataacctgttctttgctaataccataataggagcgtctgtctttcagagctgtgaagaagtctttagccatttttttgttacctcctgagaaaaattaattacttttcgtaacttaatatagattacatatatcttaaagtcaagagatttctttttaaatattaccagttagttgatgattatacgccaccattgtattttttctcactggaagaggtgtgcttggttgcatccttgtctctctcctcctgtctttccatcttcaaatcctctacaggaatggcgtctaccgtctgctcgatctcaaaacggtcgaacaagctttcctgctctgtcggatactgctctgcatgatctcgattgatcgactgtttctgatgtttagactccgttgttcctttccccgtctgtcctttctgctgattctgatcgtgcaggttatcttcaaatggggccattttacttccctccctatcggattggtgtccacaatatacttttacctttcacatcggggattaaacgcaaaaaagagaaaatctctgcaaagattttctctactcatgtagttatagatggttgattggattattccgagctggattgacctgtacactcatgaaaaagatgaggttccagcttctctcccgttacgagcttctgcaccagttgagtccccgagtcgggggtcatttgaccataccagtccccttgaggatatacgatcacaaccgcagcatcatgacaacgcccattacagcgagttctggtcgtgtgaatatatgcttctgcattttgtttacgaatttcatcccgaattgcctgtgtaacttcttcaccctcatgtcgcatacatgtgcctccattgcagatcaacacatgatgcttcattggttctaactcaaaaatagccatagcttcccctttaatcaacagttgttggttttaaatcaatgtttatctggataaagaacaagctgtgcttccatctgatcagcttcaatcgtcagcacgatgaatgaatattcgtcttcgccgcgtttgtccgtcggagaccccggattaaggacaagctgaccgtcaatcgttttgaccaccggaatatgcgaatgtccataaatcaggcaatccagcttttctcccttaaacgtattcaatgcgatattttctgtcgttcctcgccagccgtgaccgtgaaccataccgatccgcttgccttgggcttcaacgattcgttgatagcctaaacgctccacgatgtccattccatcattgtttccggcaatgccttgcacaggcgcaaattcagctagacgttcatatacgaaccaatccgtccagtctccggcatggagaatgaggtcactgccttttaactcctgtacaagccgactaggcagtgttttgcttctataaggcatatgagtgtctgaaagtacgatgattttcatatcaatttctccttaccagcgtctttacacagatgaactttgttgccctacgcgctgctgaagtgcctgctccagatctcgcagcgtaacggtctcgaaaaatgcctgtattttctgctctgccacggtatataaaccatccaacaatgcgtctatgttcctgcctacctcacaattatgattgctatcggtatggatggcgaacaacggaccttcatccttggtcgcctcatagatcattttcagattgatgtttgaactggacatgcttagacgaaagccgcgtgctccaggcgacgaatccaccaaacccgcttgcttgagtcggctcataatccttctcacaactaccgggtttgtattgatgctggaagcaataagtgacgatgtcattcgctccggtgccccttcagccagaagaagcagacaatggatactaacggaaaaatgggtactcatgttaaccacctttatgtgtgtgcctcattaaatgtttggtaaaatgcatgtttccatcataccacaatagaggcagcaacacagtgcttactgcaccttactccggaaaatagtcattttcaggacgtactcgcacttttaattggcgtacactatattccaactgcttaacgatatcctccagttgacgacggtcaagtccattaaggtcggcggcaggcttaggtgcatttttcaaatcacgtatggttgcctgctgctcctgccacttgtccatcaggtcggctatattcgcataaaagcgttcgtaatccttgatcacttcatccagaaaggcatccacctcgtccggatcatagccgcgcattttattcttaaactgtttctcatgaatggagagcgcgtccagctgaatgcccagttgcttaaacaactgcttttgcttatccagacgacgcttcatatgttcatccatcggttattccctccttaacacactattctttttatatcacattctaggctgggaataaaagtctctgctgattgcccagccctatgaacgggtataaaagagcatacgtgtcacttatccagaccacgaaggggagagatgatcatgaaccacttgaacgattcgcagcttgcagagctgaaacatatgttgttggagcagaaaaaggatttagaaaagcattttgaacaaaacggtcaggaaaacgctccattgggagaaacactgacagattctacaggtgagctctcgtcctatgacaaccatcccgctgatatagggacagaaacctttgaacggtcccgtgatctggcgattaatgattcgctgcaagacgagctggagcaggtcaatgcagcccttcaacggatgaaggatggaacgtacgggatatgtgtggagagcggtgaagaaattccttttgaacggttgcaagccattccatatacagcctataccgtcgagcacacgccaactcgagaattatcgaatgaccgcccggtagaggaacaggtcatgactccgccacccaagggtgcaggtgagattcgccaacgaaatgcaggacgatttgacgatgcgggcgcatgggatgccgtagaaaaatacggtacatcgaactcgcctgcaactgccgccaagcgtgatgtcaccgattatgatgaaaatatgtaatgctatacgcttatgtattcgttcatctaaaaaagcagcttgtcctttggacaagctgcttttttatgccttacgggaatacggtgatcccgtttatccaatttctatccgtttccgactgcgagctgactcaatacaagcgtcgatcaccttcatattgctcaccgcatcttctggctcatacggcaacgggacaccgtcaagcaccgctttagcaaaagcatccgcttgcagttcaaaggaattaaaacctttcagacgttcctcacgcgtaaccgaaccgacgtggacgaaaatttgcggtaccacagacgttctttcccaaccgaacattttgggcatcgcaatcgtacccttgctaccgagaatttccatgttggaacggttggctgcccacatgccacaatcgaaagtaaggttgactccacccgggaattccagcaagccggaagccatcatatcgacgttgtcatgctccggggaaaataaggcatgtaccgtcactgcctccggctcccggtccaaatacatacgagcggctgatatcggatagacgcccacatcatatagcgagccgccgcccatgtttttattaaagcgcacattatctgcctgatcggtattgttaaacgtaaacgtgcaatggaggccgcgaatgtcaccaatttccccactattgataatttccttaattcttcgatgtttgggatgatagcgatacataaaagcctctgcaaagatcactcctgcacgttgacatgcttcaatcatgcggcttgtcccagccgagctaagagaagatggtttttcacacaaaacgtgcttcccagcctccgctgcccgaatggtccactcttcatgcagatggtttggcaacggaatgtacaccgctccgatttcgggatcagccaacagttcatcatagcttccataactttttggaatatcgaactcccgggcggcctcagcggctttatccgcattacgactagcaatcccaagcacttctccgcgttcagattgctgaatcgcaggaattacagcgatttgtgcgatctccgcagtgcctaaaattccccatttcagctttctacccatcattctcatcctttcgtggttaggaatagttgtcttgttccgctttatgcagcatacctaagcaacggtccaaatcagctttgacctgcttcttgtacaatcgtgctttctcctccccatcatctgtaaagtgatagagtacaatctcctgaaaatccacgcgcgggtctgttcctttcaatcgcttggtacggtaaaaaacgccttcctgtaccagctcatgcagcgcccggtaaacctcgctctgaggcggaacatatccaaagccactaaactcatccttcatcgattcgagcatctgatatccataaccgcgatgcctctccaccattgtgatcagataaattttgataaaagcccgctgggatatcataaacgccatttcacagcctcctccacaccttattcgtgcaccttatcttccattataaaccactctgcgtccatacactatttcctttgatgagataagagtttatgagaactctccatcccttgtgacctgttttaagatggtgagagatatagaatgtggcgatatagagtagtgtgcgaagcgctgagaaatgattttattgttctttctattatgaatttttcatatgttgaaataatgtaactaagcaaaaaaaataaagttacacattacgaagactggattaattgttttaaggcctccgtatcgttacttgtcaaaataggaatatattctgttattttttggatgtcccagtcccaccatttcagggtttggagcatagctatagtttcctcatcaaaccgataacgaattaacttcgcggggtttcctcctacaatggaatatggcagaacatctttagtcaccacggcatttgacgcaatgatcgcgccatcaccaatttgaactccgggcataatgctagcattgtagccaatccagacatcatttccaaccacagtgtcccctttgtagcccccacttaaattgggtacaccaacttcccaatctccgccaaacgctccaaaaggaaaagtggtaaacgcatttgtattatgattagcgccattcataataaatttagctttggctgcaatcgcgcaaaacttaccaatctttaatttgtcccctataaaatcaaaatggtaaaggacatttttctcaaaatccaaagggttatcatcatcgtcataataggtataatccccgatttcgatatatggattaaccactacattgttcaaaaaacacagacttctaatatttttcatcggaaaaacgcttcttgtatctggaccactcatttagcgaccctccccatatggatgtgccttcactttactggtaaaggaacatccagtctatcagcatgtatactattaaacaaatgtagatagaaaagtatcccttggccttatttcttggctttgggatactcttgtgaacatatgtgattgggttatcaaatcaggcttgcttttgtaaggctggcggacctccagtcgggcgaggacgaacccgaagccccacgatccatttacccagaggcaaacgtgccagcagccatgttccagcaacggaaaagatcatacatagaacgaatgaagccagcgtacgaagaacgtgactccagtctgcaaacaacctctcgtcaaaataataggtcacacgtagcataaaggcatgcatgagatacgctccataggacaacgttccgatggccgtcagcatactcgccacacgtccccccttatgagcaatccacgtcgctacccgataagctacaaaaatagacgcaacgcaatatacagccatgactggacgcagcagagacaaatagttaaaggaaagaactgtacctcgcggcgtctggaactgaccgatcatctcatacagtaagtagcctgtaatcacgataaacaacggccagtatatcatctgtgctttggttacccaagcattccaacgcttgacgttcatcccggctgccgctcctagcacaaaataaaagaaaaagtagatcacattccggtcagcgtactgggtgaaccaagaggtaatgaccggaagctggagcttatccatcacttggtatacgggtccaacggcgaacatgagcaaaatatatagtacgccgaatccagccaatgcagcgggtcgccattttgacggcagtagcgcagacaaacggcgaacggcataacgaaacaccggaaataacacataacattgaataatcataacgatgtaccataaatgatagctgcttttcccgttcaacaacttctggaaaaaatccagcgggtgaatatatccaccactttgggcaagctgatttcccaattcgtataaaagagaccatatgatataaggaacgatgatgtccatgaatcttttacgtaaaaacgttccgtactttaaggctccatcataattgtaaaataacaccattccagtgataaatacaaacacaggaactgcaaatttggaacatagcagtaaaagtgtcatcaataccccgtcctggatgcgcgccccctgcgcaaccgcatagtgtgcgacggaatgctgaagaacaacggccgcaaaagccagccctctcagcaaagcgacttcggaaattctctctttttgactcatgtcactctcctgttacatctagcaatttataaatccaggatttttgcaaaatcctcaatctattataacgacaattctgtaaaaatatatagaaggttaaacgtgccaacggcatgcaaagcatcgtttatctcaggtttatcaatgagtaaaaatatgtaaaagcagcagtcctccctctcagggagactgctgctgtaaaaacaacctatatgcaaaggaaataggaaagcctactgtacatcactttcttaactagccgtaaggtgtttacaggttccttctagtatctgtgtacacatctgtacgcggcgtgtccgccaccgtatcatcatacgttctgtaacgatccgcattcagcgaacggttggtgcggaaaatatcataaacatccctgtgatggtcagcggaatccaccagcactaaaatcttgccctgatcgacgtatgtctcgtattgacgtgcatcatcctctggaatgcccagcccgaccagtccaccgaccaagccacctgctcccgctccgacagctgctccggtaagagtagccgcgataggtccagcggcaaggataggtccgatacccggaatagccaaggccccgatgcctgccagcaagccagcgacaccgcctacaactccacctgtagccgcacctgtcgctacaccctccggtgccttcgtgcctgtctcttcgctaatcgcccttagatcgtcacggtcacgtgtgatcacagaaatctcactgcttggaattcctttgctctgcaattgtccaatcgcacgagacgcttcctgttctgtatcaaaaacaccgacaattttcttttcgttataatcgtttaagttattagccatgatagttacctcccaaatattttagtgttgagtggttcgtttttcattaccccactataatgacgtttaaacgttttacaaaaattcaaaaagtcgattagcataaaatagcttctatttaacgctttggctttgctctattggtcgccacagcttccagtggatcatccggccaataatgcttgggatatctgccctttagatcctttttgacctcaaaataagcctcgctccagaagctggacaagtcggaagtcacttggacaggtcgctgggcaggtgacagtaaatgcaatacaattggcacacgtccgcgtccaatacgaggcgtatcccccataccgaacaactcttgtagtcgtacggccagcgctggtgcctcaggatttgaataatcgacaggaatgcgggaaccgctgggtacgcggatatgcgtcggcgcttcctgatcaagctgctgccgctgttcccaatccagcctgccaagcagcaatgcagcactgtcaagccgttgcagatcggatacatttttggctcctagagcaaaaggcaacagccacgattccagtgaatccagcaatgccgattccgtgcagtctggccagtcctcaggcgccgagaagtgcataaaaatcaaacgcgcctgcaactggagggtttgccgattccatgacagcagcttcagacctcgttcacggacaccctgcatcaaggcggcagcaaactcctctgccggaggtcgctcataggacgtttcctttaagacgagtgagcccagccgcagtatcttgcgggctctcactgctgaggcggagctatcccagtatacgttagcttgttccaacagcatttcactgcaatgctcgaccagctcttgcagttcaattggtgccgccaactgaatagcaccgtctgctccctcgtcgtctacttcagcggcgacgagataggacgaacgcgacatccactccacttgtcggagtcgcgccccccgaccgccgctaagcaaaaagcggccatccccccggccctgcgcgatccgatccggatacgcaaagaccaacagcagcccgcaagccgcggagccgtcaggctcgtcctgcgctgcggttgctgttggcagcgtggctagcagctgccggctctcctgcacgatacggcgaatcaccgtatcgtctgctgcccgcagcaggctgtgcgtactgcgggcatgggccgcctcgcgcagggcgtccagccgcgggcgcaaatccgtcccgccatgagcgcggaacgggtcacgctcttgcagcagcgcagccagacggctggcagttggtgccaggccgagggccgcagcacgcaacagcatgtgcccaaggcgcgggtgcgtgcccagggcggacacctcgcgcccatgcgcggtaatgccgcctgtagtgccatcggctgcttcatccagacagccgagctggtgcagcaaacctgtggcctggcggtacgcggcctcaggcggggcatccagccaggccagctcggcgggctcgcgcacgccccagaccgccaactccagcgcgagcggggccagatccgccgcggcgatttccggccggctggcatcggggagcgcggcttgctcctgcgcgctccacagccggtagcatacgcccggctggaggcggcccgcccgtccgcgccgctgatcggcggaggctttggacaccttgaccgtggtcaaacggctcatgccggttcgcgcggaaaataccgattcccgcgacagtccgctatcgatcaccaccgtgattccggcgatggtcaagctagactcggcaattgaagtggccaataccacttttcgactgcccgaagccgacgggcgtattgcctcatcctgctgctccagcttcatgctgccgtacagcggaatgatcttgacatgtgctggtaaatgctttgaagccaattctcgttccgttctgtgaatttctctagcccctggtaaaaacaccagcagatcaccttcatgagcatggagtaccttttctaccgtctcagccgtaaaggactctaatgaagttgacgaaggtttggacatatgaaaggtttctaccggaaatacagtgcctggacattccagcaatggcgcatcccctaataatctacatacaggctctgcctccagggtggcagacatgatcaatatcttcaaatccggtcgcaacagcgcctggctttgcagggcaagtgccaatcctaaatctgcatgcaggctgcgttcatgaaactcatcaaaaataatcagcccgactccctccaacgcctgatcatgttgtagcatccgggtcagtacgccctccgtaaccacttcaatccgtgtgtttggccctacctttgtatccatacgaacccggtaacccacggtcttcccggtgggctctccgagcgcttttgccatttgcgctgctgctgcacgcgctgccaaacgcctcggctccagcataatcatcttttgccctgccagccacggctcatgcagtagctccagaggtgttaccgtcgttttccccgctcccggctgtgcaatcagtaccaccgccgaatgggattgcagtgtatgtttaagctcggggatcacttgcataataggcagttgtttatctgtcaatgaaatctctccaatgatacgcttgatgcgtagaatctaagttttaattcctttattattttgaatttttcattacctgtaattatcgagcactgaatagaaaaggttaagctgcccctctggaacttctcttcggtctgtcgtgcataattcttctaaatctattatacagatatttaaatttcccgtctggccatcgcagctatgtaagttttctgtgttagctcctatacctgtcgggatgcactcgcggcaagatcgttttataatatagttgatatggattgctgaaggacggaacacagaatcgaggtcactttcgtatggaattacaggcccaacccatcagagggcgatttgccccaacaccatcgggatggatacacttaggaaacgctcgtactgccttattatcctggctgcacgttcgttccctgggtggaacctatattttgcgcatggaagatattgatatgacgcgagctcgcagccagttggcgcaagggattatggaagacttgcgctggatcgggctgaattgggacgaaggacccgacgtaggcggtccctacggcccctacactcaaagccaacggctggaacgctaccagtctgcattggagaaactacagaggccagatttactgtatccttgtttttgcagtcggaccgacattctggccgccgcccatgctccacatggactgtctggtgaagggcctgcgtattcgggggcatgtcgtaaccttagctctcaagatgtcgtagccaaagcccagcataaacttccttcacttcgctttaaagtaccgcaacatccagatgccgttatttcgtttcatgatcaggtagcaggtcatgtggcctttggtgcggctgaggggggcgattttatcgtcaaacgagctgacggcatgttttcctatcagctggctgtcgttgtcgatgatgcggatatgtatatgaccgacgtactacgcgggtatgatcttctcgattcaacgccccgtcagctattgctgtaccaagctttggggttgcagccgccacatttcgcacacgttccccttgtcctaggccctgatgggcgaaggctggccaaacgacatggtggcgtagcactccgagctatgcgccgacaaggggtcacaccggaagcagtcattggctggctcgcctatttttccgggctgctggattcacctgagcctgtgaaggctgaggatttaatcgatgactttcatttggataagctgcccaaagaacctgtcatcctgacgaaacaatgcctcacaagattatctgcactgcaacggtaatgaggtaaagcacggagattaaaatgtacgggcaggggcatccgccctttgctcctctcgcttctattcctccaatcgcttacgcatagcggactcatattcataaaatacagacgacgtattcagccctctttcctccagcagcatacggagacgtagtgatttttcagtcagcctgcgactgatccgttgttgctctcctgcctcatgacaagcgtgaagcaaatcacgtagctggacacattccttttgtaattgaagctcttccggtaaaatgcctgcattcttcaacagcttgtacgacatccgcagctcctctggaacatgtgacaaatcctcgatgaccagtggcttgcccgctcccggtaaatgatcaaattcacctttggccatcgcctcggcaatcttctgctctgccattctggagaacatccccatcactccttgttttaagcttcctatgtacaatctatattaaagaaacctggagtcctttgccactgtagcttatatatcattaggatgccctgtttccataagggagagagggggttattcttcgatcccaagcaattgacatacttgtactctatattttttggccttacgtgttccatgaatgagattggacaagcggctagcaggaatatggtaggtatcacaaaaagttctctgatccatttgaatttcaactagattttgtttgattttccagccaaaaggagttacaggatttcgtttgttcaacaacgttatcacctcttcatagtatagatttagaattttgattggggtttggagattggagattggatttcacactcttcctttagcaacatgtcatgaactcatttgttaagatttcattttgtatatttggtatatattcaatagttcatccagtttcatggattgttcaatcactttgggatgtgttaaaaatccatatttcttctggacttagtacagtctttttctggcccgttcgacacgaagtaaagtcacacctggattcatcagcatgattcccccttctgtgtcatatcctaatacaaaacgtaaatttttggattttttgaaaatttgctcgacaaaaaaagtgcttctggagcattccagaggcacttttttggcgttttatgtttatttaaagtgccacagactcctacaagatgaacttaagattcaactattgctttgctacgcagcccgatgttgcttcccatcgtcaccgcccctgtatttcatgaataaagtcagatagggttaaaatccatggcaaatgcgaccgcatcacttgcacagcaacattctgccttcttcgttttccatatacattttattttattcggcttggaataaatactgagaaatgtttaataactattaataataaaataatctttcttttcgcccttctctaactaaactttcatactttgtacacaatctaaagtctgcaaattgtttgaactgctcaaataatcttatacagctaatgaaaaaggcttctttgttaatgactaatgatttagataaaacgtctagtaagtatttaaatccatatgagtaattacctttatttaagtagtatttagccagttcatatttaaaacgcgttgattgttctggaaccacttgatgagtgtacatatcagcagatggttgctgttgggtgatcgaatctatctccgcttcgaactgcttaagtacttcatccacatcaacttgaaatcggttagccgccatcataatattcaatagttgagtaaccatttctttagtggtgtttgatgatacactaatatattcaacataatccggaagcacacttatatctccggataataatttattaacgtaagtattacatagcgcccaattttgaaatagtttaatccaatgcagagtatcctcatctgtctctttgacccaatctaaattaacgtaggcgtatgtatattgtagagcttgttgataatcaccttgggcttcacagacacttgcacacaataaatcagcataggtgatatacacaaacaatggacggctcagcctcttttcaatttccgcagactttcgctttttctgttgatgctctaatgtatattggatttccgctttatctctcatttttcgagcggtcacatcaagcctgtcccacaagcgcaaagatcgatacacattcgccaaatctttaagcgcatcaagctggtctatttcatccagacgttccacgaagggttcaaaaagcgttgctgccttgagattacggctctgatcatctccaacttgaatcgagaatatacgatattgacagatggccaagcgttcagaatgctgatatttctccacttctgcgacattctcatagagaggcagcgcagcagcatgtcgtccctgttcaaataatgcttctgcaacatcaaatagccttgacgcatacagcggattatccatgatatgcccaaccattcgacggatagcatccagcttgtccagctccgcacaacgatacaataatggctcgattcgcctaaaattcggggaaaggtcaatgatgtaattttctatgtatagattgtaaaaatagccttctggcaaatccatagccacagtgattcggtctagctgctgtacggaaacaggacgatgctgagtaatccaattactaagcgttctttgatgaacccctgaatattcggcaaattgactcaacgtcatatcattttgttttagataatcctcaaactccgctgaaatcgtaggtgtatgcttcaattcataaccacccttcacataaaaattccattattttaaaaataatcctctattcttctccataattaaccatctgtcaatatattatgcaactaatgtttatagcgaaaattcagcataacttacacatattgagacatgttgaacgagtgacttcctgaaatgattggattgatccaagtaaaaggtttcacagagttgacatgactaattcattaccccatgtggattctcaccagtaatagtatagaggtgaggtcccatgcagaaactctgttggacctttaaattacatgaaaaatcctctgatgttgatgcaatcaagggatacataggttcatttctctcgctttgataatgtgaagttgattatttctccagtcaccattcctgtcaaaattgcatagattcccatagcgctcatcttatatcccaaagcgtaaaataaccctatacatattgcgtagcccaacaaaatcgctgcatagcgctttaaaaacttactcatggaaattctcataagcagcaactcccaccttaatttatacttcaaccattgtaaatgttagttaattgttgcataaaagtaagggggaatttgtcgaataagaaatccgttaagaagaaatttgcacctattcactgctgggcaggccacgaaacaagccttctttttcataccatccacgcactcacatggagtgcgactttgtgcaaacaccactaaaggacagatcgcaataggatttcaattccacgcactcatatggagtgcgaccaattttgaggtgtacccctcagtcatttggcgcaaatttcaatccacgcactcacatggagtgcgacaccaatttagaaatggctcgggaatatgacgaactaatttcaatccacgcactcacatggagtgcgacctcagacgagttttcaattccttgacccatactgtatttcaatccacgcactcacatggagtgcgactgtgaccacagcatggacaggccatccagacacaaaaatttcaatccacgcactcacatggagtgcgactctgcagagcagatccgaacgatctaaacaaatgatttcaatccacgcactcacatggagtgcgactcagcgcggatctgagctccaccctttacttttagaatttcaatccacgcactcacatggagtgcgactcaaaggaggtacatatggatcaaaaagagtatttatttcaatccacgcactcacatggagtgcgacgccaagtcgagagacagcagcaacacgatcgaaatttcaatccacgcactcacatggagtgcgacaagagccgctgaaaatacagcacagaatgttaaaatttcaatccacgcactcacatggagtgcgaccaaaccaaccgcttcagcagccatccggatagggatttcaatccacgcactcacatggagtgcgacagcgaaaatgcagtaattgataccctaatgatatcaattctacacattgtcgcaaaaattgatgtcaaataagcttggatcaactattgacttttacggttaaatagcaattttaatacttttcgacaaatttcgaggtgcgaaggacccggggtttttatgtgagcttcacattcgcaccttataaaatcagtgggctttccatatcgtaagcttccttagcccctattgctctactttctttttatagctatctccaaagttgtagaaacgcaggctgtcttcttttttgtctatcaattcttctaattcatattttaaacggcggaactgggtcgaatccaaaatgcactcaaacacagaattttacaccctttgtccgtggtctacgcaccttttcacaaccttttccagtctttttctgccttctctatctaatgtacttacatcatacgtaattagtattaacaagatcaacctacttccacaaaaatggagggtactcgtccagatctccacgaatatatctagctaagagcaaagcctgtcaataggacacaagcccccaagacattttctcattcaaataaggatgaatcattttttcctgtttccgttcttgccatgccttcaatacgattttcctcgtatcatcgtccatcatagcagcctcgttttcttttttgtaaaatcctttgccatgaatcattttttgttaataatgtaagaacaaaacggtcgggatatactcctctaagctcttccatcacatccagtgccaaggaggctcgccctggacgatcttctatgcagaaaacctacataagcatagaccgacagcttctagtgcggatttcatatcgttggacaacagtgtataggcaaaagataataggtcattcacgttatctaacggcgggcgcttatggcgtccatggaaataaaaatcatctttttgctgcaagatcagatcatcccacacggaattgtactgaactgccgccgtcccctccaaaccgcgtaaaatctccagctcctcacttcacggacctcttcatgatttcggataaagaggcgctctccactcgtacgaccaagtggcggctgctccgtcatgatccacgcactcatatagagtgcgactctctcttatttcttttcacgcaaggaggacaggatttcaatccacgcactcatatagagtgcgactatacatatcatctgatgatggctgtccctgaatatttcaatccacgcactcatatagagtgcgacactatgtactcaacctcaagcaacatagagtttttatttcaatccacgcactcatatagagtgcgaccttgttcacgttgcggaataattgggccttgtcgatttcaatccacgcactcatatagagtgcgactccatccgaatgtagacgggagctgcccaagtagttgcaatttcaatccacgcactcatatagagtgcgacaagacataccgcgtacccctgtcaccgtcatcatagatttcaatccacgcactcatatagagtgcgaccttacattatcataattgctcttattctatttaagtgaggtatttcaatccacgcactcatatagagtgcgacgtgttgaatttaaagaatcaacagtaagatcggtaatttcaatccacgcactcatatagagtgcgactgagcctgtaacgtacgttcgcggagatgctggagatttcaatccgcgcactcatatagagtgcgacgggaaagtaccatcattccggcgtttcttcgcaaaatttcaatccacgcactcatatagagtgcgactaaaaactcagatttgccacagattggttctccaatttcaatccacgcactcatatagagtgcgacataataaacatgaaaaaacataaggcgatttttgatttcaatccacgcactcatatagagtgcgaccttgtacaaacctacgtttgaggtagaagataaatttcaatccacgcactcatatagagtgcgaccggatgttatagagtctgttgtccggcgagaagtaatttcaatccacgcactcatatagagtgcgaccccacatatccatataataaacgtccctagcagatttcaatccacgcactcatatagagtgcgacaaagagccgctgaaaatacagcacagaatgttaaaatttcaatccacgcactcatatagagtgcgacttaatatcagaagggagggaaaatgaatggcaaagaatttcaatccacgcactcatatagagtgcgacagcgaaaatgggtcaaatgccccctatttaagtaacattctagcgttattttggcaaaaacgcatctaatattacctcatcctcttgcgatcgtttaaaatttgttcacattcgatataattcgacaaaatctgaggtgcgaaactctcggagaattcatgtgagcttcacattcgcacctggacagactcgctttttggcttagcaacaaattcctgcctggacttatttcacctctgccagttctgccacctgtgaaggaggaagcgcacaatcgaatatatttaattcatcgatagcgcatttaaaagcaaggttccaccagttaactccaaagctgaacgttctggcttcgggtaaatacatccggaaatatccactatattgatcagaaaaatacctttatgtcttcgaaaatcataaaggtatttgtaaaatattttatgaaaacattcggcaaaagttgagttattaaccctgttcatcataccggctgcattacctgcataaaccttcccatccgttccagcgccttctccaaatcgacgagcgaggctgcatatgagcagcgaataaagccctctccgcctgatccgaatacatgtcccggtacaaccgccaccttcgcttccttcagcatacgaagtgcaaactgctcagatgacatgccagtagaagtaattgaagggaaggcatagaaagccccctcaggctcatgacaagcaagcccgattgcattcaagccggccacaaacagcttgcgacgttcattgtagctcgccatcatctcatccttggcagccaagccatggcgcaatgattccagcgcggcaatctgtgcaatggtgggcgcacacatggctgtgtactggtggattttcagcatgccggcaatcagctcatgcggaccgcacgcatagcctacccgccagcctgtcatcgcaaatgctttggaaaaaccgctgatgacaatcgtacgctccttcatgcccggcaaagaggcgatactgacatgctttgtcccgtaagtcagttcggcatacacttcatcggaaatgacgaccagattatgtttgataatgagctctgtaatcggcagccaatcctgctccgtcataactgttccagtcggattacagggataattgatcattaaaacctttgaatgaggtgtaattgccgcttacagcgcttgcggggtcagcttgaattgctcctctgccgtagccgccacctctacaattttaccgccatgcagatgggtaatgggttcataggcaatatagcttggtgccggaatcagcacctcgtcacccggatcgatcactgctcgtagcgccaggtcgacggcttcactgctccccaccgtcacgatcatttcgtgcttaggatcataggaaagcgcgaagctgccggaaaaataagcagagatctcctcccgaagctccatcaagccagcattcgaagtatatttcgtctgcccttcacgcaatgcctgaatgcaagcttcacgtaccttttccggtgtaacgaaatcaggctctccgaccccaagggcgattgtatctcctcctgctgcattcagatcaaaaaaagcgcgaattcccgatggccgaatatcccgtacacgcgaggatacaaaccgccctgtccccttttcactaaacatattacgaaatcccccattcctttttccgctcatggagcgagctggcaataatttggtcgagtagctgtgtaaaggttatacccgcagctgccgcactcttcggaagcaggctgttggcggtcattcccggtaatgtgttcacttccagcacgtaaggtctatcctgacacaaaatcatatcgatccttgcatagaccttgcattgcagcagccggtagctggacagtgccgcctcgcgcacacgctgctcaataacggggggaagctcgatcaccttctcctcagcgccgccgacctcatattttgctttgtagtcgaaccacttcgaacgagcggagctaatgctaataatcggtaatacctcgccatctacgatggagcaggtaatctccgtcccttcataatagggctcaatcaagatcgcttgatccaagctgcaagcctcctgaacagccggcagcagttccttctcattttgtacaagctggatgccgatgctggatccccccatattcggcttcacaataaccgggtagcccaaatgctccaccacctgcggatcataatcgtccatcccctgccagtaaaggcctgaaggcgtatgcacacccgctgccttcaacagcatcttggacaactgcttattcatgcataagctgcttgccaggacaccgctgcctgtgtagggaatgcccagtgtctccagcgctccctgcaccgtgccgtcctcgccatactgaccatgcagtgccaacagcgcgatatcaatgcctgcctgctggacctgcgcgattaaatccgctcgctgctcgatcaccattggaaccacttcataacggctgcgatccaaatgattgatcatctcttgacctgtctgcagagaaatctcacgctcagaggaaataccgcccataataacgccaattttcatcatgacacctcatttttcttcaaaatctttatgtggctacggatgttcatccgatcgctattgcttcttcgaaacaatattccttctctatagctcttttcttaatccttatgccttaagaaatttacgcgtctgtttaccgattatttgaataccccgttcgatattttcatctgttactcgtgaaaacccaagccgcaatgtattcgtcccttcgccttcttgaataaaaaacttgtctcccggtgtaaaaatgacaccctgttctgtgcaagcttctagcagctggcgtgtatttacgcctgtcgggaaggtaaggaacaaatgcaagcccccgtcaccagacacctgcgcctcaggaagatgtgcttcacagcatgtctttgtcagctcatatttgcgcttatactctgtacgtgctttttttacatgtttatcgaaatttccgttaagcatatattggtataaaatcgattgatcgattgttgaggtatgaatggtgcgcgcacgcttaatgctttccagagtgtcaatcagtgctcggtctccaagcacccagcctacacgcaagccagggaacagcaccttggagaagctgccaatatagattactccgttcccttggcctgctgtcgctattaagggcgcaatatgcgctcccgagtaacgcagctcctcattgaatccatcctcgatcaccggaatctgatagctcatcattaatttcataacagcgctgcgctttgctggcgacatgacgatgcctgtcggattgtgataggaaggagtcaaataagccaaatcgaagctattggtctgcaatacctcctctagccgctctacatcaataccgtcacactccatcggaatgccggtaatctcaaatccttgcaacttcaaatttttgatcgctgtgtgatgggtcggattttcacaaattgccgctccgcggcgtgcagaagggcgtaaagccgacagcacaatgtcaaagccttctgtaaacccgcctgtaatcagcatatccttgccaattatatcgacgcccttgttctccatataatgcatcaggtaatcaatcagcggcttgtagcccttggcatagccgtagttgagcagcacctgcccttcgattgccatccgatccataaaagctcgccttacatcccccagatcaaacagctgctcatccggagcgatgcttgtgaacgagatagttcccttttgggcacgaatgccctgcttcatcatatccagatcaacagccaatacagcatactcgttcattcttgccttccagtcgatctcccaagtggcagagccgtcagatcctccgttatctacggccgactggcccaccatggcggccacataactaccctttccgggaatcgcatacgtaaacccgtcatcctccaagccttcataggctgcaatgactgtattgcggctcaccttaagcagaacgctcatttctcgtgtggaaggtagcttctgatccgcctgaagcgccccttttataattaaacgattgacgtattcttttacttgtatcgagaccggccggtcacttacgagcttgaaatcctggaacatccttcatcccctccccctataatgatggcatacaagacgagtgaaaaaaaagaaccaccgcactggatttttcatccttcggtggttcttccgcattttatcccctgtacgtcctcatattcttgcctcattcccccgcatcattgcttctcatcgcgcccattgcgagcattgtacatatcaccaagcatcgtgaagctgatgaaagtaatagtcaacatatttttcatccaggctgtcgatcagcgtatggacagtattttctaaaacaataacgactctgccccatcaatgacaatttgtgcaccagtaatgtgacgcgaatgatctgaggccaaaaatgtcaccaaatcagctacctgctcgggttgacccggtccatcagccaacggttgtcctccctcgggaaatttgacggggatggtaatttgctttaacccttccgatttctccgtggtttcatcaatattcgtcgagatggcacccggatagatgacattcacacgaatacggaacttagccagctccagcgcagccattttagcaaaaccggtttgacccgccttcgatgtgctataggctgacatcccaaagctggtaaagcgctgatttccattaatggagctggtaataataatgctgccgccaccgttctttttcaaatgtggtattgtatacttcaccgtcaggaaggtaccatccagattcgtggacaatgtttgccgccaatcctcaatgctcagatcctcaatcggtccgacgaccccgttaatccccgcattagcaaaaatgatatgcagtccgccaaataattcaaccgcttccagaactgccttttccacacgcaccggatcggcaatgtccacgtcaaaagcccgcgctgatccttcacgtatagcattaatttctctttccgtctccgaaatgcgctcattacttacgtcaaaaagagcgacattcgctccttctctagccatttgaatggccgttgccttgccaataccagaaccagcccccgtgattagagcggttttgccttcaaagcgcgcgcctcctgcatatgtgtagctcatatgtatcgctccctttcagtaatctgtataatcacaagattacccaaaaggatatactttataatcactatttttgcgcattttttgctattcctttgctatatttaagaaaagtacgaatattacgcgtattagcgcctctttccttctcctcctcgttacattctacaaatatcttaaagaatcgtatgttctatgtattcatcaaaaaaaggacgtatacatccatatccatggttatataacgtccttttgcttatttatttaccactgcagctcaataaatgcagcatcatcatcaagccccccggtatgggatgcatccagtaatacctgtatctgctcatcagggacaggctcgcgaatggggtctaaatcggataaaccgtccgtatatacctgtaatctcatcggcatatctgcgggaatgcttctttcataccaatgaggcttccctccaatcggcccacgacttgtagaccagcgctccgctgtagagaaagtatgatcgaacagctcgctgatttcctcggcaccgttccatagtcgcaaacgtgaatccccttgccaggcaagtcggagacggccacggccaccacgcttcggcagttcgattttaccgcaaatatacatggactggcttccctgacgacgtttatcttccaataccgaacgcattaagcctgattcgtgatccaaaggctgccgatccagttcctctgccgctgtacctgccaaacgttcaaggtacactctcaattgatcagcagacagatcttgtccccgttccatccaatccagtaaagaagaacccagatagcgggctgcaaaatctcctcggtaactgagcccgacaccatcacacaagacaaaacaacagacggatttatgaatacgtactgcggcgaaatcctgtccgctttcccccatactggcagattcggcagaccttccatagccataacgacacataaaacgactgtgatgagatgataaaggctgatcgcctgtctgagagcttatgtaagcaaattgctgagtcagccttgcattcattcccttttttttgctcgccgggagcagggacagcagtggattcatgcttttacctccttaccgtacaggcgttgcggccgacatttggaacccaatggacaccagttccgcacaggttccgggcagcatcataatggctccttcacctaactgataatctgcctcaaacagcatttctcgatagctttcaggcagtacagaagacatatcacgcaatttcacagcatgttcatcctgcaacggcgtattatgcgtcagacctttccagcgacgggggtcctgaataggcgtttccagcaacctgtcggataaaaatatattttccaccagtacattaccgtccggtacactcatgctcataatacgcttcgcaatcggttccggatcatcgcctgtagaaaccccatctgtcatatgacagaccaatggtgcagggcaatcctgcatccctggtaattccgcctgcaaaatacgttcagcctgcaagaaggcttttgcagaatctgagaatcgtttgggtgtcaaatcgggcaacgagccaatggccgcaatttcatctatccccttaacaccattcagcaggtcatacacgtcgtcactataagccaaaatcgcaatccgatagcgcgctgtcagccgatttcctttggttgaccgaaaaaccatctgccggatcgccaacgatatagcttcatatacaacgtcaatacgccgccgcccctccatcagcatgttcatcgacgcgctgatgtcaatcaggtaaatgattagggcgggagtacgttgtgaagcctgtattgtataattcatagtttgtacatgctcccctcagttaccttctatctccatctgttttgtatctatcattccgcccatatataaacatatgaaatattaaattttaggcagtctaaaattcgtatcacctaaaaagttataaatcgaggaagcccgatatcccacttcacctaccgaacgataataagaaggattactatcatatagtgttctaaaacgcttggcaaagctcttagccttcgcagcgcttccaccttcctgagaggcatacgccttgttgtacagggaaataagctgaagaacgttctccttgtttcgtgcatgcatggactctttttgcttttgttccgcctcggctgctgccttacgagctgcttcttcctgggcggcacgagcttcctgctcttttttcaaagccaagtatttttcatactttgcctgttgatcatacgctttttgcttcgccaacttggcagccgcctgcttgttttgttccttttgggcgagataagcttcatatttaacctgttgagcgataagggcttgctgtttcttctgctcctcctgttgcttttgagcagcaagtgcctgttgtttggtctgctgttccgcttcctgtcgttgtttctccgtcagcaatttttgagccgcttcctgctcggctgccagcttttcctcggccgcctttgcagccttcgctgcctcttcctgcttggctgcctcgatttgccgctgattggactgatctgcaagaatattcacggctgggattccagctgccaatagaacgactgcggccgcagttgtcacgataaatgctttggatcgataccaggcttttgatttttcaggttgctctggcgtcttgggattcaactgctcctctagccctgtgatcgcagccgacacctccacatgcagaggactgccgtcttctacaaaatgatacaacgaccggtatacttctagcgctgcagcaggtttgttttgctgctccaaatcacgtgcctgtcggaacagcttgtccgttaccccacgctctccctgctccagggcagcctgatttatcaatgcagcctgttcagctttgagcggtgcaggcgctgacaaagagggtgcagcttcactggcaaggccgcccaccgttgccgattctattgtttctgtcgcagtaggctccggttctatagcctcaactggaatttcctgctcagtaaccgcattaagtacaaccagccattcgccaaaagtagggcaactgcttaaatcctgactatcccaggcacggctgaacaattctaccaccttgctgccccaccgggattcaagtgattttcgtaaaataaaataacgttcacaaggcgtctgcatttcatgctgatcaaaataactttcgccccacgctttgtccactactacacggtcagaccagcctagcatttctcctataataattgcccctgcaaaacggtctgcatacgcactccataacccgctgtggacggtacgatgggcggcataccctggcgaacctgccaatagagcatctggacgatccattttagtactatacatttgttccacgtccaccaattccacagctgacgtgccatgaggcagttccacttcagaaaaaaacggaagcattacattcggcgccgataaatcacaatgcgccaatcctttttgctccatagctgaaccgatccctgccaatgctctggctaaagccagactatcggaagcctcaagctgacgctgatctgtgagacaatcgaaccatgtcataccgtgaacccatggcatcagcaccgcatacagcaaatcaggctgctcggcgatcagacttccgtttctttctggagtgagcacatcacgcttgcatacctgcaaaccgggaatatccccgtatgcttccatatgctccgattgataaaccatagccgggatgcggaacttcggaaaaaacaccttaagggctttggcctcatgcggcgctccgtttttggcatttagctggtatacaattccctgtcgccctgcttgagcataggctaaaccgggtgcagcgggatgtcgcccaaccacataagctgtgccgtttatgatcaattcgtctcccggattcggttgaaaagacatgaaacatccctctccttacatcattcagtatgctagtattcctcaccttattatatacatctatggatggcaagaaaaccgggtatccgaagatcgcccggtttttcctgaacatcctgtgccaaaccatgaggaatggctcacatattgcttctttatagagtggtgtatgataagttgatccctatcaggcaaggcaacttatttcgtttggtcaaccgtacggaatttgttagcgatagctgtcaattcttggctgatgctattcaaagtcgttacgaaagcttgcatttgtttgctagcttcctgaaactcttggaagaagcgttgcttagtcataccttcccattgaccttccatacctgagatggactgtgtcaaactggaaacgatctgctggctttgctcaccactttgtttaaattggttagccacctgatcaacctgttctggggtaattaaaatgcgtcctgccattttttgcgtcctccttgatgataaataatgtttttgtttatctggttcaaattgtactatggctatttaattccctacaaaaggcaaaggacctaattgttataatcccactttttaactagaaaacagcacctaacagtataatattaacaaaacaaccacctaataagtcccataaagccgggaattgcgaaacgaattcaagtaaattttgcaatcgatccagattgtcccggaacgcgttcccaactaagcgacaggctggtctcttgctgtagacggatcagtaaaataccaatcctgcggactgctagaagacgcctgcatcagaatatcctggtgcaacgtttctatatccgaagactgtacaccagcaatggcatgtacgacagactgcgggttcgaaatcagactgcctccttccgaagcttgcccaggcagaatagacggtgattgctgattcgaccaatcgagcatcgtgacgggtcgtcccaatggttggctggcaaatgacagaatcgtttgatagttgtggtcaacagactgaaactgctctgcctttcggttcagttgtgtacctgatgtatggaggtaagcatggatctgttctgacatccgcttggcctgcatccaatgattcaagatcgcctcgcgtgcagatacatcccaatccagcgattgtaacgcctgctccaaacctgctgttaactgttgaatttgctccgccgcatgctgtagctgcccgctaagcccccgaagcacatccggttcaactcgaatgcgcatatccatcacccttcttctgtcacttcttcattcactgccgactgtttcaaccaatttaataataaatccacaaactgatctcttgaagccatagctgcaatcagccagtctccgttaccactagagctcatccgaaatatccagttcattgcgggacacaggacaaaggctgcccgttgtgattcccactccctaccgttccagaccagcaattgcaattctccctcggctacacgggaactcaaagactgagccaggcttacagacccctctgcatctccgctagcctcggtcagtttactgctgatcagagatacactttctcctgccgactgctcgtaaattttattaaatgcctgcttggagaacataagtgcgggggattcaggcacaagtcgatctacccaacccattttatcaatcaatgtttcgcaagccttttccacattacccagatcgtacagtcgatactcatcgggttcatcagcggatttcgcgagttccactacacgttcgttcgtgcaatggagatagccttcaaactgcttgcctccccgcacatagcgtatacggcaagccctgttggataatcccgcaatagcgactcttgaaaaaacggtaggaggcattgctagctctttgcccttatctgcccgctttagataacccttttccaaaagagtagcttttacctgctcccactcttccgccaactcctctgctagatagcccttaaacggatcttccaccccaagcagtctgtcagaacccaatacgcctgctagaaaaaacagttccttcgccttgagggttattaacttctgcttggaagcttgaaacgttaacattatgagccacctcccttcaaactacaacatgccatcggtcacgaattttcgttatccaatcctcacagctcacttgctctgagaagggaattgccgcttttatcctggtaaatttgcgccgtacgtagtatccctgcccaggtggcaggacttttaggccaccagcagcggcgttcgcctccgaataagggatacgaaagaacgatagatcattcgaatctagtgttccaaatagcataccactttggcttgccttgacatcattaaaccagtccacaccaaaggtaggaaaatcagatggcacacccgatagcacgacatgcacattgcgatcacgtcccaaccgtacaatggcggagagctgatcctttatcataaaatcgttcagttgcttacttaacatatccgcatcatcaatgaccaggagcaattcgggatcattcccttccttgttccgctgttgaacgatatcatacactttctgtaccagaggccccatttcttcttcgctttcggcagcagccttaacatgaggaagatgccgtaatctagatagtcctccgcctccatagcgtgtatcaatcgtatagacttccaattgattaggtgatgtgtaataagcgagcgatataatccaactcattagaaaagaggtttttccaccctccattggactacccacgataaaattgggcccttcttttagattcaggagaaaaggctcaagatcgtcactctgtagacctacaggtacctcataaggaagtgcgcccgagggtccaattgtccgatcccactgctgaagcagttccgacagtggaatccgctcaggtaatggaagaatggctggtgcgtgcttgcctttccattcctgcgcaatgccagcgatattgcgacgtaaccgtgctgatcgttccgcctcatcttcacctggtgaaggcaaagccgtttggaactccagcggaggaacatgtcctttaaccagggcgcggcctggaattaacggtcctggcgttttggctggtcgtcctaccgcataataatagtcactcgggtcggacatttcaaaagaaacagcattcggtatgttactgcggaatttctcaaacacatcggtaatccggttcgccgtaatgataaacgtgatacctagactacctccttctcgcaaaagagattccagcagttcattttcatctggataagcattacggaaattaagatatccatcaatgactatgacaatttgcggaatgtcctcgacagcagaacgtcgataagagcttattgttttgacaccagcctcggaaagcatttccttgcgtacggccaccatcttgaacagataacggaacaatcgcttgatccggtcatcttcctcagccatcataacagctccgatttggggaagttccccaaagtcgcgcatcgttcgacccatgtcaatgatataaccattccaatgattcgcagtaaaacgctgagccgtggacatcagcaacgtatgcaaaaaggtcgttttacccatgccaggcataccgtacacagcccaatgaccatgatccagcgatgcataaatcggctcctgccgctgattgggcaaatcatccaccagacccataagagccttcagctccaaagatgatgatgtactatctatttcggtgcatgcaggcagatttgttaaatccagcaattcaggcagcggtggaagccacggtccctgaagtcgttcgatccctgctttagcagcctcattcgcaatataatcaataaatacttgaagttgtttaggagcttcttcaccttttaagcctgagcttgcccgttctccgcccgtcagtagcgcttcacgtttcccgttcagtctcacttcatggacaggtagtgcagaagaaatatcgctgttgcctatatacggcgcaccgctccaagcaaactgcatctcttcaaacacctcgtcgctacccacttgaaaatatcctcgtcccggcttcgtaatccacgcagcattcggtattttcaacatgtcacggctatcaccttcgctttgcacccgtaagcagatgcggaacctggagttactccagatcttatcatccacgacacctgcgggcttttgcgtcgccaaaatcagatggacacctaatgtccgcccaatcgcggcaatactgattagctcgtccatgaactctggctgatcccgctttaattgtgcaaattcatcaataataataaccagatgaggcagcggttgttcctgccgctgccggagtagtctgtaatattcatcaatatgctgtaaattgcctgcatcgttcaatatcttctgtcgacgaaccagttctgctttaagagatattttggcacgttcaatcaaattattgtccaagttcgtaattgtacccaccacatgcggcaagtttacgaacgtgttggacatgcctccacccttgtaatcgatcagcataaaagccagatcatgcggatgaaactcggcagcaagcgaggctacgatggattggataacctcactcttccctgaacccgttgtaccggcgatcaagccatggggaccatgtccttgacgctctatcttatcatgcaggtttatcataatcttcttgccgcctgctcgcacgcccatcggtacgggtaaggtatcaggatggcggttacgtcgccaccgatctgccacgtccagttcttctacactcgctacgctcatcatatcaaacagaggcagcacagcgggaatatcagaagcagaggaacgcttcaagcgaataggagccatgtatcgcgccaatgcatcggcttcctcttttgataaacgatccggtttaaaactttgctgttcaacctccgccgattctgatttgcgggcatatacgccctgctctttggaagcctccacaatcagctgacactgcatcggcaaagcttctttacgagaagccagcacaatcgtgcacgcatcaatggctcggccgtcctccagtaacaacggcagcagtggttcttcctcaatcagctgggtgtcagataaaacaacgacataacacgggacttccatccctctgccctgacgatcattgcgattatttttacggcggttcagtctggcaaacagaaaatcagctagttgatgtgcactgctactgcggtctgacatcattctctggattcggtcatcatcccacacatgtgggagccagcgcatccaagtccattcactttcctctcgctcgtcatagaaggaagcaattttcacttcatctggcgagtgacgaaccgtcacttgtgccaagatgactcttaacgcagcaagggtatgttcccgttcgccgaccaatccaaccactttagattgaaatagcggtaatgcaatggaagcggcgtctaccagacgaaattcttcttccagttcatccgcagctcccaacaaaggatctcgatcataaccgtctgggcgtggaatttgtaatttaatatggaagggaacttgtccagtcccaatacgcacctgcaaaaagtcctcatcctcaggtgatcgttcccagagtgaactgttgcggtttttgacaatttgagtacatatttgcgggtcaccgtgaatttcatatagtgtgcgaatttgctcctcgcgtttcatttcaagttcttcacgatgcttttggagctgttcccggtacatgcggtcccgttcctcaagcttacgcttgtattccttcttattatttagatagacgaaaaaaggaatcgtataagatgtaagcatcatgaccacagtaaccatctggaacatcaaatagttactgttgcccatcttacctgttttgctcatatatacgtaaaagcctatagtcaccaacgtcatcattaacggaataagtatagatataatagaaaaagacggcttgctcggctcagccggaggccgtaaaatctccagcttctcctctcggagcgccggccttaatctcggggatcgctggtataatgcattcaagacaaaagtcccccttttcgctttctatttcattttaccaaggtttcatataatttcatgtgtgtatttacccatttttttcactttgaaacagagaacgccttccatacacaggcgcttcgtcctgagttgtcgaaaaagcgcgctgaatacgcacagtacagccttcccgcaagcctgatcctgtgagtagctggttatcccccaccctgaaccaaagcccttccgggaactttgcttccataatatattgcatgccttccgctggaggctcgccgaaaatgcgcacacccagcatcaactttaaatgttccaccgagtattcatcagctacctcgatgtcaaaccactctgtttcctgtcgtcctgaaagcacggtcaggatcatctgtcatccctcccgatccttaatatatagcaaagttcacgcaaaaagcctatttctacggaaatatggctatcgtaactgtagcatccgactattagactgtcaatttgttacaaaatacccactccaaaaataaaacagcgactttagtcatattttctcaagttagtagagccattagcatcaataatatgtatttaatcgtttttaatatggggatatacgtcattttgtcgattagttagaactaaattcgattgttacctagattgttgtgaacactttgtaaatttttcagacctttatgtttttataaggtgtttttaaggtaattttaagaaacgggcactacaatgaagccatgaaataactcaggcgaggtgatttttgtgagaacattaattacatttcaaaacaaacgtattcccgtatacttcaatcaagaaaataagcaaccggtacaaaaaacattaaaacttctaagtaacactttggagaataaaatctccagcggcaagcgtgcccttcaaaaatgtcttaactctttgatcagtatagagattgtcggttgtgaagccatcttgcatagcgtaagtgaaaatgattcattggcattgtccctctattaagagggacttttttttgtccacattagacacaaaaaagagaggggcatttcagcaccctctccatatcagcagctttgaaacatgatacatgtgacttaccgcagcctatgcatttgattagactctatttaaagtattctgcgataaccttttttaccgcctcgttccttattctgcgccttctcaatccgtattctaaacagttctagtaaattagcgcgtgtatgctcttcccggcagttgtccagcttttttaagataaaacggtcaatggacatatgactcaggctcctttacagcaagctgcccctgcttttcaaggggatgatcaggctatccatttttaaccattctgtctgttgtttaaacaggtacgttacttataggataaagcagacgggattacataccctttaattagggtaaatacataaagtttcgaaaattttatcacgttaagcctggaagctatggacaaggagcgagcaaaaaccatgagtaaacatatgattaccaaaataggctggaaccttttatgtgcattcttaatcctaacgatgctggctgcatgcagcagggaaaaagcatcaacccggagtatggcccaacatgaagctgaagcacgtgcctacaccgtaacgggtaatcccaaccaaggcgcatcatcccttgatgaacgagctgccaatcatacacctgtccataagcaaggcagcagctatgtcgaaatatcaggtggcgttagcattgataaaaataccgtgaaggttacaggacattccaacctcccggccggagcacggatcaaagggaatcttgcggtcaaaaactccctgttaactgggtacacggatgagacaaccgttcaaaaggatggaagttttgtactccaggtacaacgccccggaatacagggcagtatagatctgactgttctgttccgtccagatgaccaagacaatgaaatacgaaatctgtatggcagcggtggcaacaaattagaaggtccttatgtatatcaatacgaagaaaacaaacagcttctgcatgaagttcggattggggctgaatttgatcctgaacaagaacgcaatacccctttagttaagcccgtctggaacaaacctaaggactacggtagccctcaagtgtggattaagcctgatgtgaagcaagaaggtaactattatcatgtatatgcgcgcagcaatttgctggaagggtcggacgtcaaactcacgattgattttccgggacgatggcagtttggctacgatgatcaaaccaaagttatgcctgacggctccttcagcatgagggccaaaaagccgagccttgccaaccactacaccatagtcataagtttcgaaccgaacgaagatatgtggaccaacgccaaacaggcgtacggtccacaaggggaacgcctttcgggacccttagtcaagtccgcagacgacaaagagggctccaaacagattgaagcccgtatccctatccaacccaaatcgtaactaaacgcagcatctaacttaacgttacggccgttcaccatgaaatacgcttcacagatacagcctatgcgcggtttcctcgtctgagtagatacagaatctagtgtcgtctagccgctacggctgtatcgtgactggcgtgcctatacttaccttctcctgaagctcaagcacatccttattctgcattcgaatgcagccatgtgacaccatcttgccaatggaccatggctcattggtaccatgaatgccgtaatgcggcttggacagccccatccagaacactccgaaagggccgccaggattgggctgtttgttaataatcgtaaattgcccatgcggtgtctgtgtagccagcttgccaataccgactggataactaagaacaatctgatctccatctttcaaatataaacgacgatccgataaatccaccacaatgctgtagttcggcatatattcacccctttataccatatgccgactacaacttagattttcttatatttttacatttgatgcttcactgcagttcggcttaccactccacatcacgtcgccagccgcttcgctgatccctacgacccggggctgtgcttgaacggctatctttcctgcgtcggtctgcttccttacgcgcctgatattccagttcccgctgcatttttcgataattgttcactctggattccgacaattcccctctctctatagcttcctccactgcacatccagcttcgcccttatgcttgcaatctgcaaaacggcactgctgcgccgtttccataatatccgtgaaggtatgaacgacacccatggaatcatcccacagattaagctcgcgcataccaggtgtatccagcagaacggcttgctttgcgatgggaaaaagctgacggtgagtggttgtgtgcctgccccgactgtcttcctccctcacatcctgtgtcagttgaactacagacccggagagccagtttactatcgtagattttccactaccggaagagcctgtcaaagcaactgtacagccaggttgaagaaacgcctccagttgctctctgccttcgttctgcaaagcagaaataacgataacaggtacaccaggggcaactccctccgcttcagcaacccgttgttcgacatcttcacaaagatcacttttactcaaaacgacaaccgggtttaccccgctgttccaagccataattaaataccgttccagtctgcgcatattaaaatcatgattcagcgcattaacaaggaacaacgtatccacattggtagcgatcagctgttcctttgtctcaaagcccgcagcctgtctagatattcgacttttccgcggcaagacggcatggatgactgcatctgacacttcatctggcgtagtgattgctagccagtcccctacggcaggcatttccgccggatcgaccatagcatgtcgtagcttacctgaagccgctccccagcgttctccatccattgtgataagcttcaccttttgtccataatcggcaatcaagcgggcaggacgtacctgtgtatttcctgctctttcctcatagttttgcttccattggtcccaaaaaccgttccagtaatcagaccaaccgtattcatgtatactcattgttttcctcctgaaatcatcgtttatttttgatcgtagtgttattcgataggtgtacattttttctccccgcatgcaaacaacgcaaaaaatccgcaggggtttccctgcggagggtatacgattcaggccgatgtgatccgttcgttcacttaagcaagcggtctctcacggaccactccccagaatcaacaactggataacaagacgcctaaccataaaaaatccgcagggaatcactccctgcggatttcgttggttctactgtccaaccaactgctaagccaagactatagatctatacagtctttaaccgtgcatcgtccgtgcgggagacaagtcattctgctgctgaacccatccattcatgttcgtacgcatataacatcgcctcctcctaaaatttcctttatcatacaagtccatcaattgtctgtcaaggctgctacggaacttttttgaaatctttgtcaagtttcgtttagcgtacctgatcccagcgtgtccacatctcacgcgggttcaattcgtacatttcccgttccctatacataaactgatgcataatcagctcacgccgaatcgttgcaaaatcctcatggtattgcttgatccactcgtttaattcacgttcaggatacttacggcctggctccagcttttctgccagcatctgaagtacaatcaattttttcttatactgtgcagggatttggcgcaacttgccgtccttggaaaaaaaattgcgtaagaccgacgcctccagcgtttcattcaactctgacatctcttcctccccctctcctttttcgaaaataaattgcaccgtcgcctcggcatgctgccggatcagctctggatttagtgtaaaatacaccgtgtttttatcacgtcgttccttaatcaacccagcctcacggagtttggaagcatgatgtgtaacagtcggctgtgataaattcagctttttcgccaaagcttgcccatgcatctccccacgggacaaaagaagtaatatccgcattcgcgttggatcagcaagtgctttatgataattgaccattttatccagttgcatcgttattccacctcttttcactagtacatacttgctatgcaagcgaattcaatcatacaaaatagatatatatctaattatatgtttgctaaaagtggctgtcaatcttcactgtccgttatctctttctgaaaacggctggatattgtgttcgcattgcggtaggattattatttgaaaacttctcacatactgagctatttgcttcaattctgagatccgtttttaatcgtcaaaataatgttaaccctacaaaattggcggaataaaccaatacaactggaggttcatccaaatgcacgacgtaatcattatcggtggcggaccctgcggactatccgctgcaatcgaatgcagccgcagaggtttgcaaactgtcattattgaaaaaagcaacatcgttcactccatttttctgtatccgacgaacatgcagttttttagcaccgccgaactactggaaatcggtgatgttccattcagcacccctaatgacaaaccttttcgtcatgaagcactggcgtactatcgtaaggtagccactcattataacttgaacattcagcattatgaggaggcccagtccattcatcgccaggaagacggtacatttaccgtacataccctgagcaaaggagaaataaccaaaacgtattcgtcacgttatgtcgtagtggctacaggatattttgatcatccgaactatttgggcattcccggggaacaattggataaagtcactcactatttcagcgaagcccatccctatacaggaacccgggtcgcagttatcggtggcagtaactctgcggtagatgctgcgatggaattggtgcgggtcggagctacgattgatatggtatatcgtcgaagtgagttgtctcaatacatcaagccgtgggttcgtccactgtttgacagtatggtacaaaaagggaagatcacgctgcacttaggcgcacgcattaccgaaatccatccagaccatgtcgtagtcactccgctggacactgaagcattccgactcgaaaatgattttgtactggcactgaccggatttcacccggagcgaaaactgctggagtctgtcggcgttcacatggctgaggatctggacaaaccagaatttaatcctgccacgatggaaacgaacatcccaggtgtatatgtcgccggggtcatcgcttcaggcagcaatgccaatgaagtttttattgaaacaggccgctggcacgggcgacaaatcgccgaacatatccaaagctaaataaacgaaggagaacatctgtatggattacagctcacttatcttactggtattggctggtctagggattgttagtggcaactctaccgtgactattgccatggttgtattactgctactgcgggtaaccagctttcacactgctttcccctggcttgaaaagtatggcctgacgatcggaattattattttgacgatcggggtcatgaccccgctagccagcggtaaaatcagtatcaatcaggtgatggagtctttcctgcactggaaatcactgctcgcgattggtatcggaattctggtagcctatcttggcggccgcggagtaactttaatgtctggacagcccattattgtgacaggtctactgatcgggaccgtcattggcgttgccttctttaaaggagttcctgttggacctctaattgctgccggattgctttccttgttaattggccgcagctaaattcgtacaacaaatataggaatacatgatagcaatctgcatgtcgggctgaattcagtcccgctttgtggtatactcatatcgcataatttggtaaatgcaggaggcttgaccgatgtctcgacaatttgtaacggaagctgtaatggtggctatatacggccaactacttacatctcccgcccctgtggaatatatagtgccttacacatcactgctagaactatacgaattccaggacagcacagagccgctcatggataatcctatggacgatcaacatgtgaagcggaaggtaagcgagttgatcagttattttgaggaaccgttgaatcagaaaaaaattcggcgtgcccttcagatgccttgggccaagagcttgcctattctattcgatgccaatacatcactcatcatcattaatgctgttgatacagcgcattacggagaatattttgatccaattgagactgaactggtgttgacagctcagcgtgaatcattacccattctgacggatcaattggactggatccaccgcattatcgaagcttccgtacctgtacatgtgtacgacattgatgattttgattttgcactcgatggcccgatacttaacaacccttgacatacgacatacccgccttgaccacaaaaaagcggcggagcatcatgtacaggcttatctcctgtaacacgatactccgccgcttttcatgtccaaactatttgcacgctatgattgacagtggaacactaagcttgttcatcctcaacataggtgtaaataatgtcatcatgttcctccaaatacttaacttccagatgatggcccttcagataccagtaatcctggtcctccatataaaacgtaatgccagccgcttcatgctgtaatacggggtgctgcggcggctctacggcaattcccagagaaaagcctggatgcaacccaccgccagagctatagcgaacaaaaaaacggatcgaatctccacgattcaaactaagctccttaatgtaccactgtgccgcaggttcagttacctgtatgctcatacgttatgctcatctccttgtacaatgacgtctgccaactatatcatagcatcttttagaatgaccaccaaccggtctcaacccagcgagcttcttggacaagtcatatacatttttttgaaaaaggtttgacaattcgcaaaaaagggtgttaagattcaaccatacgagatccattttgaaatttattaccaatttgaacgattactcatgttagaatgaacccattttgaggaagaaaggagtgttaccggtgctaaaatttcctattgcattttacccacatctgcaaacacaacaacttcataccggagcatctcccctgtcgcatccttcaaaattgggccattcgcgttgtatggtttaatacgagtggctgcctgcgtttgagcagtttttcagtggtgagtgtgctgaaaatacctgcgcgccatatgatattgagatttaaggcatatcgtctgcggacggtatgccttttttgcgcctgttgccggatcatatttgtggtagcaagccgctgttgtttcttcaaaatggtacacaactctcgaatgaacttatcatgaaaggatgggattcctcttgttttcggtacttaaaaatttgagctggttttttaaaagagaacgaagccgatactccattggattgtttttgctgatagccgttggtgtgctggagcttgctccacctcggctgcttggtagtgccattgatgaaattgtgcgtggttcaatttcctggtcctcactttggcgttatattttgtacatcataggcattctagccgtcatctactacattacgtacatatggatgcacaagctgtttggtggtgccaatctggtggaacgcttactgcgcacacgttttatgaatcatctgctgcgaatgacccctccattttttgaacgcaatcgcactggggatctgatggctcgtgccacgaacgaccttcgctccgtagcaagtacagcgggcttcggtatgctgacactgacagactctacggtctatctgagcgtggtattagttgccatgggcactctaatcagttggaagttgacactggcagctatcctgcccctaccttttatcgcactggctatgagcatttacggtaaagccgttcacgagcgttacacactggcacaagatgcatttggtgatatgaacgatcaggtgttggaatccgtggcaggtatccgagtcattcgcgcctatgtgcaagaacgaatggacgaaaagcgtttcgctgatattaccgacgatgtatttcgtaaaaatctggctgtcgctcggatggatgctctctttgaaccaacaattcgtttatgtgtaggacttagctacgtcattggactcgggtatggtatttatctggtatttcataacgatatcacgctaggcgaactggtctcctttaatatgtatctaggaatgatgatttggccgatgtttgccattggagagctgattaacattatgcagcgcggtagcgcttccttggaccgggttaatgaaactctcgatgtccagccagatgttcaagatgcagctcaacctgttccagtggatcgcctcgaatccatcaggatgaaagacgttaccttccgttaccctatctctactattgacaatctgtcacatgtgagtctggagctcaaacgcggagaaacgctaggtgtcgtcggtagaacaggcagtgggaaatccacgctgctcaaacagctactacatgaatatccgacgggtagtggtgatattttaatctccggcatacgtctagaggacattgcagtagaacaactacacagctggatcggctacgtgccgcaagagcaaattttgttttccaaatcggtgcgcgagaacattcaattcggaaaacctcatgcagatgacgacgacattatggaagctatccgtactgctgccttcgaccaggatttaggtaccctgtctgatgggctggatacactggtcggagaaaaaggtatcgccctgtccggcggccagaagcagcgtgtttcgctggcgcgcgcctttatcggtgatccggatattctattgctcgacgatgcactatctgcagtagatgcccggacggaagcaaggattattgacaatatccgacgtaagcgctcgggtaaaacaaccttgatctccacccaccgcctttccgctgtagaacatgcagaccggatcgtcgtgctggagcaaggacgcattattgaggaagggacccacagcgagctacttcaggctgacggatggtaccgacaacagtatgaacggcaacaagtggaatctgatctgacctcaggggaggtatcctaatgaaacccaatatcggcaaaaggctatttcagtacgcgctgacgagcaaagcaggctttatcgccgctctcatcgctttggctatcggagtagccgccgagctggctggtcccttcatcgctaaaacgatgatcgacgaccatatgctcgctattgaaaaaccattttatgaaacgactcgtgtggacggaactgtaagctatgctggaacccactttaagcgtgaagatcgctttgagtccggggagactaaaggtcgcgaagcgaggattttacaagttgggaaatctttcgtatttgtcgatggctcggttcaagtggctgacggtaaccgctcctttacgaacggaacgctgactgtgacacgcggctccgaaacctttcgctatgaagctaaggctctgacagctgatgaactgtatagcttttacaaaccggaaatgcccggtatctttcagctgattggctggtattgcttcttcctggttatttccatttttgctgaattcggcaaaacatactggctgcaatcctcggcgaacaaggtcatacaaaagcttcggcttgatctctacgctcacatccagcggctgccagtttacttttttgataacttgcctgcaggcaaagtcgtatcccgtgttacgaatgacactgaggcagtcaaagatttgtttgtggctgtgctctccaatttcacttcagggattgtaacgatggcaggagtatatgttgcactctttttgctggacttcagactgggtcttatctctctgtttattgtaccgttactgatcttgtggattgtattgtatcgcaaggtcgccacccgctataatacgatcattcggtccagactcagtgaaattaatgcgattatcaatgaatcgattcaagggatgtccattattcgcgtgttccgccaccagaaacaaacgcagcaagagtttgaagaactgaatgatgactatatgaagcatcagaataaaatgctgaatttgaacgctttcacttcgcacaatttagtcaacgtgttgagaaatctcgcctttgccgtcgtgttgtggtatttcggatctgaggcgctcggaactacaggtagtgctgtttcactaggcgtattgtatgccttcgtcgatgtgctgggtcgactgttccaacctatgacgggtatggtcaaccaactcgccgtactggatacttccatcgtatcctcaggacgcgtatttgagttgatggacgaaactggagagccggtgacggacggcacgatgccgcgctacaaaggccaggtagagtttaacgacgtttcctttgcctacaaaaaggatgatgtacttaaacatatttcctttacagcacagcccgggcaaacagttgcccttgtcggacataccggatcaggcaaaagttcgattatcaacctgctattccggttctatgatccgcaaaaaggaacgatcaccattgacggaacgtctgtcaaagacatccctaagcaatggcttcgccatcatatgggtattgttcttcaagatccatatttgtttacaggtacggtagcctctaatgtcagtctcgaagacagccgaatcacgagagaacaggtgaataaagcgctgcatgacgttggagccgacaaattgctggcccatttgccgcaaggattcgatgagcctgttattgaaaaaggcagcaccttatcagccgggcaacgccagcttatttccttcgctcgtgcactagcctttgatcccgcaattttaattctggatgaagctactgccaatattgacaccgaaacggaagcgctcatccaatccgctcttgaggtgctcaagaagggacgtacgacctttatcattgctcaccgtttgtccaccattcgcagtgcggaccaaattttggtgctgcatcggggtgaaattgttgaacggggtagccatgatgaacttatggcccaaggcgggcgttacttccaaatgtatcagctccagtcgggaacagttgcaacagaatcagatccaatctctgctacgcctcctgcgcaagatgacttgcttactggcaaagtcagcatttaaagcttgaatagcccaattgcttagggctaacgatgaacatttggcatgaaaaaaccagcgagcctctcctacacattggaggctcgctggtttatttttatataggacatatggtttgtaattttatttagctacagacgtgcctgtttcggtgggcggaagcactgttccatctactgctttgagcgtaaccttatacttgctgtctaccaacgtacttgtgtgggtatccgtaatgacctgaatattcatttcccctggctttggactagtcagcttgtagtaaattactgcattcgtatcatctacgtagtcgatgtgatccacttcaatgccgtaacctggattaggtgcctgcagacgggtgattgtcactttgttctgctggtcatttgtcttctctatgctcatactaatattattttgttgaaccggatctacaggctcagccggattttcaggagtagcttcaaccgttttatgactttgtacaaattcggatgcgttataaaccatttctgctgcctccatccgcgttactttatgatccgggttaaagttgctctgttcgtccaattttgcaattttggtcaacagcaggaattgaactgctgcgtttgattcctgatctaatttttttccatccgctacattaattaacatacggacagttggatattcacccgttgcactcactgctttatacagaatattcgcaaattgttctcttgtcatacgggtgcttggatcaatatctggtgacaaagggatttggtgttgggccgcaattcgataggactgggcataccatgcggaagccggaatgtttgcaaaggaacccgttgtgaaatcaggcattacctgaagatccatcgcacgaacaaccaaatgtactccttgtgcataggtgagcgtttgatccggtgcaaatttatccttggttattccttggataattcctttatcctgaagtgagtttacgatcttctcctgttcagctccctttatatcacgaaaagcagaagccgacgtagccacagccaatgagcagacgacaagcagggcaactgccacgcttttattttttttcatgagatacacctccatgtttactttgcttctatacttaccgacgcaataaaaacatcaaatgtttcaaatatgcacaaattggttgcaaaacagtgcaacagctgcgtttagtgtaacccatctaactcttttctgctcactatctttatacatcctcaaaagtgcctggacagattaccttttacagtgtccccttggaagaaccgaatctgggtagcggtatcccgccggcaaacctcgttcccctttgttctctttgcttacatccgattcggtgctttcagaccaagaagttgcagcgcgcatgccagaatatccgcagtttgttccgccaattgaatacgccagcgtccaccatcgacaatcctttccttggcgtaaaaacggttgaacgcctgggccgtatccagtgcaaatctcgcaataaccgaaggctccagttggcgagccgcacgtatcagttgtccgtgataacgatccaactgcttaagcagcgcccaacctgcgtcaccaaacatttcatccgatatgtcattcaaatcacgagaatggctatcttggacaagggcgttgtcgctagaattagtagtaacatcaacatcggcgcgagcatgagctttctccagaaggctgcgtatgcgcgcatgagtatactgcacataaggcccggtctcaccttcaaaggtcagcgcctcctccaacgaaaaatccacttcattcagccggttgttttttaagtcaccaaaaataatcgctccaataccaacgtcctctgctactgcccgttgttcctgcaaatcgggattcttctgagtaatgatggcttgagcacgggctatagcttcatccagcacctcttccagtttgacaacttttccacgtcttgtagacattttcttacccgcaaaccgcattaatccaaacggcacatgctcacactgctccgcccatgcctctcctgcatgtttcagcaccgcaaacacctgctggaaatgcagcttctgttccccaccaacgacgtacagaagccgatcagccttcatcacttcatgacgataaatcgctgttgccagatcacgtgtcggataaatggtagtcccatccttttttagaataagacatggcggcagttcctcgtcttccagacgaactacgagcgcgccatcactttcctccagcaatccctttgctcttaattgagcaacaactgcctgcatcttatcattgtaaaaactttctcccagcacatggtcaaatgtaatgttcaggcgctggtacatacgatcaaattcacccagactgacttcaacaaaaaactcccatagttgttgagcctcagcatccccatgctccaaacgtcggaaccactcgcggccttcatcttccaaagttggatcatgctcggcctcctgatgaaaacgaacatatagcttcagcgattcaccaatcggatcatgttgtagctgctcctcatttccccatcttttataggccgcaatttgcttgccaaactgtgttccccaatctccaagatgattcacactaattggaacatatccggtttcaccaagaatacgatacaaggcagcaccaataacagtagagcgaagatgaccaataccaaacggtttggcaatattgggcgaagacatatcaatgaccacccgctgtccgtgtccgatattgggcctgaggaaatcagctttactcaattcagcaagcataagcggaatatgaaccgatcgatccaatgttatatttacgtaggcacccgatgctgaagcagtcaaaccttcttcatggctcactagctccgctaattccattgcaatgtgctgcggagactttcgaaactttttagccagcacaaaacagggaaacgctacatctccccattcaggctgcggaggcacctcgaataaagataaaatttctttttcctccaagcccgtatgggccaatatcgcttgagcagcaaccctcactaacatgatctctctccttctttttatagaatctaacaaaaaaagctcccgcctcttgatataattcaagagacgagaacttcaatatccccgcggtaccactcttcgtaaatcggttgtgcagctaaagctaacttacacaaatcgcgatttcactccaatgactaataacggtgtctgccgggctgatctactagaaattctgctcgttggatcaaccgtctcccgggtgcgcttcacatcggacctcataccggcttccacctcttccggctcgctgtaatgatacggctccgctgctactctcccgttccatgacgttaattccaattattatacaaacctattcagtagaaagcaatcttttatttcctcttcaggcactagttccatatatgtaattacactgccaccaattggcggcatgcctgaacgcaacgacggcaggcttctgcacaatgtttgcaatgatcatgggaatgcttgctgcattcagcagcacatacctcacaggccttggcgcacagctcacagatttgctcggcaaaatccgttccgcgctgcagcatttgagcagcaaatccgcatatttctgcacattccctactcactcgaatacattcacgcagcatagctaaatcatattccttcaaactcgctacgtaacatacattgcaagcgttcatacattccaggcaagcatccacgcattgttggtatgaatgattcatattacattacctcccagttgttgaccctgctgtactattacccgctgatccttgagtttaatcatttgatgtgcgcgcttacaataaaataaaaacaaaacaatcccgacttatgtaaggaagtgtactatattccagtatgtaagtgcaaggatattaatcacatggatttttagcccttgtttctgacttgcatacactcagtcattgctctattgtaaaaagtatatgtctaaccatcgatcaaggagtgaacattttaatgaatatgtcttccgtagaggagcatcgacaggaatccccgcaacaggttaattgcatggtcgtgactgtctcggacacacgtaccgtggaaacagataccgggggacaattgctcatggatctactagaaaccaatggctataaggttgttcgatatgtcatcgtcaaggatgactacgaaggtattcagcagttagtatccgaagcagcggcacagaatgacatcgaggctgtacttttgacaggcggtaccggtatttctccacgtgatactacatatgaagccgtctcctctctactggataaggaactacctggctttggggaaatcttccgttatttaagctttgctgaggacattggttcagcagctatattaagccgggctgtagctggtactgtgggtcggacagctgtattttctatgcctggctcacggggagccgttcgtttggcaatggaacgcattattgtccctgagctacgacatgtgatgagagaaatttataaataagctcctatttcctacatgccgcgacacaaaaaggcaccccatacattcatgaggtgcctcttccaactattctttttcttcaacttcgggctgcatatagctgtcgatcagcttttgcttcagctcccataccttctcgctcagatttacacgataaatttcagggttcagcttccgcaaatattctggccaaaacagtttcaactgtgaagtatggtaagcacgaatttcatccagctcaggaagctcatataccttctgtccatttataaaaataggctcaagcattggcacggcttcataattttctacatacttcttcatatacggatgtaaagggttaaacagcttcaggcgcttaccattacgcggacgctcttcatccgggaaagaaatataatcggctacagctctccctttcttcttatccacaatgcgatatacatccttcttgcctggtgtggatactttttctgggttacctgagatcttaatcgtcggcaacatttcgccatccacttctcgttcaaccagcttgtacaccccaccgagcgatggttgatctgaagccgtaataagctgtgttcctacaccccatacatcaatacgtgccccttgggctttcaggttaaaaatcgtattttcgtccaaatcattggaagctacaatttgtacgtaatccaaaccttcagcatcgagcatttcccgcgcctgaatggatagataagccaagtcaccgctatccagacggattgcattcatacgcttgccctgactctccagcatttttgctgtccgaatcgcatgaggaacaccgctttccagcgtgtcaaaggtgtctaccagcagtgtaacctggtctggcaaaaccttcgcatatacgtcaaacgcctcctgctccgtcataaaggtctgtacccatgaatgggcatgtgtccccttcgtcgggattccaaagtgctcgcctgccagcatattagaagtcgcgtcaaaacctgccacataagctgctcgtgctccccaaatcgccgcatcagcttcctgcgcacgccgtgtcccaaattcgagcagtgtatcgtcacttgccacctgcttgatgcgtgatgcctttgtcgcaatgagtgtctgatagttcataaaattcaacaatgccgtctcgacaagctgcgtttccataatcgttccttcaacacgtaccagaggctcgttcgggaaaacaagtgccccttctttcatcgaatggaccgttccaccaaacttaaactggcgaagcgcctccatgaacatgggatcgtatttctcctcctgttcagacaggtagcgaatgtcctcttctgtaaaccgcaaatttgcaatataattcacaatgcgttccagaccagcgaacacggcgtatccattaccaaaaggaagtttacggaaatacgcctcgaacacagctttacgctgatgacttccgttcacccaatgggcgtacatcatattaatctgatatttatctgtatgtaatgcgaggctcgttgactgcatcgtaatcatcctctctgactgtccccaggtttgtggtggcagcgtaccgccccatctgcccagattcagcaatatccggctccattttgttatcggacattggtgcacaatcgttaagttattttacttcttctggcgtaaaaccgtatcctcagccgaccgtaccgcggctccaagacttccttcaaaatgacccaaagcccaatcatgtccagcttgattaaagctcgccacagcgtccttgtatacggtaatagcaaaacctttgttataagcatctacagccgtatgcagcacacatatatctgtacacacaccaatcagatgaacttccagaataccacgttcacgcagcctgagctccagatctgtgcccgcaaaagcactataccgtgttttatccaaccagtagataagatcactttgttgctcatagaggctacgaagcttgccatacaaatgtcgtccgttggttccacgtatattatgtggaggaaacagcttgctctccgggtgataaaggtcgttctcctcatgcaaatccacagccatgacaacaaagttcccttgatccacgtatgcctgcgtaattgctgcgatccgttcatccaactcaatcgcaggttgtcctacaggcaaactaccgtccacaaaatctttcgtgtaatcaataacaattagtgcctgcatcgtacggtcagctccttatcctcaaagtgaaattgtacattctatgcgtaacctattacattagacgttacgtgtagatagataaacgcggtactctgtcactaaaccggtacaactgtgcaggtctttgtgaatactggttggaactgagcggtttgccgttctcatcacgcacctcttccagtattccctgcctgctacgagtcgatgttattttgcgaataaagtttggctcttcgaaatccggtacgacactctgaatcacctgatataattcacccagtgtaaaatgtagcggtaaaaactgcttggcgatcgtcgtctgaagcatctgcaactgaattttgcgataagcatctactatgatatcccggtgatcgaatgccagctccaattcctccaacgcttcgcggatcgtgaataacccgacctcggaagcatcatcggccgcctgacgctgttccaacatccattcttctaccagcgcaaaaaatgcatgtgatatgatccacccgcgcggatcacgtcccggtccactatatacacccaaatactccagatgcccgccgtccacacccgtttcctctaacagctcccgcttggcagctccatacatagattcatcttcctgacaaaaccctccaggcaaagcccaacgtcctgcaaacggccaactgcggcgcttgatgagcatcactttcagctctcgaataggcaatgtctttgttaccgtcttgcgctcccgcttcgttaaggtaaacataacgatatccgctggagctccatccggggtacggtatttcttaatgttgtaggacgccttttgcgcctcttcgtttatacgattgctatccattggcatcaccatattatatcgttttgataaattcattatgacataataaaaatttttgtcaagtgtcaggccttgcctgaatcacttgcttgtgtacgtaatactcggaaggttgctgtagatgtagaaccgagtgtaccttcactatctcttacttccgcctcagtggttatagtgcgacctccttgatgaagaattcgcgccctaacctccagtcgtccttgcctcatggctgacaagaaatgaacattcaggttcgttgttacacatggatccatatttcgtgaagccatactgaccatccccatcgcctgatccatcaatgaagtaagtacacccccatggacaatacccatcacattggtatgctcttgtttggcctccaaagcgatctgtacctcgtttgcatcagctgcaatcagctcacaccctaaataatcccaaaaagtattattttctccctctagcatcttacccaacttatccattcccttgcttccatcccttcgatgttgtcccatttctcttgatgtcttatagacacatacgatagtaaattgctttcgaaaaaaaggcgtggaagctacgcctccacaccatagatttcattctaatcactgcaattcgacgaggaagtgcttttcccctcttctacgttcaccttctcagaaacggtatcacggatcgccatgattaccatttgcagtagctcattaatttccacctgactctgctgaaactccgtgacaattggaataccgtcaagctcttcctgtagctcctgtagctcggcctctattttggcaatcattttttgattcttcaaggattcaaatgctacaatttccttttgcttctttttcatcgttgcaatcagttgctggatgcgcccatgatcctgaatcttttcttctgctttccggaatacctgcacttcctcactgctacccaaaatacctgccaattctttggcttttgccaatatcatttcgcgattgaccaaatgatcatgctggcgcgccgccgattgaagttctgtttgttgcaaccgctcctctgtcattgcccatcgctccttttctcacttagacggccttgcacacagccctttactcagaccgcatgcaacccgttagaaattcttttatccgttaaccgctacggccgtttcaaccagatcacctttgatgtaaaaggtcataggttccgtaattttcacttgaacaaaggaaccaatcaggtccttagaaccctcaaaatgtacaagcttattggaacgggtccgaccggcaagcactttgctgtcatttttgctctcgccttccaccagcacttcaaccacttcgccacgcaatcgactattaaagcgaaggctgttttggttcacagcaatgttcagacgccggagacgctcttttttgaccgacataggcacattatcttccatcgaagcagctggcgtaccttcacgtggtgaataaataaatgtgtaggcaaagtcatatcctacctcgcgcaccagagatagagtatcttcaaactgctcgtctgtttcgccagggaaacctacgatgatatctgttgtcagagaaacatgcggaacagctgcttttatcttcgcggccagttccagaacacgctcacgggtatattttcggttcattttcttcaatatatccgtattaccggattgaacaggcagatggatatgctccaccaaattgccacccttaccaagcacttcaaccaaatggtcatcaaaatcacgtggatgtgatgtcgtaaaacgtacacgcgggatattgattttgcgcatatcatccatcagatccccgaatctgtaattcaaatctttcaaatccttgccataagcgttaacattctgccccagtaaggtaatttctttaaagccttgacgtgccaaatcccgtacctcagcgattacatcctctggacgacggcttctttccttaccacgtgtaaagggaacaatgcaataggtgcaaaatttatcacaaccgtacataatgttcacccaagcccgcataccctcacgcttcttcggcaagttttcgataatgtcgccttccttagaccacacttcgaccaccatttctttgctaaagagtgcttccttgacgagctgaggcagacgatgaatattatgggtaccaaaaatcatatcgacaaaaccgtgtttttgcataatccggttaacgacattctcttcttgtgacatgcagccacacacgccaagcagcagtcctggcttttctgttttgagatgcttgaggtgacccagctcgccaaacactttatcctccgcattttcacggatagcacaagtgttcagtaaaatgatgtctgcttccttccgatcctcagttgcctggtaacccatttgctccagcaagccttttatggtttcggaatcatgctcgttcatttggcaaccaaatgtgtatacgatataatgcttcccctcaccgatatgcttgagctcatccgggactgcgttatcatacaatacttgtacgtcctctttaccgcgttgcttttcttttctatggttcggctccgccataatgttgatttcacgtccgcgaatacggatctttttgctatgctcatcttcagaaataatcttcgcatccgagaaatcaaaatatttggagtaatcttttgttttcttttccattccttagtcactccttacaccatctatttcacgagctaatttgtaattttactgtatttttaggcatgggtaaatttatcttaagttctaaaaaactttaaaaaaggcattacactaaattatagcatgatttataggccatcgccatagatcagccgcagataccatgaagtcaatgtgaactcatgttctttttgtacataagtgaagtatttatgaattatatagtatgtaaaaagcccgattcttttgcaagaatcggactctttatgccttccggcatttaaatacgtgtatattagtctacgatttcagcgttgtcaccgtttttcacaccggctccgttcgcttcatctgtatcaatgtgcatatccaaagcaaaagaatcggacacacgtgcaagaacattttcaaatacaaggccacgttcgccgccgacacgtactttcagcaactgcttgtccttaatgtcccatttagctgcatcagatgtatggaaatgaatatggcgggctgctacaatcacgccttcttgcagttccacttcaccagctggtccttttaccgtgattcctggtgtaccatcaatgctaccagattcgcgtacaggtgcttttacaccaatagcaaaggaatcagtgcgagagatttccaattgggaagcgggacgagcaggtcccaaaatgcgaaccttatcaaattggcccttagaaccaattacagctaccgtttcatttgcggcaaattgtcctggttgggacaaaggtttaaattcagttaattgatagcctgctccgaacaaaatttcaatatgctcttgagtcaggtgaatatgacgggcggaaacgccgacaggtacgattttactcatcgtgtggtcactcctttttctctatacaatactttacacatccatactattatactcctattttgccaagaaagaaaaggagagcgcataaagttccctttttcgccccaatcagcgttaaatatcctccctataaagtcggatcaaaccgtcgttttagcgaacaggagaaagaaaagcatgatttcagctacgatgagatgagggggaacgacaataaatatattaaggataaacaggacacagagtattccagtcaagaaaaaaatgactctgagacgaggtttaagatgacttaatctgtactgatgaaataccagcaaagccgacaaaaagtaaataaaaacagaagcaaaggtaaagcaaagcacaaaaatatagtctacttgtcccaaaaacaagagctgaatcgaagcagctagcatgctaagcgaaagataaataaacaaatgaccataaataatagtctggcctgctgattgttttgatttatctacgcgcttctccatattctcaaaatattgccaccagattgcgatgactaatacaaaagccaaagcagcaaatacaacagaagaaaccgtaaaatgatcggattgtaaaacagaaagcatacttatcacagattcgccaagcagaattaaggtgaactgtgcaaagcgttctaaaagatgctccgtatggattggcgtgatcaccaactttttacgaccaatcaaaggaacgaggatatcaatagctataccggtatataaaatcaaatatcgaacccaagaatcaaagaagagggagaaactagagatgactattccaacccaaaaataggtgccaaaaaaacgagctgtttcctgtttatgagccgtttctttggatgccgaaagtaaatattgaacgacagttaaacctcttaacccaatatagccaacaaaaaaagatacataatacgcatcaaaatctatattaaggctggcggtcatgatcaacacgaaaaacaattgcaggatcataaaaattcgatgcgttatactgtcttgcccaaaacgattgttgtagaccgtttgccccacccaagcccaccatattgggataaaaatcataataaacttttccatatgttcccacgaaatactaccatgctcaacatgtagtaaaacatgagtggccttagagacagcagctacgaacaataagtcataaaagagctcaagccaagtaaccttctttattaacattgtgtaatggagcccctctgatatggcggtgcagcatggtgtcccgtcagtcttgctccaacgtctgccgtatttatgcttattttagcaccatgaaattctaagatgctccaattatttcgtaatcgttctcactttgtcaaggtattcgcagccaataataactcctagtaaatagctatttaagaagacattttggaaggcaaattcgtttgcaggtattccagcgcatgtcctcccagccatcccttgactagctcctcagggtaatgcttcagcagcagttctgcaaaaaccgggtatttacccgagtgctccagcccttgcacatggtgctcgataccgtcaaaatcagagccaaacatcaaatgcctttccccgcctaatgaacaaatatgctcaatgtgcggtagcagatcgtcagcggttaccgtaccctgctctttgagaaacatcgtgacgaaggtcaaaccaatccgtccgttacgagcgatcagtgcacgaatctgttcatcccgtagattacgaggatgagcacatctcgcaaaggcattcgaatgcgaggcgatgggtggtagagcagcctcctccaacacctcccagaagccctgtacggacaaatgcgacacatctagcagcagtcccaggtcattacagcgattgaccaaatcacgccccttgctagtcagcccgcctcctctatgttccataatgccgtcagccgcccaattcgcataattccatgtcagcccaatcaatcgtattcccatggcatagcacaattctgcataaaacgggttcccttccagcgcatctaccccctccagtgagagcaaagcccaaggtgcccatgtatgatccgtccccttaccatccacatacgttaacttttccgtgcgcttctcttctcctacctgttttacttgctccatctgatgcacccacattgccaagtcttccttccacagcaatggtctcaacccacctgagatagaggtaacatgctgcctgaacagctcaatttgacgaaccacatgctcaaatcttggcatgcccaatacctgtgaaatatatatagcaaacgtttgcaaccgcacgttaccttctagcatacgttcttttgtgacatcaagcgatggatgactgaaatcgatctgcgcatcgagctgcattttacataacacatcacaatgaaagtcaacaacaggccaattcacttttagcttatcattcatgcatcttacctccatttatagattgaagcactacaaatttattttaaaaaatcatagtaacagactcacaatgcaaaaaagcccgtttacaaatcgtaaacaggctcaggcaacttacatttattatcttggttctacaatcaatttgatcgcagtccgatcttctccatcaataacaatgtctgtaaaagcaggaatacaaatcaaatccactccgcttggtgcgacaaatccccgggcaatggctaccgctttaatggcttggtttagtgcacccgctccaatcgcctgtaattctgcatttccgcgttcacgcagtactccagcgagtgcgcctgcaactgaattgggattggattttgctgatacttttaatacatccatagtaagtacctcccctgggaatgatgatggtttgattccactattagatgttattcgagggtcagcaaataattcctgctttttggtgacagttttccttattctttccttaagtagctcacaaaaaagttaatccatccgccattcatcttctttaagtctgattttctgaattttgcgggcttttccatcactgtcattcagttctacgctgatggcatgaaagtgccatttgcccatgtccacttgaaaacgtaccggaagctgggtctggaatttctgtaacacagcctctttctgcatcccaagcactccctcataaggacctaccattcccgcatctgtctgatacgcagttccttgtggcaaaatcgtatcgtcattactctgtacatgtgtgtgcgtacctaccactattgaagcacgtccatccaaatgccaacccatagcgattttttccgaggttgcttcggcgtgaaaatcaactaggatatgcttatgttttttccgtagttcatcgacaatttcatctgctgcacggaatggacagtcaatagctggcaaaaaggttctaccttgcagattaacaatagccagctctttacctccaccttttacaacggtatacccccggcctggtgttcctggtggaaagttagccgggcggatgatccgtggctcatcatctataaaatcaaatatttccttattgtcccaagtatgatttcccatcgtaatcccatgaacgccccaatcaaaaaattctctggcgatggctggggtaattcctcttcccgaagccgcattttctccgttcacgataataacatgcgggttgtattttgattttagcgaagggagattctccctcaatgcctttctgcctacactgccgacgatgtctccaataaataatacgttgatagaaagccctccctagtctgccttacataatgaaaagtggccctacaagcagcggccacttttcattgaaatgcttttattttgcgtattctaccgcacgggtctcgcgtatgacggtaaccttgatatgtcctggatagtccagttcattctcaatcgttttcgtaatatcgcgggccagtcggaatgcttccgcatcatcaattttctctggctgtaccatgacacgaacttcgcgtccggcttgaatcgcgtatgatttctcaacgccttcaaaagattcggagatgcgttccagcttctcaagacgacggatgtacgtctctagcgtttcacgccgcgctcccggtcttgctgctgacagggcatctgccgccccaaccagcatggcgatcactgaagtcgcttcgcagtcgccgtgatgtgaagcaatgctgttgatgacgaccgggtgttccttgtacttcttcgccagttccacgccaatttcaacgtgcgatccttccacttcgtgatccagcgccttcccgatgtcatgcagcaatcctgcccgtcttgccagtacaacgtcttcgcccagttccccggccatcagacctgtcaagtatgcaacttccattgagtgcttcaaaacgttctgtccgtaactcgtacggaacttgagacgtcccaagatcttgatcaaatccggatgcaagctatgcacgcccacctcaaaggtggcctgctcaccatactcacggattcgttcgtccacctctttacgggatttttccaccatctcttcaatacgagccggatgtatccgtccgtccgctacgagcttttcaagcgcagtacgcgcaatctctctacgaatcggatcaaatccggacaaaataacagcttccggcgtatcatcaataatgaggtcaattcctgtaagggtttcaagtgcacggatattacggccttcgcgcccgataatccggcctttcatttcttcgttcggcaatgtgacaacagaaaccgtcgtttctgctacatgatctgccgcacagcgttggatggccagtgtgatgatttcacgagactttttgtccgcttcttctttggcctgctgttcaatttctttaatcatctgagctgtttcatgacgaacttcctgctctacgttggtcagaataatacttcttgcatcctccatcgtcagattggaaatacgctccaactcagttacctgactcttgtaaatcaaatcaatttgctgctgggtttcatcgattcgtttctctttgttggccacttgttcttctttgcgttccagcgattccaattttttatccagcgattcttctttttgcagcaatcttcgttcctgtcgttgaatttcattgcgacgttcacgagtttctttttcagcttcggcacgaatgcggtggatttcatctttcgcttccaataccgtttccttcttcagcgcttctgcctcttttttcgcgttctccacgatttgcgcggcagcttcttccgcactggagatcttagcttctgcaatagatttgcgaataaaataaccaatcccgaacccaaagaataacgcggctacagcaacgagaacgaaccagatcgcagtcatcatactgttcacctccccgttggttcctccaaggcattccttgggactttttgcaattgtcacatttactttgatcgtcaaactaagacaacgacacaaggtcgtttcatttcatatgcacatgctttcacatgtacaattccgcctggcatagcggcatcacttgttatttggcgatgagaactcacccgtggattccgcttttttggaaggaaaaagggcgttccacaagtatcgtttcatatatattttattatttgacaaatggcattgtcaagggaatgcaaacattagtagactaccatgcagctttccatgtaataactagctcatcctatccgttcatactagccaaaggttcagcagccgtttagcaactattcctcccactgcaacaattcctcgtcatctgaagcaacgtcatgctcggccgcagtgagatgattgaccactcggcgtgtcatatcccccgaatatccacgtctcatgagaaaagggtaggttttcctttttttctccattatatcaccacgtacctgattccatttcttacgtccgaccgtcaaagcgctctcccactcctcattatcggtgatctcacctaacgcttcgccaatagaggctttagagatgcccttctgacgaagttcttgcctaacccacatcttccccttacgttggctagttatgcgctgccttgcccattggcgggcgtataaatcatcatctacgagttgttccctttgcagtcgaaccattacttcgtcaataacagactgatccagttctttttgtaacaaacgttgggcaatttcctgacttgtgcgaggctttcgccccaaatagcgaagcgcaagtacataagcctgttgcttttcatctgccagaacgatatcttccagttcttttttatcaaatgacgttcctttgaacatattgtacttgatcattacatcttctaatacagacagcgaatacggaccaaaatgaatgatataccttccgcgtttgcgtccctgtccctgctctaccctagtaatcatcaattcctcatgatccggaaaaagagaaatcccttgttgcttatttgcttccgaagtgtattcatcttcatcgtccaactgcaatatatttccctcactttgaaattcacgaaagcagcctttgaacacctgctacgcaaagttagattccgctgacaaagcagactttagttgatgcaaaaatgccctgcacaactgtgcagggcatcagaatcatgctattcaaacgcacggtgccataaccctggccccagttcacaaaccaagattcaccaagctttattcaagctccaacaattcctgttcttccttcgcttgctgcgccaactcttcttctgtaggcggagcaaccgtcgtaatcaaattgctggccacccgaattttttgttcgatcgtactagcaatattcggattttccttcaaaaattgtttagcattctcccgtccctgaccaaggcgctcaccttcgtaggaataccaggctccgctcttgtcgacaatgtcatgctccgtaccgatatcgatcaagctaccttctttggaaataccctcaccgtacataatatccacctcagcctgacggaaaggaggggcaactttgttcttcacgactttaatacgtgtgcggttacccacaatgtcgttacccattttcaaactttcaatacgacgaacatccaaacgtaccgtagagtaaaacttcaaggcacgtccacctggtgttgtttcagggttaccgaacataacacctactttttcacgtagctggttaataaaaatagcaatggttttcgacttattaatggctccagaaagcttacgcaatgcctgagacatcaaacgtgcttgaagaccaacgtgggaatctcccatttcgccttcaatctctgccttgggcacaagtgccgctacggagtcaacaactacaatgtctactgctccactacgtacaagggcttcggcaatctcaagcgcctgctctcctgtatctggttgcgatagtaacaactcatcaatattgacacccagcttgcttgcatacgacggatcaagcgcatgctcggcgtcgataaaggcggcttgtccgcctgttttttgcacctctgcgatagcgtgaagagctactgtcgttttaccggatgattccggtccgtatatttcaataacccggcctcttggaaagccgcccgttcctaacgcaatatccaaagcaatcgaaccactggggatcgtttccacttgcatgtgggtagactcacccaacttcataatggaacctttaccaaattgcttttctatttgacggagcgccatatccagcgcagcacgacgatctgacaataaactcacatccttcattgtttgtactttaataataccttgttttgacacgcttgccaagcattttttcgaacatacattcgttttttttattcgcacaactctcttctataattacacctgtctcttaaaacaaaaaaagaaccgctggcaaaaggctttgcaacggttcttccgataagatgattataccatgaatatctatctaaaacaactctacgagtcacactgtacatagatgtttaagagagtttctcgttctctaccagcctgcgccacaatctgtacaggattgctttgactgatcgcagtcggattgtttcacggttgccactcagtctcagttcatgtacttccgtttccttgtcgcgttcagcaatgccaatatacactagaccgactggcttccgttcggaatacccaggcccggctacaccggtaactgaaagtccaaaatcgctatccatgatcattctcgcctgctctgcaagcacaagggctacttccttactcactgcgcctggcgcatggtccccttccaaataatcataaggcacgttgagtaacttcatcttcatttcattggaatagcacacgatgccaccttgaaacatagcagcactgccaggtatagaagtaatctgttccatcagcattccacctgtacagctttctgccgcactcaccgtgagttcgcgtttggccattagatctacgataaccttctccagcgcaacatcctcgcttgcatacatatactccgaaagacgctgctgaatttctacttccgtagctgtcagcttaattaatgcttcactttcgctggccgccttggtggatatacggatcgtgacttccccttccttggcataaggggcaatcgtgggatctgtctgggattggattagatctaacaaatgggtttcaagagctgactcaccgatccctgcaaattttagcattttcgaataaattggcatttcctcaccgctcaatgcctgctgaagcaaccaaggtttcgcctggtttgcaaacataggtttgagttccttaggcggtccaggcaaaactacataaaatttaccgtcctgtgcaatcgcgtcgcccacagctagccctgtctcattttcaagtggagtagcaccttcaatagaaagcgcctgccggcggttattctcggtcatttctaccccacggttacggaaaaattgatctagcttgtccattgcaagacgatctatgtgcaatttccgccccaatacagccgctatcgcctctttcgtcaaatcatcctgagtcggccccagaccgccggaaaacaaaataatatccgcacgcttctgagcaattcttatcgcttcctgaagccgatttatgttatcgccaaccacagtctgaaaatatacatcgattccaattgtagccagctcttgtgacaaatattgagcatttgtattcactatttgtccgagcaataactctgttcctactgcaattatttcagctttcatcaattcttcctcctgtactgcgaatattatgggaattatataaagaaacagcaataagtttagtccctattgctgtttccataaaatttatcctgttaaactttggaggagctcagcaaatggatatttttcacgaaataatcaatacccgaataaatggtgatcaacactgctgcccatatcgctattaaatcaaacggtataccaagaaaaacaaacgggaaattattaatgagcagcgctacaatagcaacgatctggatgatcgtctttaatttgccccaattgcttgcagcaaccacagacccatccagtaaggcaatctgacgcagccccgtaaccgcaaactcacggctaacaatcacaacgacaatccatgaatcaattttccccatttctaccaaggaaaccaaaatagcggttaccaaaagcttatcagcaagggggtccaacagcttgcccaaattggtgaccatattatttttacgtgccaaatatccgtcaagaccatccgtgctggctgctacaaggaaaatgatagccgcaatcagctgattatacggcagcttgaaagctccgatctcaatcggcggcggataaaaatcaaagtccaccagcaaagccagcatcatcaccgggataaggcaaatccgcgttattgtaattctgttgggtaaattcacaacacactctcccctgattatcgtacttgattacaaatggcagttttcggattaaattcaatcctatgtaaatcgctttcgacgagcgctatacacctgaattgtctgcattttcgttacaagtataatatggcgcaaaacgcatgtcaaaataacctgccgcacatcaagcaacgttttttcctacaaaatatatgagggaaaacggctttatttcatgtttgtaaattgaagctccaatggcaaatcagctttacgtagcaattgaatgatcgcctgtaaatcatccctgttttttccggtcactcggatttgatcaccttgaatctgacttttgacttttagcttggagtcccgaataagaatattaattttcttggcattatcttgatcaattccctgcttaagcgaaagacgctgacgcactgaacctagagaagcgggttccaatttgccatactccacatttttaagggacagacctcgtttggccattttagattgcaaaatatcaatcaccgcattaagcttgtactcgtcttccgatgcaatcgtaagagcttctttctcaagcttgaggctacttttgctatccttgaaatcaaatcgtgtttcaatttcacgctccgtctgatgaaccgcatttgttaactcctgcatatccattttggagacgatatcaaatgaattttctgaagccatcgtttcactttcctttccacaacaaagttcaatatctaattataggctagtcatttacaaaaatccaataatccgttgactaaaaaggcgttcttgccagttttcctgacaaaaacgcctttattttaattacggtcaaaatatctaattatggcttcgtgttggagttcggaacatatccaaaagtccaagcacaatgtgagcaagaccaaagcccagtatgccatagccccatgcattcggtgtcagataatagcccagtaaactgacaatgataccgagcccagtcacaatccagctgacggtcataacgtatacacctcactttgcggaaaatgaaatgactgcctttccaggaattacagtcattagtatttccttgcaccaaggcgtttattcaccatcagtagttgtagaatctgtaccactttgtgttgaatccgtactgctacctgtcgaagaatctgcaggtgaacccgtcactcctgcactcgttccggtcgtggaagcttctccttgctggatcagtacacgagtagtcgatttattatctgttatcggttgacctgctacggaaatatctgtggcagaagaccgtcctgatttgatatataaaccttccggaccaatatcgaaagacatggcatctccacttttagtcataccgtagctcagcttttctccacgggaattttgtcccttgtacacttcaagccagctttcacccgtcgctttaatatcaaccttggctgtggctcccgttgcactggatactttgaaaatcgtcgtcttgccttgcttgccgtcctgtgccacagttacaccttgttgtggcgtagtcgtatccggctgctgtccagtatctggagtagtagcacccgtactccccgtaccatctggctgagtttggccggtttgccccgcatcaggagtctgcccacccgcaccatttggagccgtcgtttgaccattgttcggctgtgtcgtagtggtatcaggagtagacgtgcttggcgttgtacttggtgttgtaatcggcgttgtgttttctgctgtttttggagttgaatggttgttgctcacccaataagcataaataaccccaacaatgagaactagaaaaagccacattaacgctgtaggcaaccatttaagattaccaatcgtggcgggacggctggagcgtttctgtgtaacaggctccatcactgcttccggctcaggttcaggcacattgctttgatgcccttccagaatctcatcggggttcaacccgaccgtttcagcgtatgttttaataaaagctctgacataaaagcttcccggcagcactttgtaatcgcccgtctcaatggcttccagataacgtttgcgtatcttcgtcatttcctgaacatcgtcaaggctcaatcctttttgcagccgggcctcctttaattgctgacccagttctgacatgtcatcatctccttgtgtaattacgcttatttaaagatcttctgtataactggctgtaaaggtatcataaataatttcctcagccggattattgcgaagttcaataatgatattgaaatcgtcaaagctgtatcctgattcacgtacaaatacatcaggatgctcaatcactttagtacttggcatgctcatgatttcctgaagaaggtgataatgtctttcatttgaccgaattgtactcacaataccatcaataataaacacattgtttgggttcatttcttcttcagaaagctgactgcgcaccgtctgtcgtagtaacgttgaagatacaaaagtccaacgcttcattgcgcatacactactggcaataatggattccgttttgcccacacgcggcatcccgcgaagaccgatcacctgattgccgtccctctttaatacttcacccaaaaaatcgaccagcaacccaagctcatcgcgtgtaaagcgaaatgttttacgatcatctgaatcccgatcgatgtaacgaccgtgtcttactgccaatatatcaaccagtctcggagcacgtaaggccgtgactgtaatgttgctcgctttttttaacgtgtctccgagaatgcgtattttctcgtcatcatccgtttcaagcaacatcccccgtctttccccttcaacaccgttgattgtcagtatattaacccccagaataccaagcatggaagcaatgtctcccagcagtccgggtcgatttttatgtatcttgtactccatgtaccactgtttcgtttcttccgtcacgttagcacctcattcacattcaaaccgtcaacaactccaaatcaaagcattattgtatcataaaataacatctttcgacaaaaccaattattgaaattcgataggttacattgtgttgtaagcctcaatcacgtttatgatatataaattacaatggaattacaagaacagctctgtaaccattacagaaaagcccccaaaagggagcttttcatgttggttcctacttatgcgttgctcttagccaatttaaccattagccgggcgatggtgtgacgctcgtcctcatcggcaactccccacagttctttcagtgcgcggttggagtggttcgctgggtcgaccttctcatccagaaaatcaccaatttcataagcaagctctgaaatggtatcttggctgattcccagcttctccgcttgctctacacgctgaccaaggaactttttccaaacatcaaaattctgaacaactgttgacatacttaaatcctccttagatgattcagatttaaaatcaacagttataatatgctcttctcaaacgcttactatactggtggattcctccaagcgctatcccttaagtcacccatcctccattaggacttatgacctggccattaatataacctgactcaggaagcgcaagaaaataaaccagggacgatatttcatcaggtcgagccaaccgtccggcaggaatttcttcttccaaactggtaatttcgcctttatccaaatgatccagcatcgacgtatccactgcacctggagctacagcattcactgtcaccccggaaggtgctacctcttgagccaacgctttagtgaaagcgttaatgcctcccttggtggtggaatacaacacctcgcacgatgcgccacatatcccccacacggaggaaacattcacaatgcggccatagcgttgggaaatcatatgtggcataaaaacctgcgtgcacagaaaggttcccttaacattgacggccatcacttcgtcccattcctcttccgaaacatctgtcaacagcccataatgagataatccggcgttgttcacaagaatatccggcttcatcccgtgattatccagcttttcccgcatgcgttcgatctgctccttgctccgcagatccgctgacacggtcattaccttgcctgaataagccatgcaacgacgggcaacttcatttgctttttcatgtgacttcatgtagtgaatgacaacattcatccctacagctgcaaaacgctcagcaatagccgcaccaattccgccactcgctcctgtaatcagcacggttgtatcgccaattgcttttaattctccgccctcggtggtcatcgtttccctctccctggacattacggactcaccactagtgatattgcgagttgatcccactggatatggtcttttagacggcgatttacatcctcaagcgtgatactttcataaatagggagcagttggaaaaaatcgctgccccggaagcgatgtcttgtaaattcatgtgcaatattttctggtgaattgagtgtacgcagataaccaccgattttctttttgcgtgcccgttcaaaatgttctgctgcaaagccctgcttctgaatggactccacctcttcacgtattctcgccaacagccgatccgggtctttggtatccccgccgattgcagagaatgcatattgctgcgtactattgtactcatgaccaaaactgtccgaaatcagatcctcatcgtagagcttttgatatagttgtgtactggaaccaaacaggagatcaagcatcagcttggtttccagatcatgacgaagtaattcttcacccgttaggcctacttcagcctccttgaatccaaacagtagctttggcagagaaacggccagcttcacctcacgacgtggttctgcaactgtagtgggttcatcgtcgaaaatccgctcaatctctccctgcggcttatagtcctttttggcctgattgttacgtaccagctctattacttcagctggatccactccgcccactacaaaaagaatcatattgcttgggtggtagaaagcttcatagcaactgtacagcgtttcttttgtaatcgtactgatggattgaacagtacctgcgatatcaatatgcaccggatgaaccttgtacaacgcctcgatcagaccaaagtaactccgccaatcagggttatcttcatacatattaatttcctggccaataatgcctttttccttttctacattttcatctgtaaagtaaggatgctgcacaaaattgaccagcgtggtcaaattttcttgaatacgctcggttgccgaaaacagatatactgtttgatcaaagctggtaaatgcgttcgccgatgccccattagaggagaaggtagcaaaaatatcgccttcaggctcttcaaacattttatgctccaaaaaatgggctatgccatccggcacctttacgggctgttgaccttctacgcggaaatgattatcaactgagccgtatttagttgcaaatgtggcgtatgtcttctgaaaacccggtttgggcaacacataaacgtgtaaaccgttatccattacttcatagtacagcgtttcctgcaaatgctcataaggtatatgctccaccgctattcccccttctggtctctcaagaaataaatagtgtccagtcggaacgtccgggcggcatcctgaacatcctgcaccttgactgcctccacctgactcagcagctcatctactgtccgttctttaccggaaagctgtctgttaaaatcataggcgatcatttcaaaagcggaatcctgcatctcctttagcaagttgcgaatcatcgcctgcgtttgggtcatttccagctcagtaatcgctccgttttgcgtatcttccagttgcttgcggataatagtaaccgctttttcataattaggaatttcaataccagattgaatcgtaccaatacctttatgcccgtcataccgtgatgaagcgtaatacgccaaactttccttctccctcacattaacgaacagctttgaatgcggatacccgcccagaatgccattgtacatcagagcggaagcatagcgatcgtctccatacgtaataggggtgcgcaaccccatgttgagcttgccctggttcacatcaagacgctctacaacggtttgaacatcacgctctaccgacttgggctgttcaggaacataccctgtttccgctgaacggttcaattgaaaatagcgatcaacaaacttctcaacttcttctagcgtcgtatctcccacaacgtataaatccatgctggcatgattcagccattctccataagccttatacaagctctgtgcatctatactgtccagatcagatcgttgaccaagagggtgcaaacgataaggctcatccttgcacatttcctccatacagcgctcaccagcataacgtattttatcgttaactatagattccagcttcttacgcacattttctcgttcctgctggacgtatcccgtttgaaatgcaccattttccaatgcaggcttcgttagtacttctccgagaaaagaaaacgaacgatccagtaaactatctggactatttacaaagctgtcattaatcgtatccatgcgaaattgcacgatctgataatctccacgtttatacacatcgaaaccgaaacccgcgccatacaattgctctaactgttctctgaattgtgtagtctgcggatacgattctgtaccccgtcgcagaacgaaaggtgccagccccactcgagttacggtgtcctcccgtagcggagtgcctacatacaatgatatagcaaacgtcttaaagcgcttggtcggcagtacatgaatcctcagttgtctgcgtgtgccacgctcgaaacctgttttgttcaagtccaaaactcctttgtgacgtcaatttgcgtctagcctttgattagcaaagcattagctgctgtgaatcttcctcctgtaaagaggtaaagtgtaccaatctttattctaaccatgcaaaagccaagaagcaaccggagacaagctcccggctgcttcggcgttttacatgcaaaaaatatgttccccgatggttttcacctgcggacgggaccaaatccatttagaggtggctgtttttgggttaaaataatagagacatcctccgcttggatcccagccgttcagggcttggcgtaccgccttttgtgcattctcattcggtgtgagccagatttgaccgtctgctactgctgtgaaagctcctggttgaaaaatcactccagatggtgagttgggaaagctaggtgacttgaccctgttcaaaataacagccgcgacggcaacttgtccttcaaacggctcgccgcgggattcaccgtagaccgcgttggccataattttaagatcgttttcagatagtcccatggtgttggccgatcccatcgtttcatcattttgatccgctttatcgttattgtctgctgtctgtccctgagcggaaccttgattgttacgatgcataggagtttccgttggcttccagttaggagtagcattcaccagctttaatttcgtctttgctccgaccactccatcaggacggatgccaaattccttttgaaaacccttaacagcttttagtgtactgctgccaaaatggctgtccactttcccgccaaaaaagcccagcaacttcaaacgtgattgcaactcatatacatcctgaccgtaagatccaaaatcaaccgctcccgagctgaatgtcggctgagaaggttgcgccgcttgtactttctgctgtgtgctcagcggctctgcttgctgctgtgcagagtcacttttaaaaagtcctgtgtacgtaatagccgaggctgcgaggatacccgtgcaaatccagaccattgtctttttcatatgctgcgctctacctttcttttgtgggattaacaggatggctacgtttattatgacaaggtccgcttaaagctattcacccttttaatcttctttcagcagatagtcgccacacctcaaaaaacatcacaaaaaaacgctgtttgtgcactcggagttgtcatattagaacaaccaccatgcgaacaaacagcgttttaatgtagtgctggatagagatcatgcttaggaacttactttattttgctgatattgctccattgagataaggacctcacggggcttgctgccctcataagggccgatgactccgcgagcttccatggagtcaatcagtcgagcagcacgtgtataaccgatccgcatacggcgctgaaggagcgaaacggaagcttgtttagcctctaaaatgatgttgaccgcctgatcgtacagctcatccagcatttcatctgcatcagccgatacctcttccacctccggcactagcgtttcatcatactgcgcctcaccctgttcacgtacgtagctaacaatattttcgacttcttgatcgctcatgaatgctccctgaacgcggactggtttggaagcacccattggcatgaacagcatatcaccacgtccgagtagcttctcggctccacccatgtccaatatggtacgggagtctacctgcgaggaaacgccgaaggcaatacgtgaaggaatattggctttaatcaccccggtaattacatcaaccgaaggtctttgcgttgcaatgataaggtggatgcctgctgcacgcgccatttgggcaagtcgtgcaatcgcatcctccacatctcccgcagctaccatcattaaatctgccaactcgtccacaataacgacgatgtaaggcagaaatgcatccgggttatctttcatcagattattatatccctcaatattacgggttcctgatttggaaaataactcatatcttttttccatttcaactacaattttcttcaatgcaagtgaggctcgctttggatcagtcacgaccggagccaacaaatgcgggattccgttgtacacgttcaactccaccattttaggatcgaccatcaaaaatttgacctcatccggctttgctttgtacaaaatactcgtaatgatcccattgatacacactgatttacccgaaccagttgccccagctacaagcagatggggcatcttggccaaattaccgacaatcgtctgtcctgcgatatcacgtccgaatgcaatagataaattggaagctgactcctggaaaacggttgtctccataacctcacgcatcgttacaatggaaacttcattattcggaacctcaattccgatagctgatttgccaggaatcggagcctccatacggatatctttggcagcaagcgcaagcgcaatgtcatccgtcagactcacaatgcggctgacctttactccaatgtccggctgaatttcataacgcgttacggcagggccacggacaacctccagcaccttggcccgcacaccgaagctttccagcgttgcctccagcttgcgtgccgtttgcatgtaatccttttgtcccatacctttgcctgcgttttgtggtttagcaagtaaacgaaatgatgggagcttgtacggtttaggcggcggcggagccggaatagctgtatggttaccttcagcctcttcgcctgccaccccagttgcaatcgtctgagcttgtccctgagcaccttctaatgtcccctggatcgctgtcgaatcatccatatccgtatttgcattggcatccacaaagtcatcatccagggattcatcaataatggaagttgtctgctctgctcctgtcagggactctccaaattcagcttccggtcttctttcctcatgctttacttgttcgaagaaatccctaataatcggcgacctttttaccagagttgcagcttcctgctcaacgtgttcgactacgtcagacatctcttcactctggttgccgtttctccactgggcctgcgcgtcctcagcttcatatggaagatcatgatcatcctcatccgtatggacggaatgctcatccttgtccgctttacctgaatttttgaggccaaacaactgaaagaaaatcggctgtttgcgtgcaggaggctgcatttcgtcaaagtcatcatccatgtcttcctcataggcaggaatgggctcagacttgatttttctatttccactgcctttgcttgatgctgaaagcggagtagctttaccagtccattttttgcgcacgcttcccccggcagtcagcagcttggtctttacaatccgtaccaaatccacataggacagttgggtcatcagcatgaaacaaatgacgaacataacaatcatgatcagtttagctcctgtgagaccaaacagccataacagaacagtaagctgcaatgcgcctacgtaacccccgctgatatccttgttcagcattgaggtatggccctgctggtcaggcgacagcaactgctcacgcatatctatatgtatctgggtcatcactccgcccggctgaagcgcgttgatcggtcccaaacgctgctccatagatgaaatagaactcataagtgtaaaggcaaatactaacaggagcaaacccgttttacgggagttccactggttcggccacttgcggtgaatcatcaccatcagaccataataaatgccaatcagagggataacaaaatagaatttccccagtacgagcccaaacatcttggatagcgaccgaccaaccgccgcttcacccgacaacgcaatgaccgctaatgtaatcagcacaatgccgtaaatttcaaattttagaactccgccaaatgcggctttcttttttctttttcttcttctggacatacaaggtcaccccccagaagaatattataccacgtcacccggtatccgcacatatgttctttttcaacagtaaacgacctatttctatactactcgacaccttctacgaccactcgatgacttgacctggtccataacgcggattcaggtaggcttccaacggacagtccaacaaccgtacaatgatcccccgacgactttcaagcggctgtacttgcataagtagaccgtctacccgaacttctgcaaactcctcagcctctttccacaacccttgccataccatttccattggcattacagtatatagtgtcattgtggtagctccccgctaggctcccctgacagtgtctctgtaggagttcctgtggcactaggagaaaaaggagcatacggagcctgctgttgaatcccagcgatcccgttttgctgacggcgcgtttcaataatggtgttcagctgttttaaagcctctccgatgcctccaaccgcgtccatcaatccatacttcactgcatcagctcctccaaccgctgtaccaatatcgcggtttaactcaccggttttaaacattaattccttaaactgctcttctgtaatacgagaatgagaaacgacgaagcgtacaacacgttcctgcattttttccatgtattcaaaagtttgtggtactccaatgaccagaccgctcatacgaatgggatgaatggtcatcgtcgcactctccgcaatgtaggaataagtggaagacacagcaatcggcacaccgatgctatgccccccacctatgacaatggtcaccgttggtttactcatcgatgcgatcatttcagcaatagctagtcctgcctctacatcaccaccaactgtattcagcaaaatcattaatccttcgatacgaggattttgttctgccgctaccaactggggaataatgtgctcatattttgtcgttttgttttgaggcggcaaaatgagatgcccttcaatttgaccgataatcgtcatgcaaaaaatattggactcgcctccaggcatggaggtttgacccagttgctgcaaagcctccatagcaggtaaagcgggtctttgcccaatttctggttgatctggcgcttcgctttcctcattgccagattttagattgctgtattgttccatatgggtgatcttcctttcgctttacgcatctatatgacccgtattcaccctatagtatgggatagaaatggaatattttataccccccccccatgcctttccttgtcccaggaaatcaaaaaagcctctcctcccgcggaaaccgtccaatatttcctgcgggaagagaggcgactgtgtgcctgtgacttaagtttttaattcaggtttttgaacaaatttcaattgaatcacacttccattataattggcaggatcatcggtctccgacgagtttgctcatacaagaagcgacctagtgcatccttgacatttgtcttgagggaagcccattcatttacattttcactcatgagcttatgcagtgtacttgagacaatacgattcgcttcatccagcaaaccttccgattcacggacatatacgaaacctcgggaaatgatatctggtcccgatttaatcgttccgtcttgcttgctcagcgtaacaacaactaccaaaataccgtcctgtgacagcaatttgcggtcgcgcaatacgatatttcctacatcccctacgcctagtccatcgatcagtacgttacctgctgtaactttaccagctctgcgtgctccaccattctgaatttcaatgacttcaccgatatccgtgataaagatattctcaggctcaatacctacaccttcagcaagaagagcgtgacgacgttgcattctaaactcaccatgaattggcaagaagaactttggtttcatcagattcagcatcagcttgagttcttcctggcttccgtgtccagaaacgtggatacctggattagctgcgctgtaatatacattggcacccagacggaacagctcatcaattgtgcgtccaacgtatttttcattacctggtactggagtagctgcgatgatgactgaatcccctggaagaatgtcaacctttcgatgtgtggaacgagccattcttgtcaaagctgacatcggttcaccctgactgcctgtgcagagaataactacacgatccgctgacattttgccaacttcttcaggctcaatcagcattccatctggaatttccaaatagcccaagtctgaagcaatacctacgacattaaccatgcttctaccaataactgttactttacgtcccgttgcttcagcagcattaattacctgttgaatacgatgtacgttagaagcaaaagtagctacgaccacacgctgtctcgacttgcggaaaatgtcttccaggacaataccaacgctcttttccgaaggtgtaaagcccggtttttcggcattcgtactgtctgacaaaagagccagtacgccacgtgtgccaatttcagccatacgctgcaaatctgcatattgtccgttcaccggagtatggtcaaatttgaagtcacctgtatgaacaacagcgccttcaggagtatcaatacatacacctacagaatctggaatactatggttggttctgaagaatgttgctttcagtgtggaacccagcttgatttcagaatcagcattgatcaaaatacgtttggtttcaccaagcagattcgcttccttcagcttgttttcaaccaatcccagcgtcaatttggtaccatatactggtacattcaaatgtttcaacacgtaaggcaaaccgccgatatggtcctcatgaccatgagtcagcacaatgcctcttactttgtcgcggttctctgtaaggtaggaaatatcaggaataacgatatcaatgcccagcatgtcctcttccgggaatttcaaaccggaatccaccacgacaatgtcattgccgtattgaacgacatacatatttttcccgatttcaccgacgccgcccaaagcgaaaatcatcaatttatcgttgtttgtttttttagacaaatgaatctaaacctcctatggtagttggacgtcgtaccttgatttgtttatttaattttcaaaaaaataccgcacccagtcacttgaccccattatacatgattaaaatacgaaaaaacaagtcatcctgttcgttacgctaggtttcccattgccgtctgaaaccattagtatccgtcattttgtctacatacatggttaaaagcacagcaaaaagggcgtcctgtaagaacgcccttcacgctgggaaccttgtcagacaataaaccctatcggttttgtacctaccgactgcccttaacaaggatactccttagtattaattaacatcttacattcctatttctctttagcgggtaaataattttttaataaattccgcttcatcctcagttggaggaatgagcggcaaccgaaccgaacctaccttaaccccccgtaattccaatgcatattttactgccaccggattaggcagaggatgaggacagccaaacaaacccttgaaaatcgggaacaactgctgatgcaactttgctgcctcctgcgagtgtcctcctacaagtgaatcgatcatctgcttcatttcagcacctaccacatgactcgctacgctgataataccataagcacctacagccatagcaggcaacccagaagcatcatccccggaataaaccagaaaaccttctggcgctgccgctgcaatctgtgtgacctgcgcaagtgatgcacattctttagttcccacaatattcggaatttgtgcaaggcgcagtgttgtttcagctgttagactcgctccagtacgacttggaacattatacagtatagctgggagggatgtggagttcgcaatactttcgaaatgctgatacatcccttcctgattcggtttattataatatggcactaccagtagaacaccatctgctcctgcctgctccgcggcacgggttagatgaatggagtgacgcgtattgttgcttccagtcccggcaataatttcacatcgtccagctgctttttctacaacaaatgcaaacaacttgattttttcatcatcgctcagggtaggagattcccctgttgttccagatacaacaagtgactctgagtgctgttcttctattaagtaatcaatcaacgaggacaatgcagtccagtcaatctctccttgcttatcaaaaggtgtcaccattgcggtaatcaatctgccgaagttcaccatgctgcctcctttttgcaagtccgagcacggacaatgcgcctattgatggagttcaaatttattatgcaatgcgcgtacagcctgcaccatatcttcttttttaacaagtacccagatcgtcgtgttggaatctgcggattgaaggatctgtacgtctgattctgccaatgcctccacaatcgtcgccataatgcctggtaccccgttgataccaccgccaatgacagaaactttagcacacccggccagtatcttaggttctagacccaaaccgttcaatacttcaaccgctttgcttccatcatgatcgaacacagtataaactgcccccgatggcgttacgttaataaagtcaacgctaattccatgttcagccatagatttgaatacttgcaattgcaagtgctccaaacccggctttaattcaacattaatctgagtgacattgccgacatacgcaataccggtcacgaaacggtctacaatgtctgcctgcacgtctttgaagccttccgggtgggtaactaacgtaccttctccttcggagaaggtagagcgaacacggaccgggatattagcctgcatggcgatttcaacagcacgaggatggataacctttgctccctgatgagccatattacaaatctccgtatagctaacatgtgtgagtggctttgcgttttccacaatgcgcggatcggcagtcaatataccattcacatccgtataaatatcaaccatatccgcatgtagagcagcacccagagcagtagctgacgtatcgctgcctccccgacccaaggtagtcatatcaccgtctgctgtttgtccctgaaaacctgtcacaatgacgactctaccttggttcaactcttcaacaacacggtctggctttatatccaaaatacgagcattgccgtattgatcatccgtaataaagcccgcctgtgccccagttagcaccgtagcaggaataccttccttctccatcaggctgcataatgtagcagcagaaatgatttcaccacagcacagcagtaaatcccgttcgcgcttcggaagactgtcgccgttagacgccgcccaatccagcagcgtgtcggtggcataaggctctccttttctccccatggccgacacaacaacaaccaattgaagattttgttccagctcccgcttcacatgtgccagcacaagttgacgtgcttcaggtgtggacagcgaggttcccccaaatttttgcaccaaaatacccattattcttcccccatatcggaacgttactccgcgtttgcagcaataatttccgcgatttgcaccgcgttccatgctgctcctttgagcaggttgtcggatacgacccacaaattcaatccacggctattgcccaaatcacggcgtacacgccccacaaatacgtcaggttttcctgcagcatcagatgccagtggataaagctgagcagcaggatcgtccaccagcgttactcccggtgccgaagccagcagattgcgaatttcttctaaatcataatcttttttaagttctacatatacagattccgagtgaccatatacaacaggaatacgcacacacgttgctgttacgtccacagattcgtcacccagtatttttttcgtttcacgtaccattttcatttcttccagtgtataaccattgtcctggaatttatcgatttgcgggatagcattgaaagcaatctgatgctttactggcaacgagcctactggcaacagatcaggctgaacttcatctccgttcagaatcgctgcgctttgacgattcaattcatcaatagctcggcttccagcgccggaaacggcctggtatgtggatacaatgatacgagaaatgccatactgatcatataatggtttcaaagcagctaccatctgaatggtggagcagttcgggttcgcaataattccttgatgctcggcaattttgtcgctgttcacctcaggcactacaagaggagctgtcggatccattcggaatgcgttggtgttgtcaatgcaaactgccccatgacgaacagcatgcggcgccaattccttacttacgtctccacctgcactaaacaaagcaatgtcgattccttcaaagctgtcgggggtggcaatctctactggaatttgctgacctttaaagctaattaacgtgccggcagaacgaggcgaagaaagaaatttgattttgtccacaggaaaatcccgtttttccagcagatttacgatctgttctcctacagcgcctgtcgctccaacgacagctacattaaactttctattgctcatctggtgtatctccccttctcgactaaaaaccattttttattctgaaagcatccaccgccaacaagaaattagacccgatacaatatcgaatcatcttctaggcgagggatgctcagcagttaactataatacttcatggggtcttgcgttccacaatcatcggctgaagctgtttgccctgcaatgcttcataagcagcctccggaatcaactccatgttagctacaagcgagttcggctttttaactggattgtcctgtccgaacggcacaaaaaagatatttttggctacgagtaatttggcgatattggcagcatttagacccagtccatcattagtagatatagctaaaagaagtggacgaccgttgcgcaattgcgccttggcagccatcaaaactggactgtctgtcattgcattcgctaacttactcatcgaattccccgtcaaaggtgcaatcaccagcacatcgagtatttgggagggacccagtggctcagcctccacaattgtagaaatgatatcattccctgttatatctttcaactgtttttgccaactttgcgaagtaccaaagcgcgtatccgttgttagtactgtattggatataataggaacgaccttcgcaccctcatcaacaaagcgctgtataacaggcattacctcttcaaatgtgcaatgtgagcctgtaattgcataacctactgttttcccttgccaactcattgtgcatccccccgatcaggattatcttccattaacaactgcaccagcgtattcgctataatagcgccagcagttttgggagcaacaataccgggaagaccaggggcaagcatagccttgattccacgcttttccgcataacggaaatcacatccgcctggtgcggaagcaagatctataatcacggtgctcaatggcaatttagacaggatttgcgctgtgataatcatagagggtatcgtattaaaaatcaagtcaactccctttgtctcatgcgccaaatcccttgtcataaaaggcctccaacccatttccacggctcttgctgcatcctctgcccgccgtactccaaccttcactctggctcccaacccctgtagtgcccttgccatggtaaatccagtccgtcccatgcctagaaccatacaatctgcaccgtgaatcgtaaaatcagtatgctgaatggccatcatcagtgcgccttcggccgtaggtatagagttgtatatggccacatcatctctctccagcagctctaccagctttaactcatgtctggtacaaatctcttttaagtacgtccgcgccatccctgtatatacaacgcaatgcggtggaagagcagcagcatgttcattcagaaactggagcttctgtgctccgaaaagtgcatttacgttgccttcctcatcgcatcccaccaccggcaaaatcagtgcgtctgacgattccagcagcttgacagacattggttctagtgtcactcctttgagtggtacttcaagcttgtcaaaaccgaccacactgacggtagcgtccatgtccacacatttgcggattacctcaagctgcctcgcatcgccacccaaaacaacgacgcgtattcctgttagcatccggatcactcctttccgagacacgatatgcttttagtctatgcgagtgcccggagaggggtgaaaaaacacaaaaaaaagccgccccttgatgaggcgacctttatatgcatacttactcttaagcaagtaaatttgaagctttttacaaaatagacattcttacattgcaaaccaaccatagctcagcgtcctgtatggccaaagcctccagcaccacgcactgtttcagataattggtctacttgtttcagctctacctcaggtacaacctgaaataccatttgtgcaattcgctcattgcgcgtaatcgtgaacgattcttcgcccaaattaataagaagtaccttgatctccccacgataatccgcatcaatcgttcccggtgtattgagacaagtaataccatgcttaagagccagtccacttcgcggacggatttgtgcctccaatcccgctggcatagctattgcaaatccagttggaacgaggcaacgtttgccgggttccagtaccagattttcctgtactgctgcatacaagtcaaaccctgatgcaagctctgacattttgcgggggagctcaatatcttcattgcccgcaagtctgttaatttccacgtaagttaacaaaatagtccctcctcatatcctttaccgctgaatcactcgctcccaccatcgacagggcaaacggctccgagaacatccgatccagcactttgttcacatcatttgccgtcacttgctcgatatgttcgatcatttgatccagcgtataatgctgaccgagcattaattcattttttccaagccgattcatccggctacctgtactttcaaggcttaaaatcaaacttccttttaattgctccttacctttacgaagctcattagcgtccaaaccgttgacagcaacatctcgtaaaagctccagcgtcaaatccagcacgtcctttgtttgcttaggagccgtacctgcatagatcgtgaacaacccactgtccgcatgggagctatgataggaataaaccgaataagccagtccacgcttttcccgaatttcttgaaacaaacgtgaactcatgccgccgccgatcgcgttattcagcaaaaccatagcatactggagctcgtcacccgctgcaaatccaggcagggataaacaaatatgattttgctccgttgctttctcatgatacaacagctcaccgttaaacacaggtactgtcagcggcgaaacggttccatgattatcaaaatgtccaaaatgtcgctccaacaattctaccaagcgatcgtcaacattaccagccacactgataactgtattgtcgattgtataatgctccttcatataatgactgaggtgtgagctatccatagcaagcaggtgatcttcggttccgagaatcggataagccagtggatgttcaccataggccgcgcgagatacaagatcgtgcaccatatcatccggtgtatcctcgtacatggagatttcctccaaaatcacattcttctcttttgccaattcttcctgatctagtttggaattaaaaaacatatcagacagcacatcaactgcgatcggtagatgctcatccaatactttggcataatagcatgtatattccttcgaagtgaaagcattaacatttcctccgatggcatcgaattgctcagcgatttccttagcgttaaaacgctctgttcctttgaaaagcatgtgttcgataaaatgagaaataccgctattgtccggcgtttcattccgggagccagttttaacccagataccgaaagaaactgaacgtacggttggaattttttcaatgaccactcttaggccgtttttaagttgaattctttccacgattggccctcctaaactgaattgcatacttagccataatgttcaatcctaacagaaaaaagacgttcactcaaccggagcaggtagttgccgatcaggggaaagtgtctgactgacagttccgagcacaagtcccttactacgaatagcatgaatcatgcctttgagagcagccgatgaggaatctgttggatgcatcaatatcagggagcctgattcaaccttactactgattttgttaatcaccgattccggtgacggatgtctccaatctacagtgtccaatgtccacaacactgttttgagcccaagttctgctgctatatccaccgtttgctgattaaaatcacccgatggaggggcaaaccagttatttttgatacccaaagtttctcgaagaagcacttgagtcttttcaatttcttgtgtggctctggcccgactcagacggctcatattcggatgagagtatgcatggttcgaaagctcatgccctcttttttgaatctccttggcgagatcaggattttttttcaaccaacttccatcaagaaaaaatgtagccttgaccttttcctgatccagcgtgttcagtattggcaggataaattcattcccccatgctacattgatcatgaaagataccatcggcttttcgggattccccctgtaaattggaacattaccaagctgatttaaatgtattttaggtgccaattgtcgatatacatattgaatgggtcgatccggagatgcaatcgctttgcgataggtagcatccaaatccacctccagtccgttatagcctggaatagccttccataccctgtcgatcttggcatcaactggttcccgccgctgacgtgctgcttctgttcttagtcgctgcataagcgcattgtcgggcaaagctgctatcgccatcgtggttacagcttctggctctttaacccctgtaacgtctccattgcgtaattgactagcgtagtcacgaaccccactaaactgcccgattacaagtgtgatggctaaactggctaccacccacactgctcgttttgccctactcataattccttcatccccccgcccgtttgtccacattgtatgcggcgaggacaagaactatgacgtagcaagctctagaagctcacttgggtgcagcttgtgcatatgtatgaaaaaagagccagaaacgtagctctgcctctttccaaaagcttaaacaatgctattcaaatcccttgtactgttaatacgaaaagctactcctgcctttctagtctgcaacatgcagatacctaggattttgcaggtgcttctgcagtcagaacagccttacgggacagattgacacgaccttgttgatcaatttcggttactttcaccgtaattgtatccccaatagcaattacatcttcaactttggctacacgctcagtagacagttgagaaatatgaaccagaccatctttgcccggtaaaatttcaacaaatgcaccgaatttttcaatccgttttactgtaccgatgtaaatctcaccgaccacgacttcctttacgataccctcaataatggaacgtgctttttcattcatctcttgatttgtggaagcgatgaacacacgaccatcttgttcaatatcgattttcacgccggtttcttcgatgattttgttgatgattttaccaccagccccaataacatcacggattttgtccgggttaatgtgcatcgtcataatttttggagcatacggagacaactgctcacgcggcttctggatcgcttccatcattttgctaagaatgaacaaacgtccttctttagcttgcttgagcgcatcctgtaaaatctggcggtcaataccgttaattttaatatccatttgaatggcagttacgccttccgcggtaccagcaactttaaaatccatatcgcccaggtggtcttccataccttggatatcagtcaatactgaaacatggtctccatccttgatcaatcccatggctacacctgcaaccggagctttaattggtacacctgcatccatcatagccagtgtacttgcacaaatactagcttgtgaagtcgaaccattcgattccagtacctcggaaaccagacggatggtgtatggaaattcagtttcggaaggaattactttggaaagcgcacgttcaccaagagcaccatgtccgatttcacgacgacctggcgcacgtaaaggacgagcctcacctacgctgaatggcgggaaattgtaatgatgcatgaagcgttttgtttcttccagatcaataccgtccaaaatttgtacatcacccaatgcaccaagtgtacaaatgctaagtgcttgcgtttgaccgcgtgtaaataagcccgaaccatgagtacgcggcaaaatgctagtatcgctttcaatcggacgaatttcgtcaagcttacgaccatcaggacgcactttatcatgcgtgatcagacgacgtacttcttccttaacgatatcatagagaacttcgctcacgtcgctcaaaagctcaggtgtctctatgtattgtgcttcaaaatgggcaactgtctcttcgttgactgcatcaattgcctcttgacgagcatgtttttctgcaattttaacagcttgcattaaacgttcagctgcataagcacgtacttcactgttcactttttcatcaacagcatgcagtttaacctgcattttctctttacctgctacttgcaccaattgttcaataactgccacaatgttcttaatctcatcatgaccgaacataatagcttccagcataacttcctctggaatctcattgccttcggcttctaccatcatgatggcatctttcgttccggctacaaccaggtacagatcgcttgcattctgctgtgcaatatccgggttaatcacaaattgcccgtctatacgtcctacagcgactccaccgattggcccattaaaaggcacatccgaaatgctaagtgctgccgaggttccgatcattgctgcaatttcaggttcgcaatcctgatcgacactcataaccagattcaacacctgtacatcattccggaaaccttccgggaacaatgggcgaattggacggtctgtcaaacggctggacaaaatcgccttttgactcggacgtccttcacgtttaataaatccgccaggaattttccccacagcatacaatctttcctcatagtttacggtcagtggaaaaaagtccaaatctttcggttcacgggaagcggtcacggtacaaagcacaactgtttctccgtagctcactttaactgccgcattggcttgtttcgcaagacgtcctgtttccaacaccagctttcttccgccgagctgcatttctacgcgttgctccatggtatccctccatttcattttcattgtaaaagttctatacatatccagtatttcctgcgcaggtcttattcataagaagcaagcagacaaatcaggatatgtaattcaaaaaaagattcctcatttcaaaaaagaacccggctgctgtccgccgtcgccttagcagggacaagcggtgaacaaccaggcttcttttctcattacatgtctgaaaattaacgacgcagtccgagacgctcgatcaacgcactgtaacgtttaacatcagtcttcttcaggtaagccaaaagtttacgacgctgaccgaccattttcaacaacccgcggcgggagtgatggtctttcttgtgcgaacgaaagtgactttgcaagttgacgatgttttcagtaaggatagcgatttgtacctctggtgatcctgtatcggattcatgagttttgtactcctcgatcaattgctgtttacgctcttgagtcaatgccatcctgttcacctccttcattataatcgccattagcctcgtagccgccggtgaaagcggacaaccaagctaaggttcatcgttgtttacacaacataagtcagtataacacagcgcctgtcttatgtaaataaattagcctaatagctttttagccgtttgtgcgtcattgccaatttggttgatcagctcatccaccgaagagaatttgcgttcagggcggatgtagtggtgaagctccacaagcacagactctccataaatttgctgattaaaatcaaataaatgtacctcaaacgacggattcagcacaccttcatgaaaagtaggcttaacccctacattcattacaccgtttatccaacgatcgcttacaagcgcccgtacagcgtacacacccttaatcggaataacgtaagtgtcatccagtttgagattagcggtcggaaaaccgatcgtacgtccgcgcttctctccatccattacagtaccctggatacgataaggacgtcccaaccagcgagaggcatgtgctagatccccggtctgtagagcacggcgaatgccagagctgctcaccttgtccccatccagttcgaacggtggtacggtgtgcaccgacatcagctctcctcccagctttcgaagtgtatcctcatgcccggctccccggtggccaaaccgaaaatcaaagcctactaccgctgttcgaatgtgcaatggaagcagcacgtcgctcataaacgcctcagggctgaccttggaaaattcttcgttaaaactcaaaatataaagtacgtccacacccatatcagccagaatagtctgcttgtccgcaagcggtgttaaataaccttcataatcgccttttttcatgacttccttcgggtgaggatgaaatgtcatgacagataccggcacctgctgttcacgagccagcgcaacggccttacgtatcacgcttgcgtgtcccagatgaagaccatcaaactgaccgatcgccgtgacctgtggacgtccccattgctgcaaaagctcatcactcaatggataagataacgatacggtaatcattattaattcacctgcatttcacatcatttgactaacttcgtcaaaattatagcacaattcaaggtaaaaaaactttaatgggagcgatcgcgtctgattcatcccgaccatatatacctaaaaacgttttatcctctttatacaaacggaagggctgattgtccgtcacaggtggtgaaatcatattcagcgataggcgttggccttgcagagccgcagttaccttggcttcagccactatatgctcaggcatatagtcaatcgcctgatctgttgtaataagtcgctctccaagactgccatccgcaacgaaacgctctatttcttcgaaagtcagacaacgttccgcaggaattcccgcagacatggttcgctccagcttgaccatcgtggaaggatatcctaattcacggccaatatcaacacatagtgtacggatataagtacctttggagcataaggcacgaaaagaaatatccacatacgcccccgtctccgcgaatcccgtcatttccaactcgtaaatactcacttcacgacttttgcgctccacggttttgccttctcgagccagttcatatagacgtttgccgtccacttttagcgcggagtacattggaggtacttgggaaatcgtaccaacaaaacgcttcagaaccgctttgacttccacttccgtcacctctacgggacgttcactctcttccgtgattttcccagtcaggtcttcggtatccgtggcaattcctaatcgcagtgtagcccgatattccttgggccgctcctgcatgtattccaccacacgggtagcacgtcccagacacaagggcaaaacaccggttacctgcggatcaagtgttccagtgtgtccgattcgcttcatacctaataaacggcgagccttggccaccacatcatgagaggtaaatccagcaggtttatagacaggtagaatgccttcccatgttgcctgttccttctttatcgggttcatagctcagatttcacccgccctacaactgtctcaatgatatctcccagcttaccctctagccggcagccagctgcacgtacatgtccaccgccaccaaatgattgagccagcgcagctacatcaacattccctgccgatctcaagctggccttgaccgcttgatcattaataaccttaaagaaaatgcctacttcaactccacgaatatttcttggataattcacaatgccttccaagtcctcatttacagccccacaatccgtcatgtcgtcaggggttacaacgacccaagcgactttcccatcctccgacatcgtgagcgtttgcaatgcttttgttagcaccttcatttgtgaaaaggtcatttcctcgagcaatttctcggataaagatggaccatctacaccgtaagcaagtagctgtgacacagtagacatcactttcggtgaagtgttggagtaacggaaacctcctgtatccgttagcaaccctgtatataaagccgttgctatttcgacatcccaggttactgcaaactctttcagtaggtcaaaaagaatttctgctgttgccgcagcatccggcttaatcacattaactgtaccataagcatcattcgttggatgatgatcaatattcaggataatggcatcttccgaaaaaaactgctctgtcaaaccaacacgacggtaatccgcacaatctacacaaatgatccggttgtatttccgttctggcggttgctggctcatatccataatctcatcggcatgccataaaaaatccatacgtttgggaataggcccctcattcagcatggtaaatttcttccccagacatgagagaagccagcccaccgttacggtggagctgactgcgtctccgtccggctgtacatgcgatacgatcaggtaatcatcatgctccagaataaattccttcgcttgttgaagcgcctgttcataggtatgcattgccttctcctttacattcagttcatggttccttcagacaaactaaaagttttatttttcatccttgtcgatatcactcagcagtttttcaattcgactgccgtaagcaatagattcgtcaattttgaaaatcaactcaggaatatggcgcagccgtatccgtttgccgagttcagaacgaagataaccgttcgctttgtccaatgctttcagggaagaatttttttgttcttcatccccgagcacgctcaagtatattttcgcttgggacaaatcatttgtaagatcgacacccgttacggtgataaaaccgatgcgggggtcttttaattcagtttgtatgagttggcttagctccttcttgatctgctcgccaacccgacctgtacgtattttagccatggatgctcacctctctgccgttagcgctccactgtttccatgacgaacgcttcaataatgtcgagttccttaacatcattatagccatcaagggtaataccacattcgtaaccttgggcaacttcttttgcgtcgtccttaaagcgtttcagtgagtcgattttaccttcaaaaatgacgatgccatcacgaatcagacgtgcttctgctgaacgggtaattttaccggatgtcaccatacaaccagcgatcgtaccgactttagtaactttgaatacgttacgtacttcagcatgcccaatcacattttctttatattcaggatccagcatgcccttcatggcttgctctatttcttcaatgacattgtaaatgacacggtgtagacgaatgtccactttttcagcttccgctgtagatttcgcctggttatccggacgaacattaaaaccaatgacaatagcattggaagctgctgccaaaataatatcagattcggtgattgctcctgcaccactgtgaagaattttaacgcgcacaccttcgacttcaatcttgttcaaggaacctttcaacgcctcgacggaaccttgtacgtcacctttaataatgacgttcagatccttcatttcgccatccttgatgtgttggaacaggtcatccagtgttacacgggtattactgcccaggtcagattggcgttgcgtgatcgcacgtctgtcagcaatagcacgagctttgcgctcatcctcaaacaccatgaatggatcgccagcaagtggaacttctgtcaaaccagtaatttcaactggagtggaaggacccgcttccttaagacgacgacctttatcgttgaccatagcacgcacacgtccgaagcagttacccgctacgaaagcatcgccgactttcagtgtaccgttctgaacgaggatacgggctacagaaccgcggcctttatccagttctgcctcgatgatggtaccacgtgcccgtttgttcgggttcgctttgtactcattcacttcagctacgagcagaatcatttcgagcaggtcttccagacccattctttgtttcgcggaaacgttgacgaaaatcgtatcgccgccccactcttcaggtaccaattcatattcagtgagttcttgcttcactttatccgggttggcatccggtttgtcgatcttgttcacagctacgataattggcagacctgctgccttcgcatggttaatagcttcgaccgtctgtggcataacaccgtcgtcagctgcaaccacgataatcgtcatatctgtcacttgagcaccacgtgcacgcatagcggtaaaggcttcgtgacccggtgtatccaggaaagtgatttttttgctattaatttcaacttggtatgcaccaatatgctgtgtaataccgccagcttcgccaccggttacattagtcgagcgaatggcatccagcaaagttgttttaccatgatcgacgtgacccataatcgttacaactggtggacgtgttctcagatctgcaggatcatcattctcttccacggtttcaaaacgatcttcttcgaccggaattttcacttctacctcgacgccaaagtctccggcaagcaagaggatggtatccatatccagttcctggttaatggtcgccatcgttccgagcataatcagctttttgatgacttctgacgcatccttatgaagaagcttggctgtttcgcctacggtcatctcaccacgcacaataattttcttaggcgtgttgtcgattttctcgcgacgttcctgttgttgacctttaccacgattgttaaatttcccgccacgattactgccaccgcgattattgcctccacgaccaccgttaccaccgcgtccgccgccttgacggttatcgtcaaaacgtccttgaccggaacggttaccaccgttgttggagttactgcctgtacggttgccaccactacggttcgcattgttgctacctgtagaggatgatgttcttacagccgtaccaccctgactacttccctgagggcgtgagttagtgctttggttaccttgaggacgcgaacctgtgttgccactaggacgctgttgtcctccctgttgttgaccattactgcggttttgtgtactttgctgaccagtgggtctgctagtactttgttgactgcggttttgaccgccctgctgactgctttgcgcttttggagcgctgcttcggttactgttttggttgttgtttgtcctattcatacttacctgcttttcctgttgatttttggtttgctcagttgaatgattactattctggcttgaaccggcctgattcgagcttacttgcgccgtacctgctccgccttgcttggccgcagcattggatttaatattcttaaaaaaactttccactttacctacggcatcatgttccatgacgctcatatggttgttcacgggaatatccagccgtttaagaatggtgataatttctttgctgctcatgttcaacgatttggcgtattcgtatacccgcactttgtctttgctttcttgtttactcaatatactccacctccgacattatccccgcatgtttcttgatcaatttcgcgaatccttgatccgtcacagccagcacaacccgttcaggtttgccgatactgcttcccaagctttcccggtcaaatcctatcaataaggggattttgtacgtcccgcatttgtcgcggaatttcttttgagtattcattgaagcatctttcgcaagaatgaccagcttggcttctgaagacctgatcgctttaaaaacgatctcatcacctgttagcagcttgccagctctcatggcaagacccaatccagacagcgccttattcatcctgcacgctgccttgtgccgccaggaattcttcctcgacggcagcaaaatcacgacttagctgctcataaatatcaggatgaaccgagtgcttcaatgctcgatccagtgccttgctcttttgagccagcttgaagcaggcggctttgccgcacaagtaagcgccgcgtcccgactttttgccagtcaagtcaatcaacacttcgtcttcaggggttttgacgacacggatcaactgcttctttggcatcatttcatgacaggccacacatttgcgcaaaggtatctttctctgtttcatgcattaacccccctacactccgcttaatctacagaaacggaatcctgatgcatttcatcggtggatgttctcggtctgccgagttcttcctccgcctgtgtttcactcttaatatcaattttccagcccgtaagcttagcagcaagacgagcattttgccctttgataccaatagcaagagaaagctgataatcaggcacaataacacgcgccattttctcttcttcaaatacttgcacttcgagcaccttggatgggctcagcgcattagccacgtattcatcaacattatcggaataacgtacaatgtcgattttttcgccacgcagctcatttacaatggtctgtacacgtgttcctctaggacccacacaagagccaaccgggtcaacctcggcgttacgggaatgaaccgcgattttagaacggaagcctgcttcacgcgctacggaacgaatctctacaacaccatcaaaaatttcaggcacttcgagttcgaacaaacgcttaagcagacccggatgtgatcgggacagcataatttgcggtcctttggttgtgttttctactttggtaatataagccttgattcgatccagatggctaaatttctcattaggcatcaattcacctaacgggagaaccgcttccaccttaccaagatcaatataaatgttacgcgggtcttgacgctgtacagttcctgttacaatatcttcttccttgtccacaaacttgttgtagatcagtccccgttccgcttcgcggatacgctgggtcacgacttgcttcgcagtttgtgcagcaatccgtccaaaatcacgtggtgtgacttcgatttcagcgatatcttccaactgaaaatgcgggttaatctcacgggccgcaggtaacgaaatctcggtgcgaggatccaatacctcctcaacgatcagcttgcgggcatataccttaatgactcccgagttgcggttcatatcaacacgcacgttttgtgcggtgttgaaattccgtttgtaactggaaatcaaggctgcttcaatggcctcaaacagcacatccttgctgatccccttttctctttccaactcgttcattgcttcaataaaatccatactcatggattactgctccccctttcaaatgatgcacctgcgtactggtcggcacacgaggcaaaaaaacatgtagtacatgtcaaacagcaacagtcaaatctgaattaaaatatgatcgcgagccttgcaccagctaccttgtcataaggtatggcatgcttcttttgtccgctttgaacggtaagttccccgtcttcaaaagaaagcaaacgaccttcgaattccttcaggccgttgatcggctcgtatgtagtaacgaatacgtttttgcctaccgctttagtaacgtcctccgcttttttcagcggtctttcggcgcctggtgaagacacttccagaaaatatgctgtagaaacagggtcattttcatccaacttttgacccagatattcactgatcatactgcagtcgtccagatcaattcctccgtctttgtccacaaaaacgcgaagaaaccaattgctgccctctttgacatactcgacatcgaccagttcaaaaccatgctcatcgaggaaaggttgggccatttcttctactactgatttgatctttggtgtgctcaaagattataacctccaaaagtgaactttcctgtggtgaaaaaaagacgccctattaccatggacaatgcttctccatcaccggctttttcattttcatttgatgtaatgttcatttcgggctcactgcaaataaaccggcgtaccggtttcttgcccaaaaataaccttttcacgttgtaactgtatatcaaacagtaaagagtgggtttccccactcttttagcaacggttttatctccatgattaccaaaaaaattataacataaccatagttatgtgacaagtgccagagcttgactactgtggttcggattaaaacagagacagctgattactctctggcaaaccccgaaagcaacccatctgggacagcatttcgacaatggttttactagctttcgatttttgttgaaaatcctcgacagacaaaaattcaccatgttcacgggaggctgcgatgttacgtgctgcattgtctccaattccctgaagagctccgaatggcggaataagtgaatctccatccaccttgaagcgtgtagcttcagaacggtacaaatcaatggatttaaaactaaacccgcgagctgtcatttccagagccatttccaggatcggaagcatccctttttctttgggcggtgcctgaaagccgagttgctcgatttcgacaatcttccgtgcgattgcatcatatccctgacagcacagctcaatatcaaaatcggctgcacgtactgaaaagtaagtcgcataatattcaatcggatgatacagcttaaagtacgctgtgcgcactgctgaaataacgtaggctgcagcatgcgccttcggaaacatgtactggattttcagacaggaatcaatgtaccactgtggcaccttgcattttttcatttcctcaatccattcagcactaagccccttacctttacgtacgctctccgtaattttaaaggccagacctgcgtccatccctgccttgtaaatcaaaaatagcatgatgtcatcacggcaaccaattacagtcttgatgttacaggtattatttttaatcagttcttgtgcgttccccaaccacacgcccgtgccgtgagacagtccggatatttgcagtaagtcagcaaaagaactcggctgcgactctactagcatttggcgtacaaacttcgtccccatttctggtacaccataggtagctacaggtgtgcggatttgctggggtgttacaccgagcgcctccgtggagttgaacatgctcatcaccttaggatcattcattggaatggtcgtaggatcgacaccagtcaaatcctgaagcatcctcatcatagtcggatcatcatgacccagaatatcgagtttgagtagattcgcatcaaaagcatgataatcaaaatgcgttgttttccattccgagcttgtatcatcggcggggtactgtaccggcgtaatatcctcgacctcaatataatcgggaacaacgacaattccgcctggatgttgcccggtactgcgtttgacccctgtacaacccgaagccagcctgttcagctcagccccacgccattttttatgatgcgcctcttcatatttctttgcaaagccaaaggctgttttctcggcaactgtaccgatggttccagcacggaatacacttttctcaccaaacagtactttcgtatagttatgtgcgacaggttgatattcgccagagaagttcaaatcaatatcgggaactttatctcccttaaacccaagaaacgtttcaaacggaatatcctgtccctcacccttcagttttccaccgcatttgggacagtttttgtccggcaagtcaaatccgctcggcacactaccgtccaaaatccattcgctatgtctgcattcaggattaccgcaaatataatgtgcaggcagtggattaacctccgaaataccgagaaaggtagcgaccacagaagatccaacagaaccccgtgaacctaccagatatccatccttattagactttttaaccaaacgctcggaaatgagatagttggcagagaaaccatatttaataatcggctctagttctttttcaagacgggctacaaccacttcgggcaattcctcaccatagatggatttagctgtctcgtagcaagtgttgcggatttcctcgtccgcgccatccagcaaaggtgtaaacagcttgtcagggaacagctccagctcctcaaatcgatccgccaactcactggtattcttcacaacgacttcataggctttctcctcgcccaaaaactcgaattctgccagcatttcgtctgtggtacgtaaatgcgcatctggcttacgaatatcttttagcgggctaaatcccgtaatgccgtgtatcgtaatatcacggtacaacttatcgcgagtttccaaatagtgaacattgcctgtggcaattacgggtttatcaagtcgccgtccaatttcgcatactttgcgtattgccgttttcagagcatcgggcccgcttaccagttgtttttctactaaatgcatatacatcgtcaaaggttgaatctccagcacatcataaaactgtgcaatttcctcggcctcttcctcggacttgtttaacacagcctcgaagaactctcctttttcgcaaccagaaataataagcaatccgtctctcatttctgacaatttggatttaggaatacaaggcacacgcttgaaatattcggtatgagacatcgaaaccagcttgtacagattttttttaccaatcggattgagggcataaatacagcagtgaaaaggacgaacggtcgataaatccttacccacataatcattcagacgatcgagcatttttaaacccttaatttgttccgcatcattcagcaagccattcagcacttcagtcagtgcgactgtatcgtcaatggctcggtgatgactttctagcgccactttatatttggtcgtcagcgtattcagacggtggtttttcattgttggaaacagtaaacgagccagttctagcgtatccagtaccggattggtcatttcaggcaaacccatatttcgaagggtcgcctggataaagccgacatcaaatcgcgcattatgggcaaccaatacagcatcgccagcaaaagctacaaactccttcataacaggttctacatccggcgcgtccttgaccatttcatcgttaatgttggtcagttgctggatattgtatggtatgcgctcatgcggattaacaaaggtagcataacgatcaacttctttgccatcatgcatttttacagccgcaatctcaatgattttattctgtgtaaccgataaaccggtggtttcaatatcaaaaacgacataagtcgctgttttcaaatttaatggttgtgcctgcattacaacctcaacggcatcattaaccacgttggcctcaacaccgtagatcattttaatgccgtttttctttgcagccttagctgcatcagggtagcactgcacaccgccatgatcagtgaccgcaatcgccttgtgcccccatttggcagctgttttgacgtattgatcaatcgaggcaacagcatccatagcactcatctttgtgtggagatggaactcaacccgtttttcctctgcattatccttacgtgtgggtggagcctgtacttcaactagatcggaaggaatcataaccagctcgggaatttgcataaaacgatcatattcaactcgcccccgcactttaacccatttcccgttagccaacaaactgaggatcttcagatcttctttagttttagcaaacattttcatttgcagggaatcactaaagtcggtcaaataatacgtaaacaacgtactgccattgcgcaattctttactatccaaaccgaagattgttccttgtaaggtgacttttttctcttcgtcctgaatatcttgcatcggaacagccggttctttgatgtcataaccaaattgaagccgtacgtctccttcttcttcatccaaaggtggcatttcggattccatactttccatcatctgctgaataacttcgcgttcttcctgcatcttcttttcttggaattgctgtaatgcctcctggttactttcacccacttggactttaatgcgcatagagagaccgaaatatttatcgtaaaatttgatgatagcttgatctatctgtttttttcgcgccagttccaatgacatactgtcgctcatcgtcagcaataatagaccgtcttcccactcatgcacagcccgattcatccaaccgttaacagatgggatctcacgatgcacccactctagaaaaagtttccagtattcactgatgatatcaccaggctgaatctgctcactatactgaaaacggaacgtaatttttgcaatgtgactcattttttcctgtacttgaatacagaacgtacgatacacctgagcggggaccagtgtctccttggcaatggtgatattccaatccttattggtacggctaatctccacttgatcaatccaaccgtccaaaaaataaggttcaaccactccagccggcatcccaacttgcttcatcagcagttccagccgctttctcttttcttcagctccgcccatggctctccccccaattttaaatctaccattctgaaaacatgaaaagcttctgcgtcaaaaacatctccgaccgcaaaagcttttcgtagccctcttcaatccttctcacaacgacatagatccttcagaacattgtcccgtaatagctaccatgtcagcaaaaagaatgaagtgagtatagtgatattgccctacatctatattagtacgctcgtgcaaacactactgtatgcttggcaggtttgccacaacacaaacatgtggacttttgctcggttgttttaaacggtatgttacggcttgtagcacctgttacttctttaactttgtcttcacattcttcagatccgcaccagcctgccaaagtaaagccgcgtttttcttccatgagagtcttcatttcatccagcgtatcgacggaatagaagttttcttccatgaaatttttcgcacgatcaaacatctcctgctgtacctgtgcgagcatcgcgtgtacttcctcaaccagattatcctgctgcacgatttttttctcaccgctgatgcgggatacgagcacacagacaccgttttccatatcacgaggtccgatttccagacgaaccggcacaccgcgcatttcatattcattaaatttccagcctggacttacatcgctgcggtcgtccattttaacacgcactcccgcttgtttcaactcagcaaatagttcatctgcacgagcgataacggcatcacgcttcttaggtggtccaattggaaccataataacctgcgtaggcgcaactttaggaggcaatgccagaccacggtcatctccatggaccataatcagtgcaccgatcaaacgtgtacttgttccccatgaagtcgtatgcgcgaattccaagttgttttcacgactcaaatatttaatgtcaaatgcaacggcaaaattagttcccatatagtgggaggtcccagcttgtaccgcccgtccatccttcatcatcgcttccagtgaaaatgtatccttcgcacctgcaaacttttcagaaggtgttttctgtccagtaataaccggaatagccagaacttcctcaataacctcacggtatacttccagcattttcatcgtttcttcacgtgcttcttcttctgtttcatgggccgtgtgaccttcttgccacaaaaattcacttgtgcgcaagaaaggcagcgtgcgtttttcccaacgcactacattagcccattggttaataagcacaggcagatcacgataggattgaatccatttggagtacatatgaccaatcatagtttccgaagtcggacgaattgcaagacgctcttccagcttttccccaccagcctcggttacccaaggcagttcaggattaaacccttcaacatgctctttttccttttgaaaaaagctttctggaatgaacattggaaaataggcattacggtgccctgtttctctgaagcgcacgtccatggcttccttgatatgctcccagatttcaaaaccatcggggcggaatacaatacatccgcgaacaggggaataatccatcagttctgcttttttaataacatcaatataccatcgggaaaaatcttcgctctgcggcgtaatttcctcgacaaattgtttatcgttcgacatagaaatgcatgtcctcccatacagaccgtttttgtattaagcccgtctctaattaaccattaattaagcgtaaaatatcgttatacgtgaccgcaatcataagcaggaatagcatagcaaaaccaacgaaatggaccattccttccctgctcggatcaacaggacgtcctcttaccgcctccacaccgaggaaaacaagtctgcttccatccagcgccggaataggcagtaaattaaatatccccagataaagactcattatagcagtccaatacgtcaactgctcaatcccctgcttggcaatttgccccgtcacttcaaaagtacgtaccggtcctcccaggtcattgatagaaaaacgttgaataagctggctaaatccttgaaaaataatatcggtcgttctgaccatggattgcccggcaaatttgaacgtttcacccacacctgcttggcgttttggaagttcaggcacaatgcccaccttgccacccttttgtccttccattgcacgaggtgtaatagtaagatcaaaggtcttattatcacggcgaaccgtccacttcattggcttgtcttgagaatccgcaatcagtttgatcatgttttcaacattcgcaccaatggctattccattcaccgattcgatgatatctcccttatgcaaatcagcttcagcagcaggcatacctgctgtaatttcactaatttggacatacgtcgggttgtccacttgtatgccgaccatctgaatatgcagaccaaacaaaataaaggcaagaataaaattcatcagtggtccagcaaaaatagccatcgcacgctgtcctactgttttactcccatactgccgatccttgggtgcaatctgaatggattgacctttggttaccatcatcgcttgcgggtgtacagtgtattgctgatcttcgccatctacatccaattttaaagttaacgactgttccagatcaatatccaacacttcgccacgcaccacattcttgcgattatccagttgatccagatagatggttttcacgacgtcatccgttacgcgtacagcaatcgtttgtccggtctcaatttcattgacctccggatcctctcccgccatgcgggcaaagccaccgaacggcaacaaacgcaacgtaaatcgcgtctcgtttcttttataagaaaacagtttcggaccgaaaccgatcgcaaactcccgtaccagaatcccggcgcgcttggcaaaataataatgcccccattcatgcactgtcactatgacgaaaaacatgagcaccgtcatcaacactatttgaatcgtttccaatcgtttctgttcccctttcaatgagatcgagtttgtcttcctagattatcattattctccgatcccgcacaagagaatcacatttcgtttctaacccaacattagcctacaattctgcagctatgctacgagtctctccgtcacatgcttcaatcgcagacagatcaggattagccacattgacatgccgctccagcacacgttcaataatagcttcaatatgcagaaaagaaatttctccacgcaggaaacgggcaacagcaatctcattagctgcattaaatgcggtcggtgctgtaccacccattttaccacattcgaaggcaagccttaaacaaggaaaacgattataatccatttccttaaaatggagtctgcccacttcagccagtgacaacggcttcgccggggactttatacgctcaggataagtcaatgcatattgaatgggtactctcatgtccggattcccaagttgagcaacaatgcttgtatcctgaaactcaacataggaatgaataatgctttccggatgaagcaacacatgaatctgctcataatcaagtccgaatagccaatgcgcctcaatgacttccagccccttgtttaccatcgttgctgaatcaattgtaattttggcccccattgaccaattgggatgcttgagtgcatcttccactgtaacttcacgcaactgttctcttgtcaaatctcgaaaagaaccccctgatgctgtgagagtaatatgtgccacatctttcatacgctcaccattcaagcattggaaaatagctgaatgctcactgtcaatcggcagcaacggcactcctttcgcccgagcccgcgctgtgaccagatgaccagcagtaaccagtgtttccttattggccaaaccgatctgttttccagcctcaattgcggccagcgtggagtgcaatccgacactgcccattacagccgtcacaaccatatccgcctctgtgttcgcagcaagctcaacgagtccttcatttccccaatgcagttccattccagaaggcagtaaaggacgaatttcatccgccaactgccgagtacccacagacacttttttgggtttataaagatgagcctgctcagcaagtaactttatattagaaccacctgctaaagcctcaacagtaaactgatccgggtgcatggacactacatccagcgtttgagttccaatagatccggttgaaccaagtaccgtaattcttttcatgatgcaccttcctatcctgaaaatcacttttatccaggagctcattgattgttattcaggcagctatgctactggttccaaccttctagtagcgcaaagtgagcagcatagagattagcctgagcataaactgtaatcaatagactcatggaagcagcatcagcatatgtacaaatggaaaaacgacaatccagctgtcgcagcggtctagtataccaccgtgccctggcagcagattaccggaatctttaatgccgtacactcgtttgtatgcagattgtaccaaatcgcccagttgtcccacaactgcacatgacaaaccgatgccgatggctttgccccatggcagcagtccacccgataatccagcgaatacaagagctataaccaacgctaaaacgatgccgccaatggatccttcaaccgttttgttcggactgatcgcaggccataatttcgtcttccctgccattttgcctacaaaatatgcccctgcatcacttgcccaaatacaagccaataataagaatgtccataacagtccatgttccatatgacgtgattccgcaatatacgaaaatccaaaccctatataaacggtaccaagaaataatatagctaccgtttgaatcgggattttattttttgttcctaccgtgatgatcataaaagctatcattaccagccaaagcatactggcaaagggtaagggtgagtgaaaaccaaaaggttcaaacgggaatacaaaagctaatatgcttacgtatccaagtattgctgtacctccaaaaggagatacctgcgtcattcgtgcgaactcataaaatccgattagggccatcgccaatataagcaaatggtaggccaagccgccccacaggaccatcgccaaaaagaatatgcctgccagaataccggtaattaatctctgtctcaacggctttcatcctccatttacttcagcccgccataccgccgtgttctttgctgatattcgatcactgcttcgtataagtgttctttcttaaactcaggccaataaatatcagtaaaccacaactcactgtaggcaagctgccagagcataaaattactaagtctaagctcaccgcttgttcgaatcagtaaatcagggtctggcataccactagaaagcaacgtattaccgatcagctcagatgttatatcttctgttttaagcttcccatccgcaatttgacggcccaatgtttgcatgcattctgtgatttccaatcgacttccataatttaatgcaaaattaagaacaagtccggtattattttcagttcgtcgagtcgcttcagtcagcgcctcaacggtatgggaaggtaaatgttccttattgcccatcatacgcacttgcacatttttttcaatcagctcatctagctcaatagccagaaattcttgcggtaagcgcattagaaaatcaacttcgtcctttggacgcgtccaattttcagttgaaaatgcaaacaaagtcaaatacttaatacccagttcatccgctgcaattgctgtgcgtttcactgccttcattccattttggtgccctacaatccgcggcattccaatccgtttggcccatctgccgttcccatccatgatgacagcaacatgctgcggaatattgtcttttgaaatggccggtgtttgctgtttttgttccccgttccaccaagaccgaacccgtttgatcattccagttcctccagcattctctgaaaatgtgcctcaggcttgaaaagagacaaaccccaccgtaagggaggggctgccaatcttttaaacttccataatttctttttcttttgcagctaaaactttatccacttcagcgataaacttgtcagttgttttctggatatcttcctgatgtttacgagattcgtcctcggaaatatcacttttctccaattttttgatgtcatcattggcatcacgacgaatgttacgaatagcgatcttcgcttcttcaccgttcttcttcgtcaacttcaccaagtcagttctgcgttcctccgtcaaagcaggaatgctcagacgaatggtgttaccatcattcgaaggtgtcaaacctaaatcggatttttgtatagcgcgctcgatatcggccaaggaagatttgtcccaaggctgaatcatcaaggtccgggtgtcaggtgtattgatattcgccagctggttgactggagtcattgcaccataatactctacctgtacacggtccagtaaagctggtgtcgctcgtcctgcacgcaaagatgcaagatcacgttgcaatgcttggattgctttttgcatgcgttcctcagcactctttttcacagattgtggcattaatttacactccctttgacgatcgtgccaattttctcacccagcacgacacgtttaatgttaccttgctctgtaatagcaaagacaatcaacggaatattgttatccatgcacaacgaggatgcggtagaatccatgacaccgagatttttgttgagcacatccaaatacgtaagctgctcatatttctcggctgtgctatctttaaacggatcagcagaatatacgccatccactttatttttagccatcagaattacttccgcttcaatttcagcagcacgtagtgcagcagtagtatcagtcgagaagaacggattacctgtacctgctgcaaaaataacaacccgacctttttccaaatgacggatagctctacggcggatataaggttcagcaatctgttgcatcgcaatagatgtttgtacacgagtaggtacttcaatctgttccaaagcatcttgtaaggccagtgagttcatcactgttgccagcatacccatgtaatctgccgtggcccgatcaattccgttggcacttccagcaataccacgccagatgttaccgccaccacacacgatagcaacttctactcccagttctaccacgtctttgacttgttcggcaatggacgcaatcgtatccgcatcaataccgtaaccgttaggacctgacagcgattcaccactaactttcaggacaacacgcttaaacacaggtttttccaaatgatcaccctccaatatcatttatactttatgtaacaggataggtgtcctgttgcaagaaaaggaacactgatgtgttccatttctgttttttccatatgcaattaccgttcgttggtaattattgtttcacttgagacataacttcttcgtagaagttgtcttcttttttctccagaccttcacccagttcaaaacgaacaaagcgacgcagggagatgttttcgccaattgtactgattttttcgttgataagcgtggagattgttttgtctggatccttgatgaaagattgctccaacaagcagaactcctcatagaacttaccaatgcggccttcaaccattttttcaacgattttctctggtttaccttcgttcagagcttgtgctttcaggatttctttttctttttcgatctcttcctgtggcacttcttcacggcgaacataacgagggttcgatgcagcgatatgcattgcaatgtcgcgtacaaaatctctgaactggtctgttttagctacgaagtctgtttcgcagtttacttctaccagtacgccgatacggccgccagcatggatgtaggattcaacaacaccttcagtagcaatacgacctgctttgttggctgcagctgcaagtcctttttcgcgcagaacttcaaccgcttttgtcaaatcaccgtttgcttcttcaagcgcttttttacaatccagcattcctgcgcctgttttttcacgaagctcttttactgcgctagcattaactgccatattatttccctccaaatttgattttcagtggtataccgtgctttattccttaaaaaaagggtagtgagaggttatacacctgccaaccacccttttcatttaattcatataggtatttcctaatggaaatattatgctgtagtttcttcgccttggtttgcttccataactgcatcagccattttacctgtcagcaatttaacagcgcggattgcgtcgtcattacctgggataacatagtcgatttcgtctggatcgcagtttgtatcaacgatacctacgattgggatacccaatttgcgagcttcagcaaccgcgatacgttctttgcgtggatcaatgatgaacagagcactcggaaggcccttcatgtttttgataccgcccaagaatttttcaagacgatctttttctttgcgaagaataataacttcttttttaggaagaactgcgaatgtaccatcttcttcccaagcttccagttgtttcaaacggtcaatacgtttttgaatcgtttggaagttagtcagcgtaccacccaaccaacgttggttaatgtagaattgaccagcgcgtgctgcttcttctttaacggaatcttgtgcttgtttcttcgtgcctacgaacagaattgtaccattctcagctgcaatgctttttacgaagttgtaagcttcctcaacctttttcactgtcttttgcaagtcaatgatgtaaataccgtttctttcagtgaagatataacgatccattttcgggttccagcgacgtgtttggtgaccaaagtgaaccccagcttccaaaagctgtttcatggagattactgccatcttcacgcacctcctaagtttggttttttgtgtgtcctccgccgacatcatttttcataaagactttccattggaaagcaccctctataaaattaaccgacgtgcgtttttaacaccgtcaattaatataccataacacttgcatcgttgcaaccaacttttcgacaatagttggaacaacgcaaaatgtgacgttttacgcctcttatcgaacttgtcagcatgaataaaagccgtccacttcccggtctggtcagttggacggctttttcgtaattttagtaataatagaactgaaatcctcacctttagcaaactgataggtacccgtacgaattttggtattgattttttgggccttagctgctgcctcaaatgcactagcatccgacacaacccctgcccgttgcaatcctgatgccacacttctcaaattgcttcccgatgcaatgctatactgcacttgtggggtggcaggctgcttggggatgttgggagtcgttgtagtgccagacctttgagtttgcggcttattcggactttgtggaaccgatgcgctggtcgaaggtttagaagccgccgaggatgtgctatttgcaggtacctttggtgttgacggcgtttgagctggtttagccttttcgggtgcagccggagttttgttgccttccttgatcaccttattacgccattcctcttctgtcattttcggatcagaactgtcactgatctgaagatttaattcggctgctgccttttctagttgctctcgcgtcatgtttttcgggtctgtggaagattgctgtgattgtccctgaccgatcattgccagttgcaacagcaatgcccccgttataaggcccgtacccatgcctagcataaatgaacggtttttgatcacgttacatcctcccgcttcgcgagttgcaatatgagctgtacttccccccgctggatgcctgattgcttggctatataatccaacgacttgccttgctcatgcagcgcaaacaactctttataacgatcacggatggactctacttcctgctcagtttcagcgtcttgcaatactgtctgctcctccatagttacgagaggagcttctgaatcaggatagccttcctgtacagacactccgggttgcggactttgaaattgaccgtaagcaaccgctgcctgatgagaagttactgtatgttgtatttccttagatacaggctcggtttgcatagaaacagtagcaaacatagcctggcgctcaagctccacgatacggttccgaagctcagctacttgttcctgtaatgccgcctgtttaactgtatgctcctgcttcataccagatacgagctcaatcagctcgtcattgtcgttttcaatatcggccatatactgctccaatgtggcctcgaccttttgaacgacggcctcttctgttccccggcctggctgacgcttaggcagaagccaggcgtagacaacagctgcagcgcccagcagaacaatataaatccatggttgatccactgcccatcgtctcctttaataacgcttctccacctgtcggatcagagcgaaaaatcaatatggtgtcccttgtacggatgctctgccggatgctccttaggcacctcagtctcatctgattgggaacagctctgctgggaagaatctctgctctgtcctcccgtttgccgctcaccgacgaatgtttctgcagactgatctatggcactgcttcgctgacgcatgttctctgtctccagcgcggccttttgtccaagcaatgcttgatcattcatcggccgctgctgggactcactttggtattttcctgcttcactggtgcgaggtacggcaatttgcaattcaacagccttcaagctcattggaccacaccctttccgattgggcatccgtatctgtctttcaaggaatacaaatgttgaatgattaacagtgtgctgaattacacgtaggaggacatgctgatgtctccctcatgataataaaacgctattctttccactgaatctttaataaattttgtatatctgccgataactattttagagccaccgtaaatcacatttttcacttctacccgtgcccggctcgtatcctctaatgttcgttcaatttcaagcattctggacttggtttccaaaagctcctgttcattagattttttagtagatgtcagcttgattcgcatagccattctttcaggtgcaagctgtccggcggcggcaagttgatccaatatggtaagggccttattcgttttatcctggctgtctgtctgctgcttcaaacgtgcgcggagttctgttagttcatcgcgcagttcaggaagcacacccacttcgataacagtagctgtggacattgtattaccgatggtacgagctactacctttttaccagcttgtacactgccacctacgataagccctttggtcccctggcagagtacatttacactcgctttaatctgggaatgcatgatgctctgggatacaagtatatcgcctcccgcaatcacgttaccatcttgtatgaatgagcatttgacattttgtgcagccttcacgaaccccttatggtatccgataatgccgccactgatttccactgaaccttccgcctcaatttcagcgccttccacaccaccgatgacacgaatgtcgccagccgcccgaacgcgaaaccctgtcaagacattcccacgaatgacgacggttccaacaaaatcaatattaccgacactataatcgacgtccccgttcacttcatatacggggaacacattaagtttgcccttttcagtcgtagtcaccagtccgtcaatagccgcatacatggcaacaccttccggatggatcactacattttttccaactttaaaacgcgcctctctacctggaagaaaaggaatttcctctccggttacagcaatccccggtacacccggcagaggatcaactcgttcggcaatcaattgtccacgttttacatttcttaaacgagttagttctttataatccacccgtccatctacggtttcaagtggcttatgtgcatcttcgccagtcacaatatcagccagattaatttttccgtctttgccatggaccggctgctttccctgagcaatcagtaattttccgaagaaatgatcttccggatttgccgcaaatacacgaatcgcatcggtcattaaaccgtaggatattttttggttgcttagaaaacgctctaattcttccacagaacaggcaaaaccttcttcacgtttggcaaactccaagtaggctgtttgtttgtcaggtgagacaaccacttttaaatactggtccaaagcatattgcttctccacaagggtgctccttccgtctaactgttactgtaacctcccgtacgttaatctttacgcattagcaaatcccgttgtttgtccaatgtcgctcttagacgtaatattgctttggaatgcaactgtgaaattcgcgatggagatagcgacatgacctcagcgatttcgctgagtgacaaatcctcgtaatacaataaagaaacaacgatacgttctttttcagtcaatttatcaatgccttgtgcaagggcatcacgaagtgtaaattcattgaccttatgatccggatttttcgccttctcgtccaccaaaagggaaagccgtgtttccgattcctcttcacggatggggtcctccagtgagacaatcgacataacagcgacttcctggatcatactttgaaactctttttcagaaacgtccaaataatggctcatctcttcgtcgcttaccgtgcgtaaatatctttgttccaaatgctggtaggcatcctcgattttttttgctttttccctaactgaacgaggaacccaatccccttgacgaagaccatccaaaatcgctccgcgaacacgccaagaagcataagtctcaaactgcaaaccacgctcatagtcaaatttctctaaagcgtcaatcaaacccataacgccgttactcgccagatcatccttggatacatttttgggcaagcctactgcaaggcggcccgacacatattccacaatatggagatacttttcaattaactgtttctttgcttccttgtcaccgtgttctttccattgctcccatagttcggaatggtttaaatgagcggctttacgctcgttcatcggcttcaccctccttatttgtctgtcaggtgacgaacggccttggccaattcttcagggtccttgttggaaaccagcttaggtgggtttaaaggcgcgaaacccttgttcccttcgtccgtctgctctggtttcggtttcagcaattcattcaggttttcattctcgtctggtgtcgtcaggtccagattcccccctacgccatctacctgagagcttgcccggctttgggcattccccagatctggccgcgctacaacacctagtgtccagcgcagcacaaatgcaagtaggaaccaaaaaacgaaggcgatcaagccacgaattaagctcgtggtcagcagattgctgccaacggacaacacaaaagtcagaataaatccgactactccagaccaaagattaatgcgtaagctgccaaataacatgtttataattcctttacacctttttgtacgcttcgaatattcaaaacgccagtttcagagtccaactcaatcgttcgtccataattgccgcctgtgtcctccgcaatcaagggaataccgagatctacgagcatttctttgcatgattctacattgcgtggaccaatgcgcatggtatctccactaccggcaaaggcgaacatctgcgctccccctgccattttggcaatcagtctgcgtcgttcagcacccaatttcagcatccgctcaaataactcgggcagcgccgtatcggcgtatttagcaatattcagttgcccttcacgtgcaatatccgaggatggtagcatcacatgtgccatacctgccagtttcaagtgaggatcgtagagagtcaatccgacgcaagaaccaagtcctgtcgtgcgaatcgagttcgggttactggtaacatttaagtcagccataccgactttaatgatgcttttatcctcaatcatcgttcatcgggactcctaacgacctaaagattttcccgaacgattctggatcaggaatcaggaaaaattgaccctctatctgattctgcccttccagaaacgatgtgtcaatcaataatgcagcatctcccatctgcccaaactgcaacagtccatagctgagaattgctcctgccatgtccaacgccagcgcagggactgttggatacatagataaacgcgtaaagtctgccagcgaagacaagtatgagcctgctaaaatgtttccgatctccgacagggctgagtgctccatttcgttaaaactgtcctcgtcatctgaaggaatattcgccaaacgggaaagtaagccttttgccgcctgaggctgcaatatgaagaatagattcccgggggcttccccttctaccctaaaaaatatggcgacaacaagttgctcatagccgccgactttctcggcaatttcctcaaagggcagcatttgtactttgggcacacccatatcgaccggtttattgagaagccgggagagcgctgtagcagcgttccccgagccaatgttgccgacttctttcaacacatccaacttgaagtcttcaagatttccaagattttccatatgttaatcctctaagccttccagttggttcatctcgctacgattcaggacttcggacaagttcagcataatcaacaagcgctcttcaccaatcttagcaactccgcgaaggtatttagccttaactccaccaatcacttccggtggtgtctcgatattgtcagaattcaggtcaataacatcattcgctgagtcaacaataaagccgacttgcatttcacccactgcaacgataatgatgcgagtttgatcggtatattcagcttcaggtaatccaaaccggccacgaagatcaataaccggaatgactacgcctctcatgttgaatacgcctttaacaaaatcgtaggttcttggaacccgtgtaatcggcaccatgcgttcaatagattggactttttctacttcaacaccgtattcctcttcaccaagcttaaatacgataactttaatttcttctcccatgtctaaaaaccctccttattgatgtcagcaacttcacatttctttcatttttgatgaagacattatttaatgaaaacattcgggtcgatgatcaaagcaacctgaccgtcacccagaatcgtggcgcctgaaattccttggatgtttggaaggtatttgcccagatttttaaggacaatttcactttgtcccaaaaagtcctgtacggaaagagctgccagacggtctcccttgcggatgaccacgacctctgtctcttcttcttcatcttcattgaagtccggtacctcgaacagctgactcaaggagatgagcgggatatgagaatcgcggaaagcaatcattttattgccatgtactgaacgaatttgtgttcgcttgacgatcgcagtctccacaatggaggacaatggaatcgcatatttttcagaaccgatctgtatcatcatggctgcaataatggatagggtcagcggcaattgcacagagaaattagtgccttggcccagtgtagagtgaaccgtaacattaccacccaaagcggtgattttggatttaacaacgtccaaaccgacaccacgtcctgatacgtctgaaatgactgcagctgtactgaagcccggagcaaacaatacctgataggcttcctcgtcggtcatgaccgctgcttgctctgccgtcaaaatccctttagaaatagcactgtttagtaccttatcgcgattaataccatttccgtcatcttcaatctcgatgaatacgttatttccgctatggaaagcacgcaagtgaaccgttcctgtctcaggtttaccagctgcaatccggtcggctaccgactcaatgccatgatccacggagttccgaagcaaatgcaccagaggatcgccaatttcgtcgataacagtgcggtccatttcagtctctgctccagtaataaccaaatcaagttttttatccagcgatttggccagatcgcgcaccatacgcgggaaacgattgaaaacagtatctactggtaccatccgcaatttaagaacgacgttttgcaaatcgctgctcacacgactcatgtgctctaccgtttctgtcagtgctggattggaagcttcacttgccaactgctctaaccgcacacggtcaatgagcaactcgctaaataagttcataagtacatccaggcgttcaatatctacgcgaatcgtacggttatgcgtaggcgcagctgccttagctgctggtgctttacctgctgctggcttagccacagaggccgcagctggagactgcggctgggatggagcaggtggttgcacggcaacaggtgcttcctgcaccgcagcagcctcagccagtccagcagtaacttcgctcatttgtttaagcgattcctgatctagttgtaccactgagacagtgtcaatttcagagatacccgcgatttccttttccagctccccaacttctttctgcgttatgtaatataacgagaagctttgctcgaatttctcctgctcaatatcctgtaccgacggataggccttgacgatttcacctgagttttccagcgtgttgaacaccataaaggcacgtgccgctttcaactggctctctgagctgattgttacctgtatatagtgaacacgatgtccttcagaaatagattgctccagtacagaatactggaactgatccaagacaagcccagcacgatcgtttttgtccacttttttagatggagactcctcagtggcagcatttgtgccggacttttggaaatccccactcacgatggattgtagtgaagatacaatagaggagacatccgcttttccgtcgcctccctctgtaatgtgctgcaccatggactccaaagcatccaatcctttaaataaggtatcgaatataaattcatgcatcgccagcttgttgttacgtaccagatcaagaacgttttccatttggtgagttagcgatgctaggtcttcaaatcccatcgtagcagccattcctttgagggtatgggcagaacggaaaatcacctgaacgatgcctagatcggttggattgctttccagttgaagcattttttcgttaagagattgcagatgatcattcgactcatcaataaacatgtttaaatattggttcatgtccattgtgagacacctcctccatgagttacactccgattatttcacaacttgtacaagcttgggggcgatctcctgcattggcagaaggtgacgcacacattttaactctactgctgagcggggcattccgtacactacacaagtttcctcattttcagcaaatgtggattgtaccccagcatcataaagctttttcatcattttggccccatcgctccccattccagtgagcaatactagatgccgctccaacgaggttaacgagagcaacgattcaaacatcgtatctacggaaggacggtgaccattgcgagcttcctccatcttcagtgacacagtgtatttaccaccggctcctggcacaattcttagttgatatccccctggggcaatgtaggccgttccagtctccagcgtcattccctgctcagcctccacaactcggagtggacttaacgtgttcaagcgttgtgccagcgaacgagtgaagtttggcggcatatgctgaacgataacgattggagcaggaaaatcaccaggaatgcgttccaacagcgtcttaagcgcccgcggaccgcccgtagaacatcccaccgccaccagtttgcgaaagctggacgtatgcacaccttttttaagagaaaatcctttaggtgcggcaggaactgtaggtgccgttactggaggcgtagcagccgctggaataggagtagctgatgaactcaccgtcttacggggctccggcttaaccagccctgctttatccttaccatgcagcgatttgtcagcggccgtattagaactgtttagtttccctggtgttcgtcccatccccttggacaagtcttccttcttctgaacagtagatgcttggactgacttgcttggctgagcagctggctgttctatgcgccccgccgtaacagatgttccagactgttgtcgtttagtttcctgcttggctgctgccgggacggacttgccagcatcacgcttcggctgagttgatacagcaggtgaaggagcaagcggaacaaccggaggcttgtctgtcgaagcttgactgcctgctcgtttctcagtcaccgcctgtcctgtaggcttttcctttggcgtttttttcgcttgttccaatgcagctttgcgctcattagcttccttgcgctccaggcggctccgcactgcttgcatagcagtgtgcatctgttccagcagcgccttgctcacttgctcgatatcttgcgcatgagcaatggaaggctttcttataaaatcgaaagctcctgcctccagagccatgatggtctccttcatgccttgttcattaatgcctgacagcataataacaggtagcggatgggctgccataatcaatggcaatgcttcaagaccattcatttcaggcatctcgacatccatggtgaccaaatcgggctgcaattccttcactttctctacagcctctttgccattggcggctgtacctacgatgttgaacgactcatcccttacaattaaatctgtaataattttgcgcataaaggccgaatcatctacaaccagcacccggtaagcacacatgttaaacacctctgtttcctctcatcaaaatcaatgtacagaacgtcgcaaccatttttgcataaaccctttaattccactcaatgcacctgattgcggaatctgtggcattgctgcaaaacggtgtgccagattcaatatatctcttgaagccgcacatcccggaaaagcaaccataaaaggtatttgccttttgactgcttgcatgacatgagtatcatcactgatatacccaagcaacgggatttcgatctccaaaaagcgtctcgcaaccagtgcgatcttatcggcaacttgacgggcctcattatcgttatcggcacgattgactataattttgaataccgtatccttttgcaacccgctgacgactttaattagcgcatacgcatctgttaaggacgtcggttccggtgtggttacgaccaggcattcgtcagctgaagtgatgaatttaaggttttctttagataaacctgcacctgtatcaaatagaatgtaatccatatctgccgccattttttctacttcttcggcaaaataattcagatcgtcatccgataacgcaaacaattcgctcaagcccgatcctccagcaatataaggcaaaccacctatacccgtttgaataatttcatcaattgatttctcacgttttaacaggtgaagaagattgtattgtgaattggcccccattaatacatcaatattggccataccgatatcagcatcaaacacaagtacctttcgaccaagggattgcagagccagagcaaaattcagcgtaaaattggatttgcccaccccgcctttaccactggtgatcgttataattttggcttgacgattacgtgggggcaatcgatatttatccaaggaagaagccatttgtctaagggattgggcttggtcactcatatggaatctccgttagctcctgatgattctttgggtccaagcagcatgcttgtcaccatttctgtatcgggatgaagcaggtcgtcaggaacattttgtccattggtaatataggccagttgcatcggaaattgatgcaaaagattaaacattccaccgcagctacctgtctcgtccatcttagtaaatacaaccttaccaagaccaaacttactgaaatgtccagttatattgagcatatctttgcttttggatgtcaggctgagtaccagatacgtctcactttcattaataggcgaaagcagactttgcagttccgaaacaagtaattcattacgataatttcgtcctgcggtatccatgaggatcaggtcacaatgttccagacgttgaatggctctgtggacgtcaccgggagactgcacaacttcaagcggtacattcaaaatcgtagcatatgtacgcagttgctcgacggctgaaatccggtacgtgtcagaagtaataaatccaactttgcgatgatgcttaaacaactgctctgctgctaacttggcaatggttgtcgttttccctactccggtaggacctgccacatacacaattttggtatctttggagatccctttgtccagtcttatctgaataaaactggccacttcctcacgaaaggcttgttcccaatcaaaagtttcaggcgcaaaaggatgctcactccggcgcacatatacctgttcgagccaatactccagtaaatcgcgttccacttcctgctccagcatacgctcacaaatctcttgcagcggctccggccaagtactttccaatgaagaatttcgggaaaaccgagtcatcatagccttcatttcccgcaattcattaagcagagcctgatttccctctgctccgctcttctctggaacacttacttcaatgggctgtttaaacagttcactggatgatttcatgttcgaaagcaatgcttcatgatcaagtacttgagacatagtctccagattattagcaggcctagataacaaatgctcagttgctgaagctgcctgttctgcatcattcgttaactcagcttgttcttctttggaaccacccgtcatctgcgttacccgccgataagcttctggagcagcttgtctgggaaccacgggcataaatgatttttctggctgttcaggagcattcattgaagatgaagccgcctgggtaggctcttgtgaagatggtccaaaccgtcgtggcttttgaggttgcttttcctctaccgcagctaccacttcgattttctttttactgaacattcccatgaaaccgccgaccttcatttcctttgtacttaaaatgacggcatctgttcctaagtcactcctgatttgcagcatagcttctggcatggtatccactacatatcgtttcactctcataagttcaccaccccgacactttgaatttcaacgttcggctccagctcactgtacgacagcaccgggacatcctgcatagtccgctccatcacttgccgcaaatacatccgaattgtcggcgacgttaacacaataggctgctgtccagattgaatgagacggttgatttgctccatcatcctttgatacaccgtttgcgtagacaccggatcaagagccaaatagctaccttgctccgactgttgcacgctttcagcaattttcttctccaatcctggtcccactgtaataacgcgtaacgtctccccttgttgggcaaattgctgcgtaatctgtcgggacaacgcctgacggacatattcagtcagcacgtcgggatcttttgtataagtaccgtagtcagctagcgtttcgaaaatagtcaccatatcgcgaatggagattttttctttcaacagcttggctaacactttttgtacatccccaatcgcaagcacagaaggaataagatcgtccaccagcactggataattctctttgagattgtcgaccagcgaccgtgtttcctgtctgccaagcaactcatgagcatgtttcttgatcgtctccgtaagatgagtagctacaactgaaggtggatcaactacggtataacccgatagttccgcaacatccttggtgttctcatcaatccagagcgcgggcaatccgaaggccggttctgtcgtttcaatccctgaaatagaatcgtcatcgtatcccggactcatagccaggtaatgatttaacagaagctccccgccgcccacggtattacctttaattttaatgacatattcgttaggcttgagctgaatgttatcccgaatacgaatgaccggcacaaccaaacccagctccaaagcacattgacgacggatcataataatccgatccaataaatccccgccctgctgtgtatccgccaacggaattaacccgtatccaaattcaaattcaattggatctacctgaagcagattaatgacactttctggactacggacttcttcaatttgttgctcctcttccagctgttcatcagctatctgcttgcgttccatattgccctgcattcttcgagccgcgaaaaacagcagaatcgccagtggaagagttgtaatgatatgaataggcgtgaagagacccaataatgcaattgtggcagccacaatgtagatcagttttggataagaaaagagctgtccagttaaatcctctgccaagttgccatccgatgtagcccgcgtaacaatcaagcctgacgccgtggatatgagcagtgcgggaatctggctgaccagtccgtcaccgatggtgagtacagaataagtcgacagcgcctcttgaaatcctttcccctgaacggccataccgataataaagccgccaaccaagttaatgatcaaaatgataatactagcaatggcatcacctttaacgaatttactcgcaccatccatcgctccgtaaaaatccgcttcccgttcgattttactgcgtcgttcacgggcttgctgctcattgatcaaacctgcattcagatcagcatcaatactcatttgtttacccggcatcgcatccaatgtaaaccgtgcgcctacctcagcaacccgctcagatcccttggtgataacaatgaactgtacgaccacgagaatgagaaagacaacaaaaccgacggcaatttgccctcctgcaatccaactaccaaacgtagcaactacttcccctgcatgtccctcacctaaaataagtttggttgtagagatattaagtgccaaacgaaacaacgttgtaatgagcagcaatgaagggaaaatagaaaactgtaaagcttccttcgtattcatagaaacgagtagaatcatcaaagcaatagaaatattaatgacgagtaggatatccagcagccatgatgggatcgggagaatcatcataagaacgataccgatgacgcctgcaaggacagttatttcttttattttcacgggtctctagccctccgatccctttatttcactttaccttttaatttatatacatacgccagcacttcggcaacggcctggaacagatcagctggtatcgcatctccgatttcggctctttgaaacagcgcccgcgccagcggcttgttttccatcgttattacgccgttttgcttggcaatttctttaattcggagcgcaacgtaatcttgccctttcgcaataatctgcggcgcttccatctccgaaccgtcatatttcaaagccacagcaaagtgcgtagggttggtgatgatgacatctgcattaggaacctcctgcatcatacgctgcatagccatacggcgctgacgctcgcgaattttccctttgatcagcgggtcaccctccattttcttgtattcatccttgatgtcctgtttggacattctcaggtttttctcatgctcataacgttgatacatataatccaacaccgctaaaacgaacagcaccacaccaattttgagtcccagttccattgttaatgaagctgtaaagctcaacatctgatcaccggacatttcagccagtttaggtaggtcagcttttgttttccagagtacgctgtacaccagataaccaattacggtcatttttaaaacagatttcaggaattcaactaatgatctcatggaaaaaatgtttttgaatcctttaatcgggtcaagcttgctaaacttgggcgtaatcccctctccaactaataaaaaaccgatctgcatgtaattcgctgctatcccgatgacaatagccccaataaaaataggcgcaagcataatcaagatttgcacgccgtactcacccatcatcagcagcgttgtgttcggagttacctccatagagagccgattcacaaaaatatctcgaaatagtcgaactgcatggtccttaaaatacccgccgaaaatcatgaggcaaaaaaacgtaaccagcaggacaccagcggcgggcaactccatgcttttggcaacctgccctttttgtcttgcatcctgtttctttttgggtgtagctttttccgttttttcccctgagaacaactgcaggttcatagcatatttaaatgacaaactacgttcctccagaccagacattaaggacgattacccataatatccaacaaattgcgcatggattcgaacatcacagaaaacaatttctcgaatataaaagcaaaacttggcatgagaagcagtaacatgaacagtcccacaaaaattttaagcggtacaccaatgacaaaaatattaaactggggagccgttttagcaagaaatccgagtcccacatccgttaaaaaggtagccactacaatgggagcagcaatttgaaaggcaagcataaatgattccgcaaaagaacgtaccaggaattcagttacactgccaccatacagctttacaaaaaaatcatttgtcagcggtacccaatcatagctgtataagatagcatttagcagatgatgatgcccgtttatgctcaaaaaaagcaatacagctatagcaaacttgaaattccctgttaaaggcgatgaagctcctgtcattgggtcaagcacattagccatcccgaagcccacctgaagatcaataaaggagcctgcggtttggatcgctgtcataaacagatatgcggtaaagcccagcaacaacccaatcagcacctcacgagcaactaacaagacatacgccgcatctgccggtacctgttgatgcgtaccgtaggttagatacacgaccaaagctagaaatcctgaaattccaactttaaagatattaggtaccccacgggttgaaaaaataggcgctactacaaaaaatgaggtaatccgacaaaaaatcagcaaaaaaacagggaaactctgtaacaatatgttcataacattcagcctaacctatatatttgtacaaattgtccagaatgttatacgtaaagtccactaatgtggtcaatatccagggcccgaacaaaagcaatgccagcaatacggcgacaatcttcggaacaaaggccagtgtttgctcctgaatttgggttgtcgcctgaaaaatgctgataatcaaacccacgactagccccaaaatcagcatcggagcactcaccttgagtacaatgtacaccgcttgcccagccaaggaaataataaactccgaagtcattgccgtcctccttgattgctgtccttgcatgaaatattcatgtgttaaaactcagaagcaatgatttgacaaccaaataccaaccatctacaagtacaaagagcagtattttaaaaggaagtgaaatcattaccggtggtagcatcatcatccccatagccatgagtgtactcgctactacaatgtcaataactaaaaacggtataaaaaccataaagcccatctgaaatgccgttttcaattcactgattgcataagccggaaccatcaccgttagtggaatatcctgataattctttggtttttccattttggtgtatttcataaagagtagtagatccttctcacgtgtatgagagaacataaaggtcttgatcggtaccgatgccttatccagcgcctgagactgtgttatatcccccttgagatacggctgaagtgcagtttcattcatagctgagaacgtcggtgccataatgaataaagtgagaaacaaagccagtccgacaagcacctgattaggcggcatctgctgggttcccagcgaagttcgcacaaagccaagcacaatcacaattcgcgtaaaacttgtcataagtacaagcaacgcgggcgctacactaatgacagtaataagtaaaataatagacagcgaggtggcaccgggctgtcctttgtccgaattgccgacttgaatatcaatgttcggaatcggttccgcagaggccgccgtcaccgaaatgaagctgaacaagacaagcagcaaacatgcaagtataatcttttttctcatgaatctcccgaccgatctgtagtattctcctcattgcgcagcttttcaagtttatccttgcgattcggcatttgccgaagcttggattcaaacatctcgtgaaaagatgtctcctcttcaggctgctgctgtgccgcgttgttccggcgaagcttatccgcaattttagcgaatagcggggcaatcgggccgcgctgcagagaagcttcttgctccagtgcggccaaaatttgctccacttcttcaggatcggatactttgtcaacaagccggatatcttctcccacaccaatgaggtacacactgctaccaacttcaacaagctgaagggatttattgggaccaagtcccacgcctcccagtatgcgaacggagcggttgctgaaccagctctgatttcttttactcaaaaaccgtatcaagtacacgatcagtacgatgataaagattagcacgaaaaggacccaggcaatgttgcctatattgctggatgtactcaatgcgtcagaggcaccctgttgtgtatccatactgggtgcgccttacacacccagtgttttgttgatggcttcgataacccgatccgattggaaaggcttaacgataaaatcttttgcgccagcttgaatggcatcaataaccattgcttgctgacccatcgcggaacacatgataaccttagcgttcgcgtcaatttgtttgatttccttcagagcggcaatgccgtccatttcaggcatcgtgatatccatcgtaatcaggtccggacgaagctccttgaatttttcaatggcctgtgatccgtcctgggcctctcctactacttcaaatccatttttggacaggatgtcccgaatcatcattctcataaatgcagcatcgtccacgatcaaaatacggtttgccatctgaaataaatcctccctaaattatgcttttattgtaatttttgaatacggtcccattggcttacaatatctgttacacgcacgccaaagttctcgtcgattacgacaacctcgcccttggcaatcagtttgttgttaaccaaaatgtccaccggctccccggcaagcttgtccagttcaataattgaaccttgtgagagctccagaatatctttaatttgcttttgggtccttcctaattctacggtgactctaaggggaatgtccatcaataaatttaaattgttttcatccacttgcgcaaatgcaccggactgcaagttagaaaattgtacaggttgtacatttacattacgtcccggtactgcaccgtagtgatgaggcgttccgtaaggagcttgcggcggtacgccagctggcattccataacccggtgttccatagcctggagcgccctgctgcccatatcccgggtcttgaggatacattggcggttgttgcccatagcctgcgtcttgcggcgcctgcgcggctgcaggtggctgttgataggctggtgcaggcggttgctgcggaacgctggcttgttgcggcgcttcgggagcagctgttgcagctacctgctgtgcggacgcttgcggttgttcttcatcctctccgccattcattaggatgctcaccatttttttggcgaaattaacaggcaacagttgcatcagcgtagaatcaataagatccccgatcaataaccggaaggatactgtaatgagcgtttcttcatccggcagactagatactccatcaccgtgcataggatccaaaatatcaatacccggtggagagatattaacaaaacgattaaacatggtagacatagaggtcgccgacgatcccatcatctggttcatcgcttcctgcacggcactgatgtgaatttcattcaattcttcatccgctgggttaccttcaccaccaagcattaagtccgctatcacctgtgcatcacgctttttgattacgagtgagttaataccctcgaatccatctacataatttacatgtacagctacgtgtggctttggaaatgcagtttcaaattcagaacgggtaataattgaaactttaggtgtcgtaatatccaccttttgaccgagcagtgtggaaagagccgtagctgcgctgccgaacgttatattaccgatttccccgagagcatcctgctccagaggagtcagaaaatcgtcaacggtcttgttggcgggagtagaatccgtccccgcttcagactgtttcagcaaggcatcgatttcctcctgggacaaatagtctttactcgtcaatttcttcaactccttcgttgacaatttcatcaatttgtacggcaacacgatctcttaccatgccgggacttcccataaacttcaatttatcgcccacccggatggatagtccttctttgacaggcttgttcaatgaaatgacatcccctaccgaaagacccagaaactcggctacatttatccgggattcacccaactccgcaataatagggagctctgctttggtgacccgtaatctcaaggcgtcgatctcttcgggcgcccttgatttcttttcggatgtaaaccactggtgcgtggacagtctggccataatgggttccaataccacgtgcgggatacagaggttaatcatccctgtggtatcaccaattttggtactaagcgaaatcagagcaatcgtttcattgggcgaaacaatctgcataaactgcggattcgtttccatcgcctctaggcgcggttcaatgtccagtaccgttttccaagcctcttgcaggctatcaaaggtacggctgaaaattcgctccatgatcgtcgtctcgatttcggtcaacgcagtaacctttgacggtgccgaacctgttcctccgagaagcctgtccaacatggcataagcaacgttcgggtgaacctcaagcaccatacggccttccagcggttcagcttcaaaaatgtttagaatggtcattttcggaatggagcgaatgaattcatcataaggaagctgctccacctgaacgacattaatttggacaaaagtacgaagctgcgctgaaaaatatgtggtcagataccgcgcaaagttctcgtgtatccgcgtcagactccgtatatgatccttggaaaacctaagcgctcttttaaaatcataagcgcgaactttcttttgggtatcttcctttttaagttcttccgcatccatttcaccggacgaaagagctgctaaaagggcatcaatttccccttgtgacagtacatccaccaatgttattcacccccttacgtgttcctgacaagttcacctggaatcaaatggctgccagcaaaaagtctgtaattttggcgttccccaggtgaccttcagggagcgacttgttgatgagatccgtcagcttgtcactgaactggtcccggcctttagccgttctgagctcatcaggtttggtgtctgcaagcaattgaataacgatgggcttaatactgatgtctttaattttttcaaaagattcttttgctttggcatcgttcaattgaaaagataggttcatctggacaatgtaatctgcgtctgccaaattcgttttgataccggtaatttcagagctcacttccaccaattcatctgctgacaatcttggaagttgttctgcttgagcagcttgcgcattcggtatgacttccgacttcttcccgctaagcgctggtataagtacaaaggccgcgcctgcaatcaaagtaatcgcgagtaaaattgtaatgagccatggcagcatcttcttcattcgtcttcctccatttgttgcacttttatcgtggcggcatgcatgccgatttcacggctataacccttgatcaaggagacgacatctgccgctttttccaatacaatcaaccgtttccccgtcaccaaagtgacgtatgtatccggtgtttcctccacagtctcaatgagcagcgcattaagccacataggcgagccgttcagccgcgttaacgggatcatcgtaacaccaacctcctgataggtgcggaggagcctctactcctccgcgtttaaatgagattatcgtttcaagtttacaacttcctgaagaacttcatccgaggtcgtaatgatacgcgagttcgcttggaatccgcgctgagctacgatcatttcggtaaattcgcctgtcagatcaacgttggacatttccagctgacctgagataatagctcccagaccatctgcgttagcagtaccgatttccaattcctctaggttagagttaactgtggtacggtataaacttcccccaatcttctccagaccttctgtattcgccactctagccacaccaatttgaagagcattatcagttgtaccatcttgcaattgctgcacaattgtaccgtcctgtgagatagagaaagatgcgacatcttctgaaagtgtaattggagttcctcctgtatccactacgaaaaacccatcggaagtaaccagatttcggttcgcatctacgtgaaaatcacccgcacgagtcagataaggaacttcctgtgcatcattcattttgaccaggaaaaatccgtcaccgttaatacgtaaatccgttgggttgttcgtagtcattgcactacctggaaggtgcagtgtatcaattgagctgaccgacactcccaaacctacctgcttggcattttgcccggcagttgttgttccgtctggtgcacttgcgcctgaactcgtttgactcaagatatccttgaacatcactcggctggacttgaagcctgtagtatttacgtttgcaatgttgttaccgataacgtccagcttcgtttgaaagcccttcatgcccgatacacctgaatacattgatctcaacattgagtataaatcctcctctgattggttgcttagttgaccgcatcagtcgatccgcggctttttcatggctttcctattcgggccagccacttcgtatacatttttatgaaataattacagcactatctatctgcgtaaatacgttatcctccatggatttcttatccatcgcggtaacaactgttcgattaggtacacttacaatcaaagccatatcctgcattaaaatcaatgattctttggcgcctttggcagctgctttatccacagcagagttgattttcgccatttggtcacttctcaactctattccccgctgctccagacgcttggctgcatggttgctcagcttgagcacctgttcctgcaacacctgaccgaacggtctggcatccttggataccgaatttactcggttttgtgagattgctgccggtggcacgttggcgggaaaaaggcgtccgaccgttatcctgtcattcatgagttctcaccgcttccagtagaggaagaaggggaagtatccgatgtatttgtagcgggagtcgttgtattagcctgactcactgatgttacatcttttaatgccacctcagccgctcccattttggcatactgcacaccgtcacgaataacgatggaatccacgattccacttttcactgtacccgcacctgtttcacctgtaatggagtcttttttacctgcctcaatccagctgacttcttttcctatcaaaccggaggctgtacctaaagactgtcccaatgcattcagctgcgtagaaatgttcatcagttgttctaccgaggaaaactgggccatttgagcgataaattctttatcctccaaaggctgcatcgggtcctgattttgtagctgggtgatcaaaattttcaaaaactgatctttacccatcgttttagtatccttggcacttgctgttttgacattattcacattgtaattcggccagacgttactggtggatacattgttgtctgtagtcgtcattgtgttctcacctccatcattacgcttgtgctgtaaaggagcctgtccgattcatatcatctgcgcgttgttcagctgtccagttacgaagctcttctgccatttcagctaccttcaaagcatcctcgctctcttctctacctcgagctttggaacgttgattggattgctgctgctgattagctccagatccgcgtccatcctgatacatatgggaggaaagcgactcattgtgcgttacttctaccttatctacctggataccttggctctggagactcgaacgcagctgcgacatttgctgttccagcaaatccttcgctccgctatgctcagtcatgaactgggcaaccagatgaccattttgcattgtcagcttaacttccagctggcccagatgatctggacgaagcatgatagtcgcttccgtcaaaccagtgtgttttacaatgtcaagtttctgcactacaaattcggtcatctccttggcaaattgccgtacatgtacgactggttgagccggagccgaaggtgttgttccttgcgtttgtaccgaaagctgtcccgcagtcgtgatcactggagtctgattgtcagttgctgtcgaatccgctcgctcagttgcatctacgaatgcactcgcttcatccgttacagtcgtcttaactgcagactgaacgagaatattagttgatgaacgttgcccttctgaaccttgttgattagtttcgccctgaattgcttgctgctgagaagcaacaacctgtttgtctgtagtcgctgtagctacggtctgagtaccatttgctcgatttgcagaaggctgaactgcttgtgaatccccaccatcagcaagttccacagctttcattacaccattccactgctcatcggaaatagctcccgtacctgccgttgcactttggagcgattgtagtaattgtgccacctgggacttttggtctccagaagcctgctctgctacattggcaagttgtgacaaagcgtcctgtaatgcaaatcgaagagtagccgggttggctgccaaagctgttaagcctgtcgcctctgtcgtttctccaccgtttaactgttgatttgttccgtcgccttgtaaaaactgttgtacttgctgaatccacgcttgcagagttgcaagcagagcaggatcagcagctacttgatcatccagcttttcaagattttgcagcaaaggagccagtgtttcggccagcggctcggttggagcttccgtggattctccagttgcaataagcggaagtaccataactaatggagaaccgttcgcatctgtgcctgctgagcccgtttgcccgcctgtcatcatttgggtaagtgtttgattaaaagcacccgtggttgctccagcagctgccgctgtagtcgttgttgaggccgtagtactgctagctgtctgactggtgccgagcgatacactttgagaaataagggtcatttatttttcacctcccttcatttaaattacttactgcccatcagtttgttcaaaatttttgcggtctgagcagcatccttggcagacatattttgtagtaaagaaccacgtgtcgaatcatctactgtatttaatatgtttaatgccttgtctggactgattttgtaagtttgtaaaataagttcggcaccactcttcttgtccatggaagcaaatgtgctactgatttgagtgctttgcaaactcttactcgttgttccagctgtggtaccttgatcctttttcagacgagactgcaacgcagcaactgacaaatccgtagatggcgttacgtttttcagagccatagtaatatcggctgcttttttagcgtccatcttttgcaaaatctttgcactgttggcagggtccatgtagcttaacagctgcacagtctcttccgtggtcagattctccataatcggtgccgctttactagctgtcatcccttcatacatgctagcaagatctctggcctgttttacataaggatcttcatttgttgttccacctgtagtttgcgtaccggcctgtcccggctgactcgcctgtgactgctgttcctgttgcgtttgcagcgtattgacctgattctgcagttcagtaacctttttatcttgtgtcgtcttagcagcggtagcctttttaagctcctccgtctgcttggctaaatctgcctttaactgctcaatagttgcttcagaactttcagactgagccttctgatctgcctctttcgtctgagtagccttatctttcggttcaggtatccaatttttaacaactggtattttgttccctaatgaaatcatttcgcttctgaagtccatattgaacaatgtaagcaggaccccgaccagaacgattgtgaacacaatcggaatcaggaaaaacataaaccgttcaaatcccccgcctgattcttttcctaaatccatatccagttcattttctgctaacttctgtgccatcgtcttcctcctcaggcagctgatatgcgtatcctatgactttccgcttaccgggctttcatggcaaatcgcacggaagccatttcatccagctcgttctgctcgcgcaggagcatttcctgttggaatttcacgttggccttctctctcgctttcagccaaacctgttcatccagcattttatcggtcaaaacggtttgtttgctttgcacattttgctgcgcatattgaacatccctatgcttgcgtgtaatacattggtccagatgattaacataagcctgtaattcctgaatggtagagagtggcgcgcaatcctcggcagccttttgaatggctgatatgacccgattcctttcgcctacaagctgtgttaatgtctgctcctcagcctgcaattgtccgacagcactggaaagcaaccattcggcctgtgacttttcgttggttttcaagtctacaactttctgaaaggaatactgaaatctcatcgttcaaccttcatctcctcgtaaattcagaaatcaaacgctcccttacctcgtccagctcagccttttcatctgttctttgtcttgtaaaatcccatatatcccgtatgcgctccatggattcgtcaatttctgcatttgaaccctgctgataggccccgatattaatcaggtcctccgaatctttgtaaatggccatcaagcgcttaatgttctcggcagcgtctatctgatctcgtggtgcgatatccttcataacccggctaatactcgctaacacatcaattgcgggaaaatgtcctttgttcgcaatcccacgattcaagacaatatgtccatccaaaatcccgcgcaccgcatccgcgatgggctcattcatgtcgtccccatcgaccagcaccgtataaaaggcggttatggagccagtaggacctgtccctgcacgttccagaagcttaggtagactagcaaacacggaaggagtataccctctcattgctggtggttcccctacggctaggccgacttcacgttgggccatcgcataccgggtaactgaatccatcatcagcatgacattcaatccgcgatcccgaaaatattccgcgatggtcgttgcaataagtgcacccttaatacggattaacgcaggttggtcggaagttgccacaatgaccacggaacgttctagtccctccggacctaaatcgcgttcaataaagtccagcacttcacgtccacgttccccgatcaaggcaattacattcacatcggcttccgtattacgagcaatcattcccatcaaggtacttttacctacacccgaacctgcaaaaataccaacccgttgtcctttaccgatagtaagcaacccgtcgatagcgcgcaccccgatactgattggttcctgcacacgcggacgattcagcggattggacggaatattgaaggttgaatatctcgccattcgcgaggggatcaatgagccatccagaggctgacccaagccgtccagcactttgcctaacagctctgacccgacctgcacattcaacggcttccctgttcctacaacatcacaaccgggaccaatggactgcagttctccaagtggcatcagaagcactttattgtccctgaagcctacaacctctgcttgcaacggctttgccgttttacccggataaatgtaacaaacatccccgatactggcgtctggaccttccgattcaaccatcaggccgataacctgcgtaaccttgccatttacccggaccgggtccaactggcgcaaatgatccatgtagcgctgcgtattaagccccttcatgtcttcgctcctcattctcatgtgccagacgcagtagttcctttttgatctcagctaattgcgtatcaatccgcgcatccacgctcccaaaagaagaacggataacacaaccgcgatctttcacggtaccatcaggaataatttgcagttctgcctgcgaatcgacagttaatgacaattcttctcgtgcaccttgcacaaatgcgaaatgctgaggcgacacacacaatgtaatggttcctttttcccgcttacgagccaaatttttacgaattaattcaatcgtgtagtccggttcaaggctaagctgtttctcaatgaccttctcagcaatagcactactcagttcgaccaggaaaggctccgcttcctgaattagttgttccttaatctcataggcctgacgcagaatatcctgtgcttcttccatcatctgctccgatttcgtttggagctcggcctcagccagcttttggccttcttcatatccttgctgaaacccatcagcttttaacgactgagtcaactgatcgtcatgctcgcgtcgttcctgccaccaggcttcaatctgctgctgtgcctcctgaagcatccgttccgcttcttcagctgcctcgcgaacctgacgttcagcaaaatccttggcatcattcagcatttcatcgcgcagccgttcagcctcgtgatctcgctgaggctccggctccgtatattcagttgtgatttcttcatccgtcgtttctggcgcatacgtatgtgccacatcaattgttttcaaagcctctacaggaacatattggaaagatttaatcaagttagacaatgatgtcatctcctccgccgcgtgcgattataatctcaccagcctcttccaatctgcggatcgtcgatacgatacgtgtctgtgcttcttccacatcacgcaaccgcaccggtcccatgtactccatttcctctttgaatgtttctgccatacgtttcgacatatttcggaaaatcacatcgcgtacttcttcactggacactttaagcgccaattgcaaatctgcattgtcgatatcgcggataatgcgctgaatggaacggttgtccacattgacgatatcctcgaacacgaacattcttttcttgatctcctcagccagttctggatcttgaatttcaagcgagtcgagaatcgtacgttcggttccgcggtctacgccattcaaaatctgaacaatggactcgataccacctgcattcgtataatcctgcgtcgcggttgcagacagcttttgctccaacactcgttccacctgggaaataacttccggagatgtactgtccataacagcgacacgccgggccacatctgcctgtttttcctgtggcagagacgacagaattgtagccgcctgctcaaattgcaagtacgaaagcacgagagcaatcgtttgcggattctcattctgtataaaattcaatatctggtttggatcagccttgcgggcaaaatcgaagggtcttacctgtaacgtcgctgttagacggttaatgacctcaactgctttttgcgatccgagtgctttctccaatatttctttagcgtaattaataccgccttgggaaatgtactcctgagccaaacaaatttgatgaaactcggccatgatagagtccttctcaatggcatcgaccttccgcacattggcaatttccaatgtaagttgctcgatctcctcatcacgcaaatgcttgaatatttgagcagatacctctggtcccattgtgatcagaagtatagctgctttctgtcttcccgttaaaccttgactgcttgcctttgccaatgaactcacctctattcgtcagccagccatgtacgaagcagattgacgaattcgtcgggtttctttttcgccagactttcaagctgtttacgcacttgactttcatttgtcacactttccatggtaatagacgggaactccgtcggcgttggcatgagttgcaattcttcatccaactcttcttcctgcttacgacgaccgcgtacgatgaggaagattacacccgccagcagtgccagaacagcagctccgatgccccatagccaagggttggaagctgagaagaatgtattcgtgctcgcaggtgctggaacagcttgtgaaaacactgaaaccttcttagccaaatcagcgtctgtaatagtagtaccagaattcgccaacgatgctcttacaatattaaccaaaatgttttgaattgctgtctgagttgcagtatccaacgtttgctgacctgttggtggttcaactgcaacattaatggttaaatcttttacagtgtacggactttggataatatcccttgcaattcggttaacttcgtagttaatcgtacttgagctcttatctgagctggtattgccggaattagctcctcccgggtagcccggaacatcctgtgttcctgttcctgcaactcctccggtttgtccactactgcccgtatagctttcctgaatttgttgggcgctaatttcaatacccttcattttcgtttgatcaacaggcgtgaccatttgttcttttgatgttactttgtcgaaatttagctgggacataaccagcacgttcaccttgtcgtctccaacaattttcgacaaaaattgttggacattattccttacatcgctctcaaacttcttctgtagagccatgttttcctgaacaccactagtgagtccaccttggccgcccttggccgttggaatcaactcatattccttattggtgatcgtaatgttttccactggcagattcggcacggccgtttttaccagattaaagtatccatcgatcgcttgctgatttggagtaaagccgggctcgaattccatttgaatcgaagcggaggctttgtccttttcttcaagtccggcaaaaatgttttcctttggcatattaatgacagctttggagctttggacaccatccatccgttccaacaattgctgtatttcgccgttcaatgcattattgtacttcacattgaactcgttctccgtcataccaatcgcagaggaggattggtcaaaagcgctcatgccgattgaacccttctgaatcaggccttgagacccaacatctaccttcgccttatccgcattagcagttgggactgagatttgtgtcccaccagcattaagttggtacggtatacccgcagaatcgagatatttaatgactccagcagcatcgttagcatttaaatctcggaaagccacttcatactcggttttggtaaactgcatcgttagcactacaacggcgataatgatgaatgctaatgtcgaaacaagtaatatcttctgttttttgctgaaattattccaatacccggaaatcttatcccgatattgggcgattctctcgttcactccgtcaccccatccgaaactttgctaaaccctctttacatctgtgtacgcatgatctcctgataggcttcgatcgctttgtttcggacctgtgtagtaagctgcagggaaagcagcgcttgttgggaagtgatcatgacctgatctacatcaactttgcctgccatgaattggtcggacatctggtgcgtagcggcttcctgctgccctacttcattgagagcatcctttaggaaggaaccaaaatccttcaaggattcggaaggcgtcgctttcgtcaactcattgttaggcgattgaatctgctgtattgccggtgtctgtacattaaacatggcgttctgaatcatgttttactctccctattaagtagttagtagtcctagaacttagcgaccgatttcaagcgctttggaaaccatagcctttgatgcattcagagctgttacattggcttcgtatgagcgtgttgcggaaatcatgtcgaccatttctttcataatgtctacattaggcatatatacatagccatctttatcagcgtccgggtgacccggattgtacacaggctttaaaggtgactgatcttcctgaatttgcgaaaccttaacgccagcagcgcttgtgctacttccttccatttgagccttcaaaacatcggcaaagccagattggttcggctccaaaacaaccgtttttctccgatatggaactgcttgtccattctctactttcgcccgagttgtctctgcgttggcaatgttgctagatataacgtccatccgcaaccgttgggccgtaagagcagatgcactaatatcaaagccgttgttaatcttcacctagtcctatctcccttctaccgctgttctcatcatcttgatgcgctcattaatttcttggatgtaggtattatatcttagttgattttcagccataagactcatttctctgtcgatatctacgttgttcatattgttattcatgactgagtgcccatctttggtgaccgtggcatctggaatggagttcataggtcctatttgaaaatgtcttgaattggttacttttccacgtagtggtgtgacttccccgtccatttgctgctgaagcagttcttcaaatgaaacctccgaacgcttaaaatacggggtatccgcattggaaatattgtcagccatcacacgttgtctcgtatttgccgcctgtacacctgcctgaagcttttgaaagctcatatcacccagcagattcatttagctcctccctcccagcgtctactccaaagtaagattcaataaaacaagatttttcactttttttcgacaataaaatttcataattacacatttcttttaggtcttaagtagaaaataataactttctgtcatatattctaagtttcgtagagttgggacctaattacaataagaaaaaagccctatcttttttaaaaaagagggctttagatgcataaaatgttaaatttttcaggtttatttcaagaaaatgaatgttttcttagcactttacacctgtaaaagattatacgtcctacttttggaatagacagaaaaatcatcaacttgaccattatctaggtctaaacgacggtgcaagatagtgttattctggacctcacaccctatttttagaaaccctattcataaaatatactgactaaggtccctgttttgggcaatatctcccagcttctcacgtacatattccggagtaatgatcatacgatccaatgtaagctctggtgcttcaaacgacagatcctccagcagcttttctagaatggtatgcaaacgacgtgcaccaatattttcggtgttgcgatttacagactcagcaatgctggcaatctcacggatcgcttccgcagaaaattcgacttcaatctcctcagtacggagtagatcagtgtattgcttggtcagcgcatttttaggctccgtcagtatcgacacaaactcatccaaagtcaggctacttaattccacacggattggaaaacggccctgaagctcagggatcaggtcagatggttttgcaacatgaaaagctcctgccgcaataaacagaatgtaatctgttcttaccggaccgtatttggtcatgatggtagatccttcgacaataggtaaaatgtcgcgctggacgccttctctcgacacatcggggccgctacccttaccctggctggcaatcttatctatttcatcaataaaaataataccggattgctcagcacgcttcacagactcctgaatcacatcatccatatcgatcaatttggcggcctcatcttgaatcaacaccttgcgagcttccttgactggtagcttgcgctttttcgtccgcttgggcagaaaacttccgaacatctcctgcatattcatacccatttgttcattcccttgcccagcaaacatatcgagcatattgggggcagtatcctccacatcaatctctatgacatcatcctcaagcttaccagacaatagatcgaatttaaccttacggcgcttttctgccaaagatccatcctgttgtggtggttcttcttctactgaagttcccgtgttattgccaaacagcatttcaaagggattacgttgcgatttgtttgacttttctgcaggtacaaggatgctgacaatccgttcatttgccatgtcttccgctttgtccttcacattctctgttcgttccgttttaacgatgcgaatagaggtttccatcagatcacgcaccatggattccacatcacgaccgacgtaacccacttctgtaaatttggtcgcctctaccttgacaaaaggagctcccacgagccgtgcaagtctacgtgcaatttcagttttacccacacctgtcggtccgatcatcaaaatatttttaggcacaatttcatcccggatatcatccggcagcttactacgccgataacggttgcgcaaggcaacagcaacagattttttagcttccttttgtccgacaatatacttatccagctcggataccacttgtctgggcgtcaacgattgattattcattttgcactcctccacccttgaatactcagagccgatttacagttcttccacgataatctgattgtttgtatacacacatatttccgaagcaacctctagcgcttcccgtgccatgtcctttgcttccatgccagacccatggcgtttgaaagcacgggcagccgccaatgcaaaattaccacctgagccaatcgcaagcacatcatcatccggctctataatttcgccgcctccagaaatgagcaacattccggatgagtccatcacaatcatgagcgcttccagcttgcgcaggatacgatcctgacgccagtccttggcaagttccacggctgctctttgaagatttccgtggtgttcctccagcttattttcaaacttttcaaataacgtgatagcatcggccactgaacccgcaaatcctgcaacgacctgacctcgatacaatctgcgcacttttttagccgtctgcttcatgacaacactgttgccgaacgttacctgtccatcacccgcaatagctcctttgccattgtggcgtacagcgcagatggtggtagcatgaaaggacatatccataacgcgctcctccttttccttcatccttatgcctgtacttcagctgacataactcccgtttcgttgatataaccccgcaaactttccaacgcgcgattagcgagagcttcatttttttcctttttgttacgaatccgtttctccaactttggaagcaaaccaaagtttgcattcatcggttgaaaatgcttaaaatcagcggtggtaatataccgtgccatgctacctaatgtcgtttccgcaggaaatacaaacatttcctgcccacgcgctgctcgtgccgcattcatcccggccagcagaccagaagccgctgactccacatatccctctacaccggtcatttgtccggcgaagaatagattacttcttcccttaaactgataagttggatgaagttgctgcggagaattaataaaggtattgcgatgcatcacaccgtaacgtacaaactctgcctcttcaagacccggaatcattgaaaatacacgcttttgttccccccatttgaggtgagtctggaaaccaaccagattatacagcgttcctgcggcgttgtcctggcgaagctgaacaactgcgtgggggagttcacctgtatgtggatttacgagacccacgggtttcatcggtccgaacaatgccgtttgtttcccacgttgcatcatcacttcgatgggcatacagccttcgaaataaatttctttttcgaattccttgacttgcgctacctcagccgtaaccagagcctcataaaaagcatcaaattccgcttcgttcatcggacaattcaagtacgctgcttctcccttatcataacgggaagccagataaaccttgttcatgtcgatagagtccttttctacaatcggggctgccgcatcgtaaaaatagaaatactcctctcccatcagtgatttaatctgttccgacaaagccggagaagttaaaggccccgtcgcaatgaccacaataccgtcctgtgggatttcctgaagctcttcattaacaacctcgatcaaaggatgttgatgaagcgtctcagtaatatgaccggaaaatccgtcacggtccactgccaatgcaccgccagccggaacagcatgacgatctgctgcactaagaatcaaggagtttagtattctcatctcttccttcagtacgcctactgcattcgttaggccgtttgctcgcaaggaattactgcataccaattcggcaaatttatctgtatgatgtgctggtgtttttacgaccggccgcatttcatataacttgactggcactccacggcttgcaatttgccaggcagcttcgctgcccgccaaacctgctccgatgaccgttaccttttgtagttcactcacgtttaaatccccctgctattgttgttcttaagaagtctctacgctctcatcgctctcttccagcatttcgctgtgatcgcagaccgtacagttgagcttcgtcccttgttttgtacgtttttcgaccattaggctactgcaacttgggcaaggcttaatggacggtttatcccaggaaacaaaatcacattccgggtagcggtcacatccatagaagatacgtccctttttactccgtcgttcaacgacatggccctcaccgcatgaaggacaattaatcccgatatccttaacaattggctttgtgttacggcaatctggaaaagcagaacaggccaggaatttaccaaatcggccaagcttatacaccatttggctgccacacttatcacaaatgacatcggatacttcatcttttatttcaatttctttcatttcttcttcagccacttcaagtcgcttctcgaatgactcgtaaaagtcactcaacaccttgacccaattaccttcgccttcttcgacgtggtcaagatcaccttccatattagctgtaaactccacattcagtatctctggaaagaactcctccatctgttcgatgaccaattcgcccagctctgtagggaaaaatttcttttcttcaatagcaacgtacccacgtttctgaatggtttccagcgttggtgcatacgtacttggacgtcctatacccagttcttccagcgtcttcaccagtcgcgcttccgtataacggggaggcggttgtgtaaaatgctgcttcggctcaaccgcttctttttttaatttatcgcctggttgaagtggtggcagcagtttatcttcttcggttttaccgtcgtcatttccctctacatacactttcatgaaacctggaaaacgaaccttagaacctgctgcccggaatatcgtctcacccgcttcaatatctacggacaaagtatccataatagcagatgccatctggctggccatgaaacgttcccatatcaatttgtacaaacggaactgatcccgactcataaacggcttaactgtttccggatcgcgtaacgcagaggttgggcgaatcgcttcatgcgcatcctgggcgttggccgctttttttgaatattgacgaggagtttcaggtacaaaagcttcgccatatttttgaataattaattctttcgcttcctcttgagctgaagcggcgatccgtgtggaatccgtacgcatatacgtaatcagacccacggtcccttcttttcctaaatccacaccctcatatagctgctgagctacagacatcgttttagatgcacggaagttgagcttccgagccgcctcctgctgcaaggaacttgttgtgaatggaggagaaggattgcgtaaacgctctttctctttcacttcgcgcaccttgtaagacgattttccgatagcttccaacacttcttgtacatccgcttcgctggagagctctttcttttcaccgcgcagcttatgaaatttcgcttcaaaggtgctgtctttaatagctagtttagctgtaatcgtccagtattcttccggtacaaactcactaatttcgttttcccggtccaaaataattttcaccgcaaccgactgcacccgcccagcggatagacccttttttacctttttccagagcaacgggctgattttgtagccaacaagtcgatccagtatccgtcgtgcctgctgagcattgaccaaatccatattgattttacggggtgttttaaaagcatctttgacagcctgcttcgtaatttcattaaatacaacacggcaatctgctgtatcgtccagttccagcgcatgtgccagatgccaggcaatagcctcaccttcgcgatccgggtcagccgccagatatactttttttactttttttcgggcatcctttaattcttttagaattgagcctttacctcgaatggtaatgtatttgggattaaaatcattttcgacctctacgccgatctgactcttcggtaaatccctgatatgacccatggaagccttgacgatatatttgctgcctaagtatttgccgatcgtcttcgccttggaaggcgattccacgatgacgagtgaatccgccataggctcttcctcctctcaattacacacatgaatatgatagacttcctgaaatgtggtgagttatgacgcggagagcgcttcacagattggtcatttttccagatcgctgtacttgctcagaaagattccatctgctccgctgctgcgagtcataatgtcaacacatttcaggaagtggggaaggagtaggagtccgcgacgcggatgaatgccatactgccctccacctgatgtttaaaattgaatttgtgcatttactaactaaggactttgcaaaaacaactactaaataagcttgtattttgtgcccgctagctgggcgatccttttttttatgattaacgataacagaactgcgtgtaaaagtccaaaatcccatgccgtagcatcaagcagttcatccagtgtcatggttccctgttcgagcaacagtatgacacggttttcctcagaagtctcactttctggcactttggagacctgcttcagattaagactctgctctctattgtatgaagaaacctcccttgtacgcaaatctgcttcatactcctcaataatatccgaagcttcagtgactgttttagctccttgcttaatcaagctcagcgtgcctctactcttcggtgacgtaatgggtccgggaacagcaaacacatctcgatttgcctctaacgcagcatcagctgtaatcaaggagccgcttcttgcatctgcttcgacgacgagcgttcccttcgttaggccagctataatccgattacgttgtggaaacattcccggatgtgacctcgtgcctggaggatactccgatacgatcaatcctttgctagccatctctgcaaataaagacgcattttggggaggataaatttgatcaatcgctgttcccagtacaccaatcgtgtttcctccccggcgcagggctgtttcgtgacaaatactgtcaattcctctcgccaatccgctaactactgtaatccctgcataacataatccctctgttagtatctccgctgctctacgtccataagcggtgggaacgcgagttcctaccatggctacagaacatgtatgcaaaagtgatttatccccttttgtatacattacccaaggtgggtcaactgtttccttcattaataggggataatcctcgtccacataagttaccgtcccaatatcaccggatagaactcgctgatatcgctcatgcacccattcttcatcgtaacactgagccgcaattcgtgcctgagcagggcttaaccctatctccatccacttttgttcgctaaaatgcagtagctcatgcaatcgatagtcactcgaccaaatacgctgaattgtttttcttccgattccctctaactcatgcaagcctaacaaaagccatctttcttccaaactatggttcccccattcacggaagagtgaaccctcccttattttgtggcacaatgaatcattttgcaagcgtttccctgacaagcctgtcttaacgcaaaaaaagcaaccttttcatcccctgtttcagaagataaaaaggttgcttacctttctttcattatacactagcctgcggcaaatttcgatgcagttttatggcctgtatattaatgaagaaacacgatttaatgtgtcgtacacaaagtcaaaataccacgtgcttccagcacacttaccagtgtcgagcccatttcggaaggagtcggtgccaccttaatcccacaggcttcaagcgtggcaattttctctttggccgttccttttccaccagaaataatggcgcctgcatgccccatccgtttgcccggaggcgcggtcacaccgccgataaaaccaactactggcttcgtcatattgtccctgatccactcagcagcctcttcctcggctgtacccccaatttctccgatcataatgacagcgtgagtgttggggtcctcattgaaacgttgcaaaatgtcaatgaattctgaacctttaacggggtcaccgccaataccaaccgcggaagattgtcctatacctcgggtcgttaactgatgcactgcttcataggtcaaagtaccactacgtgacacaacacctacatgacctggtagatgaatgtaacctggcataataccgattttacattctcctggcgtaataacgcctgggcagttagggccaatcagaacggtctttttaccttccataaaacgtttgaccctgatcatatcaagcaccggaatgccctccgtgatacaaatcacgagatctagttccgcatctacagcctccaaaatggaatctgctgcaaaagccggtggcacgtaaatcacgctcgctgttgcgccagtagcttccttggcttcgcttacggtgttaaacactggcaatttgacctgttgtccgttctccagcgtaatttctacctcggtgccccccttacctggagaggtgccacctaccatttgtgtaccataatcaagtgcacccttggcatgaaacaacgccgtttttcccgtaatcccctgtgtaatcacctttgtatgcttatcgaccaaaatactcacgatcttcacatcccctatcgtttattcggcatatcggaatgcaaacaggctattgaacaagttcgacgattttttgggcgccatccgccatggaatccgctgctacgatattcaaaccggattccgctaaaatctgtttgccgagctcaacatttgtcccttcaagacggacaacaagcggacgagtcagccccaactgtttggcagcctccacgacgccgttcgcaatgatgtcacactgcataattccgccgaaaatgttcacgaaaataccttctaccttcggatcggacaaaatgattttgaacgcttcggttaccttttccgtcgtcgcaccgccccctacgtccaggaagttggccggatcgccaccgtaatatttgataatatccatggttgccatcgccaagcccgcaccattgaccatacagccaatatttccgtccagagcgatatagcttagatcatatttagatgcctcaatttccttctcgtcctcttcatccaaatcacgcaattccaaaatatccttgtgacggaacaacgcattagaatcaaaattcagtttggcatccaacgccagtacattcccatcacccgtaacgactaagggattgatttctgcaatcgaacagtccttgtccacaaaagcttcgtatagcgccagcataaacttgaccgctttgtttaccagttcatttggaatattaatgtcatacgccaacttacgggcctgatacacctgaagcccaatcgctggatcaacaaccgctttaaaaatcttctccggagtggctgcagccacctcttcgatttccgtaccaccttcttctgaggccatcattacgatacgtccagtcgcacgatctacgacaacgccgacgtaatattctttacgaatatcgcagccttcctcaaccaaaaggcgtttgacctctttaccttcaggtccagtctgatgcgtcaccagcaccttacccaaaatttcagaagcaaaagtccgcacctcatccaaacctttggcaactttcacgccacccgctttaccgcgtccaccagcatgaatttgtgctttcaccaccgtaacagcgcttccaagcgattctgccgccgcaacggcttcctccaccgtataggcaaccttaccgttcggtacagccactccgtactgcttcaatacttctttaccctgatattcatggatattcattctggaatcctcctatcaacatgactgcaacaagggcggttcacaaggaaatctatactaaacctacatcattgtaacatgtttttaaaacgctttccttataatttagcctcatgaattacagtattttgatatcattatcattcccaaaatcgaatgtttggatattattggatatttctcttaatacaaattcacacaaaaaaagcacctctacaacatgggattacctaatccacattaagaggcactttaattcttcaagcattattaggtattttttctttcagctgagaacactcatgccataagattcgcaagagcaactgaaaacaccttatgatttttcaatttgcacattagcttgatgaacacgatcgagcagatcattgaactggagcagaagcgacccaaattgatcatgagtcatacttgttttttcctggatgcatcctggtacggacagagctttttcccgtaatgcgcttccctctgtcgtcaaagaaatcagcaccttacgctcatcctgagtggaacgctttcgatcgataagcccggcgttctgcaatctcttcaatagcggagttagtgtgccggagtccaaatatagtgcctcacccaattccttcactgtacactcttcacgctcccagagcacgataagtaccaaatattgcgagtacgtcacaccgagcttttccagataaggctggtatagcttcgtaatctctctggagcatgcatatatggcaaagcataactgattatcaagtttcaacgctgtaccttcattaggattgtcttccatgctgtctgatcacctactttcgtcattattttagcacattatataataaaatacatgctaattgcacaaaatactttacaaacaataattattttgataaattaaattgtgtgaaatataatttgagcgagaggcagtgattggattatgatgaccattcaacaaaaaatgtatgaaacaacagtaaaagcggttggtggacgtaacggttatatcgagtcttcttcccctgaactccgtttagatatcgataccccaaaagaaatgggcggcgcaggcggtgcaggtacgaatccagagcaattgttcgcagcaggctattccgcttgctttgacagtgccttaaatatggttgctcgcatgcaacgtattaagcatgaaggtactgaagtaacagctacggtccatttcggcaaagtggaagacggcggcttcggaatcggagtaagtctcgacgtactggtaaaaggcgtcgatcatgaaactgcagtaaaactggtggaaggcgcacatgaacaatgtccatactcccgcgctacccgcggtaatattgaagtgaaactgaacgttttgtaacttagattttctttagcacatgtaggggacgtcttcatctctcttcatggattcaatagtttcgttagaatgaatttcacaacaagcccctcaaccgtttttgtcgaggggctattatcctttcagctatcccttcgttaaagactgtttgttttttttccatcaagtaacatgggagatgatgtataaacgtatatacaaaattgatatactcatagtataatcactattgtcataatcttatttttcttctccagatctttattgtctggagctttttttgtcctttttccattttctattgtacatacgctttggaaaactctttcataaaaatgatcgtgttatagctactattttatcgcctttttaactttcgggaaaactggcatttgctctatccatatggcggtattgaatagcttcagccacatgtgaagtcaaaattttctctgagtcatgtaagtctgcaatggtacgcgaaagcttgagaattcgatcatacgcgcgcatgcttaaaccgagtgcgtccattgtctggtcaagcaactctgctgcatttttttctaatacggcatatttacgcagcatttgaccagacagctcactattccatgaaaagggaagcttgctgtatctgtggatttgtatcgcttgagcagccagcacctgccttcgcatttcagcggacgacaatgattctttttcctcccgccaatccttcggctgcgatacttcaagctgaagatcaatccgatccagcagtggaccagaaatacgtgaacggtagcgggctactgctgcaggtgaacaggtacagcgctgatgttccgtgtcattaccgaaaaaaccacagtgacatggatttaaggaggcggcaagtaaaaaatgcgctggatacttaaaaactgcacgtgaacgactgatcgtaacattgtgatcttccaaaggctggcgcagcacctctagcacatgacggctaaattcaggcaactcatccagaaataaaatcccccgatgtgcaagactgatttctcctggtttgggtatacctcccccgcccaccaaaccagcagcagagatcgtatgatgaggcgaacggaagggacgaatattcatcagatgaggcgatgactccttccacttcccggcagcgctgtatactttggtaacttcaagcgcctccttttcagtcaaaggcggaaggatagatggcaatctgcggatgagcatcgtttttccagcccccggcggtcccataagcaagatattatgcattccggctgcagcgataactaacgcacgtttggcgtgcagctggcccagtacatcgctgtaatcctccatattgctagttatctctttttcctcacacagcgggatatgctctgcttgaggtaaatgggcataggactggatcatgacctgtttactagcagtacaattctgatttgtcgcttggctatcaacagtcccctgtgcatgatcttcaatcgggataagatctgctagatgacgtatagcgtaaatacgtatacccgtgatcagacgagcctcgttggcgttttccttggggagcagcacggaatggaatccttctcgcttggccaaatcaaccatggacagcaccccattcacaggacgaatgctgccatccagcgccagctcgccaataaacagcgtccgttctcccactggtaaaacgacctgttcactggttgtcagcaaccctaaagcgatagcaaggtcaaaagatgaaccttccttacgcaaatcagcaggagctaaattaatcgtgacacgctgggacggatatttaaagccgcagtttttgattgctgctctgacacgctccactgcctctcgaatcgccgaatccggcaatcctataatcgctgtctgaggcaagccattggacaaatcagtctcaacttcaatcagaacaccatctattccatacaaacaagctccgtgtaattttccatacatatcaaaaagcacctctcctcatattggaatgctccctctcgggaatcattgcatatatgaaaaaaggtgcttccaaattttcattctttgcaaatgtgatgttcgaaattttagcttcggaccatgctttcaaaattcttgactaagtttatctgacgacagattatttgtcaaacaaggtcagcttatcggctgccggagtacgtggtcttgattccgggataacgtcaggatagcctgcatatatcattcctattaccttctcacccggttgaattcccaagtgctcacggaacttaggcgaatacaaaaatggctttgtcacccaaaacgttccgattcctttgctccatgcggcaagcataaagttttgtacaagcgcgctgaccgctgcaaaatcctcatcccaaaccgcttgacgcgggtcttcttccaatactactaaaagctggatcgggttgtgcaaaataccgctctcaaacttgttgtccttaccaatatcggctgcaattgcttttgcaagctttttccgtccttcaccagcaaacaacagaaaacgccacggttcacgcattttatgattaggagcccacacagcgacgtccagcagttctttgatcgtatctaccggaatggagtcggatttaaatcgtttaatcgtccggcgttcctgaattacatctatgacatgttcactaaaggtatgctttgtcacgtaaatcctccttcacaggtacaacttctagatattcattttaagatgaaaatgataactattctcaataaaatatacctgtagctttcattcctgtcaacctgcacatatgaattcagtcccgcactcttacctttgaataagctcttactcgtttaaaatgcgcctattaaatggtccgtaacaactgccttttcgtcagttaattgtacagaaatcatgtcaaagcggattggagcttctccaatcccgttcatgtgcaaatatacagcggctgtttggcgaacttgggctattttacgcgcagtaactgattctgctggcgttccatacttggagctacttcgactacgtacctcaataaacacgagtgtatgctcctgcttggcaatcagatctatttcaccactgcggcatcgccaattacgctctatgatacggtaacccaagttttctaaaaacaaagccgctgcctcttcgcccatcgctcctttggctttccgttgatccttgcctccagccttcatttcattcgacatcaccagtcatcccttgatgcaagcctatccatttgatatatataggtaagcacctctgccaccaactgatagagctcagcaggaatttgttcgtccaaatcgagtttggatagtacttcaaccagcgcggcatcctcctgtactggaacaccatgttctttagctttttctaaaatgctatccgcaatacggccgctccctttggcaacgacaatcggtgcttcgctctcaccaggcgtatatttaagggcgaccgccttctttatggaaggagaaggaggttccaacggctctttcatattttaagatcgactcctttatacggctgaggcacatagctttgtacttcagaagaggcgagactgttctgttcagtccttatgggcataggctcggtacgaagcgatagaagttggtatcctagtgactccaacgctgtgtgaatggactcacgcccactggataacaacgaagccgcccattcatgatcattatggagcttaacacttacaatccgatctacaacctggacatctaccagggtcgctccaagtcccttcatgtccaaatcaaaccaaagacgacagttggaggcgtccagctctccacgtttgccgcggcgggactgaatctggatcgtagctgtttcacgaccatccggtccaacgaacggtataaacatgtgtacttgggcaaaaggcgccgttcggtctgtgttgagcagcaactgctgacctgtcaggtgctgtacaacctgctgagccgcctctttcaaagcaggcggcagatcgtcactgctcatcagctggagcagcgccccttttacggtggctgcgtctgctgacaccgtgtccccagacgcagccgctaatcccggcagcggctgcggcgttccctctggcggctccatacgtgccgccgccccttgcgcgacctgtgtagtcgcgcggtgtacttgctgctcgtgctctgcaccgagcagcttcagtacgcggcccacccacgggtcctccgtggggctgagctgcgggctggacgccgcaggctgcgatgcagcggcgtctgcggcccgcgaggcgctagccattggctgcgccacttccgttgcgggctgctccggcgcagccgtgctcagtgggggcggcaccgccgcgcgtagctcttgcagcaacgtgcgcagccgctggagcgtcacctctggcgcagcagtgttacctgctgtggattgcggcacaggggcaccagcctgctgtgccgtgggacggtcagccatggccgcggttaaggctgtctttgcccccacaggttctgccgtggcagccgctggagcgccatccgcatccttaagttgtgtgcttgacgcagtagcttgctgtgactgtgactgctccactctagtgcgagaaccctttaatgcatcagcacccgattcttgagcatttacgctagcttccgatgccactgtcgctccgcgtccattgactgtctccgcttctcctggagcagtccctttggctgcagatgtagcccccgttgcagtatctgaatctgttgccaaagcactcgcttcactcactgcagcagcaaggttggctgcttgagtcccttttaacaattctttgccgcctgtggtttgtccagcttctgcctgctttacagcggtagaagcatccttggacagtatgggagcttggccttcctgtccatctacaaccaccccggaagaagcacctgttggactagcagacattcgatcagcgctctttatagctgttgattcccccactgaacggtcagtgggtattccctgtcctggctgctttaataccgcttcaagctcttgctccagcgaagacaacagatcatttaaaggaggcccaaacatcgcttgacgcaatccgtttatgctttctgccgtcaatggaagtccccgctgaaaggcaactgccgccgcctgcacaaacgttcccaattgtacattgccgttttgcttcgccatagcttctcgcaaagacgcagcattttccgatgtcaacggcacaccgttcttttgcattgcctgtataagctccctgttctgagctgtatccggcagtcccaccgattccaatacatctgtcagcgctacggtttgctgtggtgtattagtcacatcgttcagaggcttaagcaccgtcattccgctgggggaagccggttgaacctgaaacgttgtagtctgtccaggttgaagaggggtctccagctttgccctgacctgagaaccttgtatttgcaacacagcctcgctgccgtcctcagacacctttagcacgactcctcgtacaacctgacctggctgcatatcaagttttttagcctctccagccttcacatctccaagtaatccacgaaatacagatccgatgttcatatcgcccctcctctcactctcccccattcaaaggggcttatggtattagttatgctttatatcggcattatcccgattcataataagtaactacagatcaaacagcgtcggttgctccgtcaacaaattgcccagaaagctgcgtctatgcatctttgtaggtcctagcgccaaaatttgttccctgtgtaacttggtagcgtaacctttatgtataccgatcccatattccggatacttcgcatcccattcacctttgcacagccgatcacgggttaccttggcgatgatagaggccgccgcaatagactgactgttggcatctcctttaataatagagagttgaggaatagacacatctaccttttctgcatccaccagtaaataatcaggagacacatgtaaagcctcaatagcctgcttcatagccaaacgggctgcttgcttaatattgatatcatcaattgtctgcgcgtctacatagccaactcctacagcaatggccttctccataattagctcgtagtatgcttctctcttcttgtccgtcaattttttggaatcatccacaccttccagtaactcacccactggtaaaatgactgctgcggccacaacatcaccaaacaggcatccacgacctacctcgtcaatacctgcaatccgctcacaagactgctcccagcattttttttcataatgtagcatgtccttcactacattctttttatcttccatattcaatacctgcccatctatatgtagtttaacgcgtcattcatgccgtagctctagcgattgaattcagcttaccacagaccttcatcgtccaaaacccttttctaactgccttcaaataccaaaaaaaccttcctcctctccggagagatggggaaggttcttccttgccacaaaatgctatgttctctatcggtgtaccagtagaatcagtaaggagcttccaaactgaaccgtcccagcttccctgcacgcagctcacgcaaaatgatttttgacgccttttcgagatccacacgtccgccgctaacaatacagccacgtttacgtccgatcgcttccatgacgttgacaatttcatcaggattttctgtatcttcaggacgttcggtgagctcaaagcgctctgccagtgcgtcccaatagtactgaaccaaatatttagtcgcaaaaaaggcaatatcctcgacattcagaatttcttccttgatcgcacctgtaactgccagacgatagcctacattctgatcctcaaatttaggccatagaatccctggtgtatccagcaattcaatttctccaatcttgatccactgctgtgccttcgttacccctggacggtcacccgtagctgcaatattacgtcccgccattcggttgatcagtgtcgatttgccgacattcggaataccaacaatcaacccacgcataggacgcggattcattcccttcctaatctgccgatctatcttttccttaagcagcagcttggcctgaattggaatttcttttagtcccgtcccagttgtggcatccaccggaatggccacatgcccctgctccttaaaataggcaatccattgctgtgatactaccgggtccgccaaatctgctttattcaaaataatcattcgcggcttgccttgcaaaatatcatcaatcattggatttcggctagagagcggcaatcgagcatcaatcagctcaatgaccaaatcaattaactttaattttgcttcaatttggcggcgcgctctggtcatatgaccaggaaaccattgaatcgtcaccgtcatcaccccattgatcgtaactcctacttttacccttaggctcttagttaggattacggcagctatgctgcttattagttattctagtggttaatccactgcatatctttcgccggccagaaaataacgtcagcccgacctacaacttccttcaaatcaatatatccaatcatccgactgtctgtactattggaacgattatctcccattacaaaaatatgccccgccggaacttttccatccttaaatttctcatttggaaaatttgtaaacttgttgtaaagttcaccattttggtgcgcttcttctaaaggagctttcaagtaagattcctgaatcggcttaccatttactgtaatcgtgtcaccttctaccttgaccgtatctccttcaacggcaatgacgcgtttgataaagtctcttccttcctccggcacatgaaacacgatcacttcccctggtttaggggcacggaaatcatacaaaatctcatttacaatgacgcgttctccggtatgaaagttaggctgcatcgacgggccatccacaataaacggcttaaagagaagccagcggattaaaaagacaagcactaacgcaataatgatggccttgagccactcaaaaatctcattttttggtttacgcttgggcgtaccatcctgttcagttggctgctgtacagctccttgtcctacttcttgctccatagctcactgtcctctctttacggtcaataatccacagttccctatgtacgtagaaaaaacgaaaggagcttgtaaccaagcccctttcgttattcgttgtattaacgacgaatttctttaattctcgctgctttaccgcgcagttcacgaagataataaagcttcgcacgacgcactttaccacggcgagccacgtcgattttatcgattttcggggaatgaagcgggaaagttctttccacacctacaccgtaagaaattttacgaactgtaaaagtctcactgattccaccaccacggcgtttaatgacaacaccttcaaacaactggatacgctcacgagttccctcaataactttcacgtgcactttcaaagtgtcaccaggacgaaagttaggcaaatctttacgcagttgttcttcagtgatcgcttggacgatattcatctatgactccctccttccgtacaggtgttcatgcttcttctggaaacacaaccgtttccttcatcatccacagaggaccaccgtattacacacaacagatgtattatatcatggaggataccgcattgcaacaacaaaaagggatttgaccaaacattatttaattgactccattataaaacaggtcactccctgctttcaaatccactcatgcctaagacgctttattgcttatcgcccaaacagtcagatttgcgctgctcctcaacccacacgcgctccttgcctgtcagttcaacctgttccaacaggtctggtcggcgttccatcgtgcgacgtaacgcctcttggcgtctccaagaatcaatattgacgtgatgccctgacaggagtacatcaggaactttccagccccgaaactccgcaggccgggtataatgggggtactccagcaacccggtactaaacgagtccgttaccgcactcgtttcgttccccagcactcctggtagcaaccgtgtcacactgtcaatgacggccatggctggaagctcaccaccagtcaacacatagtctccgatagaaagctcatccgtcaccaaatgctctcgaatacgctcatcataaccctcataatgcccacatataaaaataagatggtcctctttggccagctcttccgctttcttttgcgtaaaagtctcgccttgtggacacatcaaaatgatacgcggagattttatgtctgtgttacgttctatcccttcatgttgaataacttcgtcggcagtttctaatgttgattcctctgatttatccaacagcgcttccacggcagcaaaaatagggtcaggcttcaaaaccatgccgcccccaccgccatagggcgtatcatccacttgtccatgcttattgccggcatactgacgaaaattaaccgcttgcagtgatacaattcccttatcccttgcttttcccagaatgcttgcattaaatactccgtcaaacatctctggaaacagggtcagcacatctacccgcattacagcagaccttccattaaccgtaccgtaacccgtttttcgcgcacgtttacatccaaaataacatcctctatatacggcaatagcagttccttgcctttaggcattttgactacccatacatcattggctcccggagtcaaaatttctttgaccacgccgagctcatttccgtcttcggtcaccacttccatgccgactacttcatgaaaatagaattcattttcttccaattcgcctaaccgctcagcagataccttcaacaaagtacctttatatttttcaacttcattgatattgtgatattccttaaatttagcgacaaccatatttttttgaaaacgcgctgtttcaatagttacgggaatcggggctttaccttcagccgggacaatcaaaagttcactacctttagcaaagcgatcctctgggaaatctgtcgtcgttaatattttaagctccccacggattccatgggtgttcacaatttttccgacattaaacaattgttgcatcatgttcctcctgcttgttatcggtcccgctccatatcatcttcatcatgtacgaaaaagggttaggacatacatcctaacccactttcgtatatctttaagatatgatgtctacggtaacccgtttatccatcttaacggctgctgatgcaaccacagtgcgaagcgccttggcgatacgaccctgcttaccaatgattttgcctacatcctcaggatgcacactaagctcatatacaacaagccgatccttctccaaggtcttcacggtcacatcttccggatgatcgactaaagccttagcaatgattatcactaattcttccatggttgaccctccgtatcagcaccttatttctgtagtttagactcatgaaactttttcattacgcccgctttgctaagcaagttacggactgtgtcggatgcttgtgcaccatcttgcaaccatttcagcgctttatcttcatcaatttttacaaccgctggtactgtgattgggttgtagtaaccgatttcttcgataaaacgaccgtcacgcggggaacgagaatcagataccacgacgcgatagaaaggagctttatgtgcacccatacgtttcagacgaatacgaactgccacgaaaattcacctccttcaaaaagtagactgtatattgttatcccataattccaagggcctattggccttagcggaaaggaaacttcatacctttacccatactcttcaactgcttcatagccttgttttttccacccttaggtcccatcatatctgagaactgcttcatcatacgacgcatttcgtcaaattgctttatcagacgatttacctcagccagtgatgttccactgcctacagaaatacgtttgcgtcggctatgattaatcatgtctgggttttgcttttcctgtgtggtcatagaatgaacgatagcctcaatccggcccatctgtttgtcatccactttgatatctttcatttgcttcatgttgcccataccgggaatcatatcaagaatctggtcgattgggccaagcttcttaacttgatccatttgctccagaaaatcttcaaaagtaaactcggcattacgcattttccgttccatttccttcgccttatcggcgtcgatattggactgcgctttttcaatcagggacaacatatcacccatgcctaaaatccgtgaagccatccgttcaggatgaaacggctccatcgcatccagcttttcacccaatgtagcaaacttgattgggcatcccgtcacagccttgaccgataaagctgcaccaccgcgagtgtcaccatccagcttcgtcaatacaactcccgttaactccaagctattattaaagtgctccgccacgttaaccgcgtcctgccccgtcatgctatctacaaccagtagaacttcatccgggttgacgttggtatgaatctggcgcaactcttccatgagctcttcatcaacatgaagacgaccagcagtatctataataacgtagtcattaccattatccttagcatgctgcaaaccctgttttgcaatttctaccgggcttgtctgatctcccagtgtaaatacaggagtattaatctgctccccaagaacctgaagctgcttgatcgcggctggtctataaatatcaccagctacaagcaatggacgatgattttgcttttgcagcaatttcgccagtttaccagacgtcgtcgtcttacctgcgccctggagacccaccatcataatgaccgtaggcggtttgtttgctttggcaagcttggcctgactgccacccatcaactcggtcagttctttgttcacgatgtcgatgatgaccatgcctggcgtaaagctgtccatcacttccttaccaacggatttctcctttaccttggcaataaagtcctttacaaccttgaagttaacgtccgcctcaagcaaagctaatcgtacttcacgcatcgcctgagctacatcatcctcagacacttttcctttaccgcgcagtttactgaatacattttgcaagcgagtcgataatccttcaaatgccatactttcgcacctccttgtctaccagggttgtttgttcttaatctatatgtcctacagttcctgcaggcgatttacaatttgatgaacatgttgcagaatgccttcatcggactcaccgattttaccgaatgcctcatacaacgtcttatttaattcttcgagatcttggattctacgctcatacttgcttagcaaaccaagcttttcctcgtacatttccaatacctgttcagcacgtttaatatgttcatatactgcctgacggctaatttgaaattccgatgcgatttcccctaaagaaaaatcatcatggaagtaatattttaaaaacatctgttgcttctctgtaagcagaggttcatagaagtcaaacagtcggttaatccggtttgtcttttccagccgattctcctgactcatcttgtatacctccatcgtcaaggaaaaacactttacagttcttttcaacgttccttatgatacataaaagaaaagaagatgtcaagcgttatcccttgtcatacaaaaaaaagccgatccactgccctcaaacggaagtacggatcggctttttgcccactgttacttaaacccttactggagtaagatacagcagaacagccagaaaatgaagtatactacctgctaaaacaaacagatgccagatcgcatggtgatatggaaatgcccgccacacatagaaaatcgtgcccaacgtatacataagaccacctacgaacaataacgtcatccctccggcgggaacagtcgcaaccagaggattccaggcaatggtgatgagccagcccatcacaatgtaaaacacggtagacataaacaggaagcgcttggtgaagaacgccttgaacaacacaccaaacagtgcaatcccccaaatcactccaaacagtgtccatcccagagtacctcgcagtgcaacgagcataaacggggtgtagctacctgcaatgaacaggtaaatgcaggaatgatcgaatatttcgaacaaatccttcattttcccttcacgcaggctatgaagcaacgttgaattggtgtacaacagcaacatcgtaatcccgtaaatcgtaaaactgacgacatgccaagtggttcctttcaagctagcaaaaacaatgagtaacacaagcgctgccacgcttaaaacggctccaattccatgtgtaatggcgttggctacttcttcccgtcgggagtaggtataggtgtttgccatcggtttttcacccggcttccttatttatatttacatacaacatacattacatatacggcatcgacagacctcttgctttcattatacatctgggcgaacttgaacagcaacaggatggctacttagtcccaaacgtagcatgaaagcctactttaaacgtatcagttctgttcttccacgtctgcagcagttgcttcgacggtctcttcctgaatcaaccccgcaaacaacgcatgaacgaattgctcggaatcaaacggttgaagatcattcactttttcacctaagcccaccagcttaacaggcaaattcagctcctgacggatggccacaacaatcccgcccttcgctgtaccatccaacttcgttagtaccagcccggttacaccgcttttctcaccaaacagcttggcttggttaagtgcattttgtccagtcgtcgcatcaagtaccaacaacacttcatgaggagcatctggaatttcgcgttggatcacgcggaaaattttgttcagttcctccatcagattgcttttattctgaagacgtccagcggtatcacacaacaaaacatccacttgacgctgcttggcagcctgtacggcatcaaacataaccgcagccggatcggaaccggattgctgcttaataacctctacacctgcccgttcgccccagacctccaactgttcaatcgcacccgcccggaacgtgtctccggcagccaacaaaacttttttgccctcttgtttaaaacggtgagctaacttgccaatggttgtcgttttgccgacgccattgactcccacgaatagaatgactgtaatcccgtcagcgctcattttgagctgactattgtcattcccccgcagcaactcggacagcttttccgacaatacaggctgtaattccgatgcgtcctcaattttgcgctttttcacttcttctcgcaggtcttcaatgaggttcataaccgtgttgacgcctacgtccgctccgatcagaatttcttccagttcctcataaaattcctcatcaatctttttacggcgaatcatcaagtccgttactttttcaacaaaacctttacgtgttttttccaaaccatctttgaactgttttgtgacagattcagttttgtttgcaatgctttccttcaatttcctaaagaaactcatggattccctccgttggtctgaaagtatgttatttaatgtcaggcaatctcagcttcatcgttgtctagcttgacagatacgagtttggaaaccccgccttcctccatcgtaaccccgtaaagcacatcagattcttccattgtgcccttacggtgtgtgactacaatgaactgtgtctgctccgagaattcccgtaaatactgggcaaaacgcaccacgtttgcttcgtccaatgcagcctctacttcatcgagtacacagaatggaacaggtttaacgtgtaaaatggcaaatagtaacgccatcgctgttaacgcgcgctcaccgcccgacagcagctgcaagttttgcagttttttgcccggtggctgagctacgatgtcaattcccgtctccaataagcgttccgggtcaagcagcacgagatcagcacgtccgcctccgaacagcttggagaataccgttccaaattcgcgccgaatagcatcgaacgtagccttaaagcgcttggacatttcttcatccatttcacgaataacctgataaagtgttgtcttggcctccaccaaatcagacttttgctcatcaagaaacgtataacgctcatgcacacgctggtattcttcaatggcgcccagattcacctcacccaacgcggaaataccccgtttgagcctctctacctcgctctgcgtaccttcaatatcttcgggtatagggtaacgctgcttggctaactcatagctgagttcataatcatcacttaattttttcagaacgttttccagttccacatcaagccgatttactccaatttccgtttgacgaagcaactcctccactgacttgagctgaattcgctgttctttcgtgtcgttctcagccacttcaagctttttagacaagctgctgcgtgcagcccgtttgaattccaattgctgtgcggcttcttcctttttcaaacggtattgattgagattttcaatctgtttcacggtctcctgctcattggtcagcaaatctgcttcgatggaagcaagcaaggttttgttttgtctcgaatccttaccaagagtatcataatccccacgcaatctgcgcagctgctcttccaaagaaaagcgctcttggtccagctttccttctcttaccttgagattcgtgagctctccctgcagctgctctttggcagactcgttggctttacgggcaaattcagcagcatgaatggcctgatgcgttttcttttcttcttcctccaacgtagccaactttaccaacgcttcttcacgggaagtttccagctctttgatttcctgatcaaagccctttttctcctgaccagacgcagcgacctgctccagaacatgacgaagttcatgctccagttgcttgagttccattgccatctgctgctcttcaccgcgcttcacatcgccgccctggcgcaactcgtccagacgggtctgtgtctcctccaactggcgtttggtatctattgcactctggcgcaaccttgcaatttgctgctccgtatctacaatgtcttgatccaactgatccagctggcgtttgcgtccaagcagattagcatttttcttgaactggcttcccccagtcatggaaccccctgcattgacaacatcgccttccaaagtgacaacgcggtatctatattggcaacgggccgcaatacggtttgcatcttccaacgtacgggcaatgaccacattccccaagagactgcctacaattccggcatatcgatcatcatactgaacaagatctgcaccgattccgacaaagccttcggctccttctgcaatttggcgttctcctgcaccgatttgacgcggacgaataacatccataggcaaaaatgtcgctctgcccagttgacgttgctttagaaaactgatcgcctgtctggatacggattcattttccatcacgatatgctgaactgaagcacccaaagcggtttccatcgcctgctctaaatgctcgggcacccgaatcagttccgctaccgctccatgcacgccgtgcaaagtttcttttcgtgcagccttcaatacctctttaactccaagcatgaagccgtcaaagtcatcctgcatttccttcattgtatctcgccgtgaaatttgagcctcacgtttttgttcccatttacgaaccgtaccctggttttcttccagtagtttttgcagggcctggtacttttcacttccctgaatatagccactacgcaaactactgatttcctgccccagcttctgaaccgcagcttccaatccctttttgcgctgttcaagttgtactttctgggcttcccatttgccggattcgtcacttacgcgagtcacacgccgttctaatgcttccttctgctggtctgtataacgaatttcgttacgcgcctgcgccatctgattcatcagctccagcagaccaccctttaggctttcttcctgctcctggctgattccgcctgtaacaccaatcagtttggcctcttcgtcagacagccgcgcacgcaactcgtcaagctctacattcagtgcagacagtttttcgttcagctgatccagttcactcctgcgctcggaatgccgtgattcgcttgtgctaagtgataagatcaattgttcccgattagcctccagattgcgtgtgcgctctttgagcaattcgccgtagccttcacttttctccgtcgcttcactgtattgcagcaaatccctttgcaactgctctacctgctcttccagctggcgcaattcgttgcggtcgctttccagcatcgcatcatggcgggacaccaccgtagacaactgaagctgctcctgctgcaacagagctagtttggaagtcgcatcgctccacgaagtatgaatttgttcaatttgatggacgtacattgaaatttcttttgatttcaattcaccgcgcagctctttaaaatgaatcgctttttcagactgctccttaagcggtccaatctgatcctccagttcactaaccaaatcgtgaatacgcagcaaattttgctccgtttcatccagcttgcgaaccgcatcttttttacgcgatttatattttacgatacccgaagcttcctcaaaaatacctcgacgatcctcagatcgggtactcagaatttcttcaatgcgtccctgcccaataattgaataagcttctttaccaatgcctgtatccataaacagctctgtaatatctcggagtctgcatgattgccgattaatgaaatattcactatccccacttcgatgtacacgtcgcgttaccgtgacctcaccaaaatccagaggcaacgcctgatcttcattatccaacgtaagcgatacttcaccgtaattaacagccttacgagcatcactacccgcaaaaataatgtcctccattttgccgccacgcagtgatttggcactctgttcgcccagcacccaacgaattccgtcggaaatattactttttccgcttccgttgggtccgacgactgccgtaatgccgcggacaaattccatttccgttttatctgcaaacgatttgaagcccgccagctcaatgcgctttaaaaacatgctcaatctcacctctaacatttcaaatatgcttgtacaacaccgtatacctgattgatatgaattatccctattgtagcataaactagcttgtataaagcacagtaccgacactcacattacaccagcaaagccacgaaaaaagagcaaaacgcagtccattcgccattacgggccgggactccccgcggactgccctttgctcttactttgtgcccctgcttgcgtaacccgtccgggctgctcaggtaccgtttacgattctgccagcttcaaacggtttaaagctactgccgccgcttgctgctcagcttcttttttggagcgtcccgtacctgcccctagccgttcgctgtccatatatacctcggctacaaactcgcgctcatgggctggtccgcgctcctctacaatcttgtattcaagcatccccatgttatgatgctgcgtcagttcctgaagctctgttttgaaatcactcatctgaagctttccgtttaatacaatttgaggaaaaatataacgttccagaaacgaccggacggcctccagaccctgatccaaataaagcgcacctacgaacgcttcgaatacatcagccaacagagccggacgagtacgcccacctgtcaactcttcaccttttccaagcagtacatattgcccgaactccagcccgacagcaaatttcaccagcgaaggctcacagacaatagctgcacgcaacttggtgagttcgccttcgggtcggttagggtactgattgtacaattgctcggacaccgtcagttccagaacagcgtcacctaaaaattcaagacgctcattgtctgcatgctgactgaaccgatgttcgtttacgtaggaagcgtgcgtaaaggcctgcttcagaagctgccgattgttgaattgaatatgaagtttctgctgtaattgcttcaagtctccactcaacgaactgaccccttatgcttcatatttttttagaataaccgtagcattgtgaccgccaaaaccaaaggaattggacataaccacattcagttccgcttttctcggcttattaggtacataatcaagatcgcatgccgggtcttgattatccaaattaatcgttggcggaatcgtctgatgctgaagagcgagaccacagatcacggcttcaacgccgcccgctgcacccaataaatgccctgtcatcgacttggttgagctgatcgctaccttataggcatgctctccaagcgttttcttaactgcttccgtttcggatttatcaccgactggtgtagatgtaccatgtgcattgatataatcaatctcttcaggattcaatccagcatcacggatcgccattctaatgcagcgtgccgctccctctggatcaggctccgtcatatgatgggcatcgccagaaagaccgtagccaatcacttcaccgtaaatacgcgcaccacgcttcaaagcatgatccaacgattccagaataagaacaccagagccttcgcccataacgaacccgtctctttcggtatcaaaaggacgacttgccttttgaggctcgtcattacgcgtagacatcgctcgcatggaacaaaatccagccataccaatcggacgaatagtggcctcagctcctccgcaaatcatggcgtctgcgtcaccgcgctgaatcatgcggaaggaatcgccaatagcatgactgcccgtggcacatgccgtaactggtgatgtattagggcctttagcaccgagtgaaatcgatacttgaccggaacccatattagcaatcatcatcgggatgaagaaagggcttacgcgtttaggtcctttttcaatcagcgcgttgtgctgatcttcccaagttcccaatccgccaataccggaaccgacagatacaccaacacgctcagcgtccgcattttctccgattacaagtccgctgtcctcaagcgccaacttactagcagcaaccgcaaactgcacaaagcggtccattttacgcgcatccttacgttcaatataatcctctggattaaaatctttaatggaagcggctattttcgtagtgtactcacttgtatcgaaagcttcgatttcactgacgccggattttccagccatcagattatcccatagtgtgttcaaatcctgtcccagcgaagtgattacacccattcctgttatgacaacacgttgtttcaaagataatcacctctatgtttactgcatattgtattttaagaccgcacactcttgtgcgtaaaaataatatagaatcaactaaagttagtaatgccgcatacttctcagcctttgactaagtgaagctgagccaaactcaaaaacacgcggcaattccgtctttagttcaatctgtataattaggagaaagtcccgcctgtaacagaacgggacttttgatgacatgaattaggtatgagattgtatgtacttcacaacttcacctacagttgtaattttctctgcatcttcatcagagatttccatatcaaactcatcttccaattccattaccaattcaactacatcgagagaatcagcgcctaaatcatctttaaaagatgcttcaagtgtaacttcggcttcgtcggctcccaaacggtcaacgacaatgcgttttacgcgctccaatacatcggacatccggctcacctcctcttaggtattatacgaaaattacaattaaaatgccatagaagagagttttcattgacaactcttcatcggggcatgcggattggcaacatgctactacatatacatgccgccatccacatgcaaagtctggcccgtcatatatgaggaagcatccgaggccaagaacagcaccacgtcagcaatttcctcaggccgtccaagacgggccagcggtataccgctaagcatattgtcacgcaaatcatcagccagtacctgtgtcatctcagtatcgatgaatccaggagccacacagttcactgtaatacctctcgacgcaagctcccgagcagaggatttggtaagaccaattacccctgctttagcagcaacgtagttggcttgtcctgcgttgccaagtacaccgaccacggaggagatattgataattcggccagaacgctgcttcatcattggacgtgttgccgccttaagacaattaaacacacccttcagattcgtttcgatcacctgatcgaattcctcttccttcatgcgcatgattaaattatctcttgttatgccggcattattcaccaggatgtcaatcttgccccaagcgccaatcacatccttgatcaactgatctgcttcgtcagcgcgaccgacattagcctgaactgtaatagcctctacacctttggcacgaatctgctctgctacctcagtcgcagccgcttcactaccagcatagtttactgccacattagcgcctgcttcagccagcgccagcgcgatactacggccaattccgcgcgacgctcccgtaacgagcgccgtttttccactcaatggcttagacatcatagtccccccttgcaagtatataacccgttaaggcaatgattatacttttaacgggcctccaaggcttccgttacagaagcaaacgactccaagctgcttatattatacagcttaaccgttttgtcgatttttttaaccagtccagtcaaaacacttcccggtccaaactcaacaaaggtgtcaacaccttgttctagtagccatgttacactgtcttcccacagtaccggagaatagacctgatccaccaacagttggcggatttcgctcccctcacgtacaggtttagctgttacattggcaacaaccggaatctgagctttggagaaagttacagcccccaatttgccggagagcttggtcgctgcttccttcatcaatgacgagtggaaaggaccgctaacctccagagtaatagcgcgcttgcctcctgcttccttcacacgttcagcgacagcagctacgccctccttcgtaccagatacaacaatttgtccgggacaattgatgttggctagttcgaccagttgaccagactccgtaatatcacggcacaatgctgccaatgcttcacgatcagctcccaacacagcagccatcccgccttgcccatcaggaatggcctgctccatgaactcgccacgtgtacgaacgatctcaaccgcatcctcaaatgcgaggacaccggaagcgactagcgcgctgtattctcctagactgtgtccagccacataatcgggatgaatgcccattttttccttgaacgcttcatacaacgcaatgctcgccgttaacagtgcaggctgcgtattggatgtttgcttcaaagctgtgtccggcccttcaaaaatcagtgtgcttagtgcgaaccctaaccgttcgtccgcttggcgaaatacttctgttgcagctggaactgcttcataagcatctttagccatacctacagcttgtgagccctgaccgggaaatataaatgccgttttgcccatcgtgtatgcacctctctgtatccaatgcttgtcctgtaaaacactacacaaattcaatattatatcaaaacttccaactcattaccagacaagaaccgacgctccccaggtcaagccaccgccaaagcccaccattaatacacggtcgccttccttcatgcggccttcctcagctgcttccacaagagcgagagggattgatgctgcagatgtattcgcatatttatgaacattaacaactaccttttcctctggtaaatccagacgttgcatcgccgactggatgatgcgaatattagcttgatgcggaacgaacagatcaatatcatctttagacagccctgctttttccaacacatcaaccgttgccgttcccataacacgaaccgcgaacttgaacacttcgcgtccgttcatgtaaatgtagtgctgtttattttccagtgtgtctgcactcgcaggcaaacgcgagcctccggcttccaacttgagtaagctgcctccggcaccttcagccccgagatcaaaggattggaatcctctaccttcaggcacttcgccaatcactacagctcctgcaccatctccgaatagaacacaggtattgcggtcggtataatctgtaatccgagaaagacagtctgccccaatgattaatgcattattataaatacctgtcttaatgaagctcgttgccgtagccagtccgtatacaaaacccgagcatgccgcagacaaatcgaaagctgctgcgcctttggctcccaatttgtcctgaagaatgcaggcagttgacggaaacgccatatccggtgtaaccgtagctacaataattaaatccagatcctgtgccgtcatacccgcggactccaacgccttaattgctgcttcataagctaaatcagatgtagcctgttctggagccgcaatatggcgctcctgaatccctgtacgactgacaatccattcatcactcgtttctacgattgcttccaaatctttattggtcagaattttctcaggtacgtatttccctgttccgataacaccaaccggccgtaatttattcatatcgtcactcacttcctgctgatttccttggatatactttccaccaaccggttttgcaaggccgtacgagcctgccttaccgcgtttttgacggcaacgccgtcagacgaaccgtgacttttcaggacgagtccactcaaacccagcaaaggagccccgccatgctctttgtaatccaatttacctttcagactgcgaagctcaggcataatcaaggctgctgcaagcttggtcttcaaggatttggtgaattgctcttttaagagagaaaatatggctccggctgtaccctccagtgattttagcatgatatttccagcaaatccatcacacaccagtacatcgcaatttccggttaacacatctctcgattcaacattacccacaaaattgacaggtaactgctcaataagtggaaatgccaacttcgtcagttcattgcccttcccagcttcagtccccacattcagcagacccacccttggagaagtcacaccgtgaactttctgacgatacaagctccccatcagtgcatactgggcaagatgctcaggcttggcatccatattggctcctaagtcaagcgccagaataccctgatcatcaatcgttggtatcatcggcgcgagagccggacgttcaatgccttccattcttccaaccaccagcaaccctgtggtcattagcgcgcctgtattacctgcggatatcatggcatccgcttcgccttctctgaccattcgaccagccacgaccatcgaagcatcctttttacggcgcactgcctttacaggctcgtcctgtgcatctatcgtttcggatgcatggcgaatgctgaggttcgtcggcaacgccctaccgttcagaaccgattcaattcgttcccggtcaccaaccagcgtaatgtccgtatccttccattccgccgccgcagatagcgcgccctctactgtcgcctcaggagcattatctccccccatggcatcaatggcgatccgcatgctgacttcctccttcgctatactcttcctccgtggagcgataaatgacaaagttgccttggaacaccatttcttctcctacgtaggcaaagacttccactttagccttccctttttgttctggattggaacgtacatatgccttggcaatgcacttctcacctaaatgaaccgggcggacaaagcgtatatccgctgacgcggtcaatgctatctcatcattaatcacagcaacggccaatgaattggcctgggcaaatacataatgcccccgcgcaatgccagtacgcgaaaaaatatgttcctctttaatttcaaaaatcgaaataccgcttcgatccaactgtagatcaacgatatccccgatcacttcatgcaaaggcaaggaacgaacctggtcgtaggagcgctcagccatcagctttagccgttcccgcaattccgggattcccagctccatccggtccagccgaatagtctgaatacttaccttcagctgtcttgtcaattcctgatccgttacgaacggattatcatcaattaattgagtcagccgctgctgtctctgtctcttcggcaaacgttcgatgtcaatgaggcctcctttctctacaataaactgtcgttcagacgacagtttgggttactttacttcactttctaacggcggacttcaagccgatttgtcttcttgtatgtataaaggaaccccttcggcccttctttcttagaacctggtactaaaacagtatatagcatgctgacgtaaaaaggaagcatgcagacaaaaaaagtagcgcctcactgaagtgaagcgctactctttctgcgaagattccaaagaatccacttatcggacattattgagagatgatctctctagctttgtacgttccgcaaactttgcacacatggtgagcaagtttcaattcgccgcattcggagcatttcaccatacctggtactgccagtttaaagtgagtacgacgtttgtcgcgacgagttttggatgttctccgttgaggtactgccattcttcccacctccttaaccagatcaaccccgcataacgggtatgacttcttatctcattcaagactgaaagtaaatgctagaagcaattatcttacagccggtgaatcaagcctgcaacatccacgcatcggttcagtaactctccggcacaagcggatgatgatttttcagaattgaactcaattctcatttaaaaaaatccttaagccctgccagacgcggatcaatcttttccgtattgccatcgctactgtcatcggagccaatactccagttttgtccggtctttggtgcgattccctgacaatcctcactgcacaaaggcgcaaacggcacatgcagtacaaacagttcttcacaatacggtgcaatgtcgaaggagtcctccgtcactgcgataaaatcgccatcttcatcctcctcttcaacactcgaagaggcttgcttgaaccgttcacggaattcaatctttaaatcctcgtgcatcgggcttaaacagcgtgagcacagcatgtccagacctgcggtcaacgtgccttccacgctcatcaaaccttgacccagactaacggcgaccaagtcggtctccagcggggaaacggccgtaacatcagcacgatcatccaccaattcactcacattaagagattcacggataggaaaaggaccgtcacttgttgctactttgcgaaaaaatagttgcatcactatcactccaaacaaacaaaaattattataccgactgatcgagtcgtttgtcaacacctttcactttacaccactcacaaatccaccggttttccaatggttcgacaagttttatgcagaagcaaaaatgcattgtgctaaacatgtactgatgagtattcgtacccccgccactcttcgtgtacaataatgcgagtataaagctttttcgtccaggtctcaatggtcttgttcatgccgacgatgaaaaatcagtatagctgccctgaaaacaatcattgacgggtacttaaccattattatcaaaagagttacccaataagctactttaagaaaggagccgactacagtcttgaaaacactcggtatgattgtagagtacaatcccctgcataacggacatatccatcactgggaggaatctcttcgcatcactggtgcacaacgcacagtggctgtgatgagtggtcctttccttcagcggggtgaacccgcgattacagacaaatggtcccgcaccgaaatggcactcgccatgggtgtggacctagttctggagctgcctgtggcctatgccgtccagcccgcagaatggtttgcccgcggagcggtcgccctgctccatgcgacgggcatcgtcgacgcgctctgcttcggcagcgagagcggagacatcgccccgctgcgcgcgctggctcgcgtgctggcggcagagccggccgagctcaaggccggcatcgcgcagcgcctaagcagcggcacgagctatcccgctgcctacgcgggagccgcagccgcgctcgcggccgaaggagcggacggcgctgcgctcgctgccctcatgcagcagcccaacaatacgttggggctgcattatttgattgcgctggaacggctgggcagcacaatcaagcccttcacggtaacccgcacgggatcgggctaccacgaagccgtggcccctgcggacggaatcatcgccagcgccacggccatccgccgtctgctgctggacggcgggccggaggccgcgtcgccgtacatacctgcggcgacactggagattttgcggcgcgagtggcaagctgaacgcgcgccgctgcactgggaaacgttcagccagccgttgctgaacgccctaatcacacgtagcccgcagcagctggcggagctgcacgaggtcacagaagggctggagcatcgtctgcggcaatcactgtacacgctgccccagccttctgtggaggccctgctcaccgcgatcaagacaaggcggtatactcgtacgaagcttcagcggatgtgtgcacatattttgctgaatcatgccaaagccgatatgactccggctgagctggcgaaaggtccgggctatatccgcgtgctcggctttaacagggctggacgcgagctgctggcacgtatgaagcagacagccacccttccggtatgggtcaagctttctgccggatcacatccccacctggactgggatacagccgcagccgccatacacgcagccgggatgccacgtcccgccatccgcggcatgtatgctgattacttgcgaccgcccattatggtttgatgggcagcttttccatataattcagcgcatcgtcaagcctgcgaaccgaaacaagcttcatccggcttcccatttgctcagctttggccttggcctctttataattatccgcagggacgaaaaacaattccgcaccctgacggtcagcagcaactattttatactttgcaccaccaatcgctccaacctgaccgtccttatcaatagtacccgtaccggctacacgatatcccttactcagatcacctggtgtcagttggttatagatttccatggtaaacatcaaacctgccgaaggaccgccaacatccgtagatgtaaaatgaatcgttttacgttcgtccttcggctctaccttctgtaccgtggcaatactgacgccaaatccagaacgttgcttacccgtctcactgtccgtgatggtcgttaagggagcttgcacggtcagcaactttccatcgcgctttagcttcactttagccatttttcccgatttttcatcctctaaagccttccgaatggaacgattatcggtcacccgcacgccgttcagctccaatatttcatctccaggctcaaacacgctgttcgatcccgggaccttaaatacatacacataatccggcacaatgcgatagggaacatgggcacgggtgtaggcagcctccatcgcggaagattgggaatcccccatataccatacctgctctgccgcatattcgtcttcacttcttccatgcagacgatcctctttgcgctggatctccgaattgcggtccagcttggacaggcccaacataataacattggcataacgcgccgataccgtcgtcatcataaaggtcccccgttcgatgctgtcaccctcccggactttaaccatcggtttgatctcgttagccccacctggtccatagatcagataaggggttggcatatagaccagcacatagaccattgcagccagcattaagacataaccggttgaaaaaaaaactcttttccggtttaatcgtttcattgcttctccccctcttgcagcctaacttctcctatcttatccaagtgcctctgcgccacctgttctcaagccttccgaaaaagcatacattgtttacgacaacgtatacgaacaacctatcccaagacaacgaacgtgaataaacactggagacagcatcccactctccttagtatatttatgagaggtgaattctttgatgcaaaaggaagcccattccgctccttattggacaaccatactacttggcctcggagccattttgcttgtactggctgttgtcgcctcaccagaagaagtatttcaagcctctactcaaggccttaagctatggtggagtattattttcccagccatgctgccttttttgatgctgtccgaaatgctcatcgcctttggtctagtacatggactaggtatcctgctggagccgtttatgcgatcctggttccgtctacccgggcgaagcggctgggtgttggcgctcggcctgaccgcgggattccccgctgcagcggaagcggtgcgccaatgggcacaacaggaggatatgactgcgtttcagcttcgacgtctaacctctatcgctcatttctgcaatccgattaccatcctgctcgtcatcgggacagggctactgcacaatgctaccgcaggcgtgatgttacttgcagttcactggatttccgggctgctggcaggctggatcaccgccagactatctgtatcgtccaaagaattgcaaaaacgggaaacgccagctgccctacggcgcacctcagtttcccgtacttctccctccctgatccgatccgcatgggaagctacccgctctgccagagaacgggacggccgcagtttcggaaaactgttgggcgaaaccgtatcccatgctgtacagacgctgatggtgacaggtggattcattattttcttttccgtactgattcgactgctgtccatatacacaggccaaggatcgctttctttcatatggcctgcctggatggaaatccatttgggttcctatgaaatcagccgtctgccctacgatcttcgtacacaagcagccctgatcagtgctgtgttgggctggggcggcctgtgcggctggcttcaaattaccgccgtcaccagaccttccgacaagggcatcaccttcaccttgtcacgagtgctccatgggatcattgcttttggacttaccttagcgacatgggtcccgcttaaccgcatcgtcagcaatacaactcccgcttacgtcaatcgcagttctgtgtcttcttttgtggaaagcgtaaatgaatccgccacgcatcctgtcatgaccggagccagcggcttactaacacaaatagaaggaacatctatgtacccctggcaactaaccgtactgtccattgcgctgctgggtacaattatagttaccctgctggccttttcctttatgacttcatggtggagccgccgcgattcgcgttgaccttcgcacgcagcgcgtcttccacctccggtgccaccagatctacaaccttgccatcaaaatgcgcaatttccttcaccatactggaactcagatatgaataagtcggattggtcatcataaagatcgtttccgcatccgggttcagcttatgatttgtagaggctaattgcagctcatattcaaaatcagtcaccgaccggattcctctgacaataacctgggcccctttttgacgtacataattagctgtcagatcacggaagctgtccacttcaacgttcgggatatcgcgagttaccgttcgcagcagctccattcgttcttcaagtgaaaacagcggatttttactaatattgttaagaaccgcgacaatcaatagatcaaactgtctagctgctctttgaataatatcctggtgccccatcgtcacgggatcaaaggttcccggatatacggcaatacgtggtttgtgctcaatcatgatggtcctccccgtctgattcgctgatgccgaatttgaccactccggcttccgtatgttctacgacatccgacaaagcatcggctgcaaaatgataaatagataacgccgtttcaccatagactgcttttctgacctgttcgaacggtccgaagctttccggatattcatgtcccgattcatactccagcacgatgattgcatctgaacgaagcaagttcaactcagccatacggctcattaattcatctccgtgtttgagacgatagggtggatcgagaaaaacagcatcaaaaagagctccacgttttgccagcaccttgagcgctcgtccggcatcattgcggaacacttcagcctgtccttccagtccagtttttcgtaaattttctttaatgacatcaatgcttttggattccatatcaataaaaacagccttgtccattccccggctaagcgcctctatacccaggccaccactaccagcaaacagatcaagtgcgactcccccatcaaaataaggacctatcatgctaaatagcgcttccttgaccttatccgtggtcggccgcgtccctgtgccgggaactgcctttaacggccttcctttggcactacccgataccactctcacgctgaaactcacctattttctatatgtgttcataaccatataagattatgacgctatcgtaccacatgcaccgtcgtttgaaaaacttaggatgaggcaggtataaaaaaccattccctgggcatccttaggatatcggcattcaaccaatgtcgtagacaaccgcggagaagacttacgtttccccataagctcttcgtccggtttctcctctcccattcgggcgctctttaatggagcgcctgattttttttacataaaaagaagctgcttaatagcagctccagattgtcgagaaaccc

SEQ ID NO: 28 - DNA, 462303 bp, Unknown
  Kingdom: Bacteria, Phylum: Firmicutes, Class: Bacilli, Order: Bacillales, Family: Paenibacillaceae, Genus: Paenibacillus
cagcgttcgtcctgagccaggatcaaactctccattaaagaccaaccgaggctggtttatagaaagagcgataagctcattttgaaactgacgagataaaatatctcttgtttgattttgcgaacaaaatcattttactcactcgttgttcagttttcaaagatcaaacattcttttttgttgactcagtttgtcgcctcatcaactcttatatcttatcatgtccgaaccaactttgcaagcatttttttttgaaatcttttttttgtaacactcgctcgcaatattgtatttcttggccggaattagaatataccatatacatatcccttttgcaagcatttattagataaggtttcacaatactttattattattcgttttccttctatataatagctcctttgtatctatctgcgtctaactacaaaaaaagaacctcttcccttaagcaacaggaaagaggttctgtgttctatatctactgattattcggagcccataaagacaaagcggatcactacaataatagcaagcacccacatgagccagtgaattttaactttattgctggtaaacaggttactaaacacagccagcacaacgtaagacagaataccagcagagataccattcgcgattccacctgtgaaaggcatcagcacgatggtcaaaaatgcaggaaacgccaacaggaagttatcccagtcgatattgcgaacctgactcatcattaggaccccaacgataatcagagctggagcagtagcggcagaaggcacaaccagagccaacggtgcaataaacagggccaacaagaacagaacacctgtcgttacagcagtcagtccggtacgtccgccttcttctacccctgcggagctttctacgaatgctgtaatcgtacttgtacccaatactgcaccagtacttaccccaactgcatcaaccagcattgctttaccgataattttctcgccttttttcttatctttcattatacccgcgcgtgtagccgtacctaccaaggtaccgaacgtatcaaacaactctacaaatgtgaaaatgaaaatgatatcaaacagaccgatatgcaaagctgctttcaagtctaactgacctacagccaaattactgaaatcaggaatccagttgcctgttgtcaagctactcaaatttgttactcccatcggaataccgattaatgtagtagctacgatcccaatcagcaatgcacctttgacccgaacgaccatcagtgctgcgataataagcaatccgattagcgccagcagtgcatccttttgatgtaccagacttcccagaatcaaattaaaagcatgacccggaaccggttgaccaacatctgtccctggaacgatgctcaccataaccaggttacaaagcttgaatccgacaattgtaataaacaaaccgatacccactgtaatggctgtctttaaattttccggaactgcaacaagcagcatctgtcttactcgtgtcacggttaaaatcagaaagacgataccggatataaatacagcgccaagtgccgcttgccaagtaatcatgccattggaactcaggactacagtcataaaataagcattcaaacccatacccggcgccataccgatcggtacattaacgaatagccccatcagtatggtaaccaaacctgcacctaccgccgtcgcaaaaaagacagcttcactgggcatacctgctccagtcggacctaaaaaggtattgttgaccaccagaatataagccatggtcataaaagtagtaatccccgcaataatctctgtgcggacgttcgtgccatgttcctttaatttaaagaaacgctccatgagtcgtaattcctcctacgcaaagcatactcgtattgttgtcgttcgtttgaagtaatattcgcattcatatgcgctatattattacattggttattttaggctctcacctactgcttgtcaacagaaaaaacgaatgttacaaattgaacacatatgtattgttcggaaaatagaaaacccgcaagctattatgcagctgacgggttatcatttagaggaatcagatatttttgtacttatcaaaggcattcgctgagtccggtatattttccagataaacgatagatcaagtagtgaaaataatcttctaaaatcttcatcgtgtgcaattcctttcgtgctgtatatgtgtatgcgtccttatgggaaggttattgcaattttaccaacagcgtggtgggtttcgcttaaagcgtgtgcgtcatacaaacctttttgtgaaaaaggaaacgtagctcctactaccgatcttactttcttttgctccaacagatcggcaatttcctgtagttgctgtccattgggctccagccatatattttgggctgttacgttgtactccttcaccagctcttcgtcaaaattgctgacaatggatatgatccgtccggtatcccttttcattaccttaaagctgttcttctgaacatccccgcccatcgtatcgaacaccacgtccacatcagataaaacttcctcaaaacgagttgtacgatagtcaatgatttggtcggctcccaatgaagcaagcaattcatgattacgctcactggctgtagtaatgacataggctccggcctgtttggcaaactggatagcaaacatacctacgccacctgcacctgcgtggattaatactttttcccctttggtcagttgaccatgtgtaaagagcgcctgccaagcagtcaaccccgccaaaggtacagaagcggcttcctcccaagaaattgaggcgggtttacgtgccagcagatgatcatccaccaaggtatactcggcataagtaccgaatcgggtggtgtccgggcgtgcaaacacttcatctcccactttccaatcggtgacctcgctgcctacttccgaaatagtaccggctacatcccagcctaaaataattgggaactcccaatccatcatttgttttaagtaaccttcacgtagcttccagtcaattggattgatggaggtagccgccactttgactacaacctggtgagcctgtggtgtaggagtaggcacttctctttctttcaattcatccttgcttccatactgatctataacgatggctttcatatccatttcctcctcgcacatttacatattcttcacattgctagacatacgctgtagcacatctgtcaaaaccacaatttcctcatctgtaaacttacatagcagcttttcctgaaaggcttgtctttgctctgacaaaacttgcagctcttgaacccctaattcagtcaaacgtatataggtcacacgcttatcctgctcttttttactacgtaaaatcagaccttcctcttccagccttctcagatgtcgggtcactgctgcaccatccagaacgagcagatgttggagctccagctgacttagttcctgacgatgatcaatatgatacaaaatttcgaccttggtaaaactggtttttaattgtgcttcaaaagcgttattcatttctttacacaaaagatgcatgcgataaaacaactggcttctttcagagcaatgttcgatgacaaaccctccttctaatgcttgacccatcaattgatgcatcaagtattatacaccctcactaaaaataaacaagtctgagacaagtatatacaatcctacattcacaaaaaaagctcaagctaaacggatagcttgagcagcctgtgcatactcgctatagacttgacctgtgatggcattaggcagatgctcaggaaccgtatcacttgatccgtgaggcggggtcaaaaagacgatcagcttgtccgggtaacggttaattaatccttcggcaatatgcttaagcacaccataaaacgtacgcgtttctgtcgatgggcgctcgcacatcggttcaaaaccgctgctggctacactgctgccggatatgccgtgattctgtaaatcaattccccctactctattagatcgtattgttgatttcgataaatttatgttcaatcgctgtcatttcgtgatttggccgggttattaaatatgtatccatgtagccgaaggttgggggagcgggcaaataggatgttactttgaattgccgcgcaagccttttagacataagggtgattcccattcccatcaagacaaattccaccatcgtttcaaacacaccgacctccacaacctcgccatgggtcaattgcatgtcctgatacatcttctttaaatgcgttaggtacaggcagccatccgacaatatgataatagaggctccttgcagcacctgtttgagatctgagccttcatgtatgcctttccccaccagcaccaactcttcacggcatattttttgataatgaatatacgggttggtgggataccctgtgacaaaagcaatatcgagctcgccgtcgaggatcaatcgctccatttccgtggtggttccggtttttaatgtaaccgaggcctgcgggtacagctcgtataccttcgtaagcgcccttgttgtttcccccgcaacaatagactgcatcgtcccgatgcgcagcttttcctcctgcggtctcattttcatctccgtgtcttgccacagcaacaacatttgcttgaactgagcatataggatttctcctgaaggtgtcagctccataccacggggctttcggtaaaataacgctgtgccgtaatgagcctccagcttctttattttggccgtcatattcgattgcaggtgattcaacttttgggctgcttctgtcaggcttctcagctctgccaccgaaacaaatgcctgcatattttcaatatccatctcttcacctcccatcaaataaaatgatatctatatcataaacaagcattattatttatgagttaaatgtattatattggccttggatgctattttccaccctcatcttaaaaatcaggaggtatggcaacatgatcaaaaagaagattcgtgtaggtatcgtaggaggttcgatgaataataaatgggccagtcaaacgcatattccggctttgctcaagcacttaaacttagatatcactgccgtcggtacctctcgtatggagagtgcgagacaaagcgcagaagaagtaggcgcggcactggcttttgatgatgccaaaaagctcgcaacttccgaggatgtggatatggtcgtggtgagcataaaagttccccatcattacgaggcggtgatggcggcaattcaagagagaaagcatattttttgtgaatggcccttgggggcaaacactgcggaagctgctaaaatggccaaggcggcggaattggcaggcattcatcataccgtcggcttgcaggcacggcaggatcttgaagtgcaaacgatgaaaaaactcgtggagggcggagagattggtgaaattatatcctgtcatatgcaagtagctactcccggcaaaggaggacaagtaaatcaggacactgcttatttgctgaatagagccaatggggctaatctgctcacgattaatggcggtcattccctggatgcgctgcaatacatcgttggcgaattccgcgagctatcggccatcacatcatcccgctataacgaagccactattcaggaaacgggtgaagtcatttccaaggatacagccgatcagattttgattcacgggctgttggaaaaaggagtaccggtatccgttcacattcaaggtggagtaaattctaagtttgagatagagattcaggggaaaaagggcattttgcgtttgacacagaatccttcgcttgggcatgttcaatttgggaatctaatgctcgaaaaacttgtgtacgatccaagcagtacgcagagtcatggtcctaatggcgcttttgaacaaataagtataactagagagcctaatacaagcctggatttcccaaaacaaggggtaaccctgaatgtagccaaggctcattatgtttttgccgaggatattttgacacacacccgtctcgctcccgatttcaaccatgccttaaagctgcatcagctactggaccgcattgaggaatcggctgcaactgggaaaaagatcgcatggtaaggtagaattgtaaaaaaagaaccttcaaccccacgatagatgtggagttaaaggttctttatattgtgctgcctttttaatgaagtcatgtgttctccacttttatcctgtcaccttcaaccaaaataacttccgcgttgctgattggatataaatttaattggctgccatattcctcaatgatgttctccaccgcttttttaaacggaatgttcgtatgatgggggactggatagaattcaatgacccctagcgcagcaaaggaatctaatgcaggggcctcctgaacatcgtccataagttgaacatattcgatattcggtgataaaatcagcgaaccggcagattcgcctatatacaatttccctgcattaacttcttcagcaatgattttgtcagccccggttctttttaactcttgaagtaaataaaatgtgttgcctccggtaatataaatatagtcattccctctaattttactcgctatttcatcccaggttgctgtgcttatttcgatttcatccacgactaatcctaaactctctaatgccttttttcctgattccacataaaacttaactttctctggaatacttgcggttgggatgaaggtgactttttttccttccaagttttcaccggcgaaatggactaaccatggtgcaacatccttaaatgaggacgacaaaaataattttttcatctctttattctccttagaacagcgtttaatgagacgggatatgtaacactttattctaggtatattataaaatatattagtatcaaaacatgacaccattggaggataacataaaaaagcttgaagctgataaagtcatataaaaaaaggagacattattattgaataatatctccttaatatctcctctttttcaacctcgtatccgttgaaaataactggggttccttgattttgacccataaaatactctcttccccgctctcattttggagtgggagcagatgttcgaccttgaacccgtaaaaaagactcctgccgcacagcgatatttcggccgatgcggaggagtcctgatgttgtattggtgaatctccaaaggtttgtgattacagggcgggagttcccgcgtttattcccactcgattgttgctggtggtttggacgttacgtcgtacacgatacgattcacgttatccacttcgtttacgatacgtaccgaaattttctccagcacatcccaagggatacgtgcccagtcggcggtcataccgtcgatggaggttactgcacgaatacctacagtgtaagaatacgtacgagcatcgcccataacgccaacactcttcatattcggcaaagcggtgaagtattgccagatttcccggtccagaccggctttagcaatctcctcgcgcaaaatgtaatccgactcacgaacaatcgttagcttgtcctctgtcacttcgcccagcacacgaatggcaagacccggacctgggaatggttgacgccatacaatctcagctggcaatccacattcttcgccgactttacgcacttcgtccttgaacagggcattcaacggctcgatcagcttgaacttcatgttctccggcaaaccacccacattatgatgggatttaatggtctgtgccgttgctgttccgctctccacgatatccgtatacagcgtaccttgtgccaggaaagtaaaatcgtcaaattgagaagattcttcctcgaacacatagataaactcgttaccgatgattttacgtttttgttctggatcatcgactcctgccagcttggacaagaagcgctcacgtgcgtcaattttgacaactttcatatcaaatttaccaacgaacgtctccattacactttcggcttcacctttgcgcagcaatccatggtcaatgaacatacacgtcagttggtcaccgatcgctttgtgaatgagcatcgctacaacggaagaatccacgccaccgcttaaggcacacaatactttcttgtcgcctacctgttgacgaatctcacgaatctgatcttcaatgaacgattccatggtccagttgccttcacaaccgcacacttcataaaggaagttgctgatcatctcgttaccttgaacggaatgacgtacctctggatggaattgcaccgcatacagattccgctccaggttactcatcgcggcaatcggcgcactctctgttcctgcatccagtgtaaagccagtcggcagatctgtaacgtgatccccatggctcatccatacggtttgacgagaatccaatcctttagccaagcgggcatcctgattgaattgcacgtctgctttgccatactcacgcttgcccgcacgttctaccttaccatccagttggtgagccatcagctgcatgccataacaaataccaaagatagggatgccaagatcataaattgcccgatccacctgaggagcattgtctgtatatacgctggagggtccgcctgagaaaacaatcccttttggcgccagctctctcagcttctccgcaggcgtattgtatggaaggagctcgctatatacgccgagatcccgaattcttcttgcgattaactggttgtattgtcctccaaaatcaagaactacaacgatttcattaggcttattcattaccgtgcctccctcaattgttcgtttcattatacgcaacgataaaacaagacgtcaagaaatcaaccggagttgagtgggcatgaaaagattgttaaaatgaattgattctaaaatactcaatctgttcgtaggagtgtaaacgatggatgtgctgaagtggatcgcgcaattgttcgaagaatacggctacggcgtcctttttttcggcttgctgcttgagtttattgctttaccatttcccggggaaaccacaatggcttatgcgggatatctctcctatgccggtaccttggatttcggtaaactggtgctactagcttttctgggcacaaccctcggtatgactattacctactttgttggaagatgggctggactcccctttattcagaaatacggtaaatgggttttgttatcgccggacaagcttcagaaaacacaaaaatggttccaacgatatggatactggcttatcttccttggatattttatccccggtgtcaggcattttaccggttattttgccgggattattgctctttctttccgtaaatttgccttgtatgcttacagcggcgctttattctgggtcatcctctttctaagcatcggcaagctatttggtccccaatgggatgccattttccatttggtagagctgtatgcgctgcgaattgcgggagtcgttgggttcataatcctgctgtatattatttaccggtggagaagcttcctatttagctcgctacgcaaatccgaaaaatcggtgaaaaccagcaacaaggatgacttgaagtagtcaaactcctgctgccttacggctacgaatccttgcataatacatcgaaatcacgatagatatcaccacaaatcccgcgcctccaaccaaacccaacatacgcggctccatcatttcaatcgccacccctgctccaaacatagacagtccgatgataccttggctccacgccgtcagcatgcccaacaatggacactgtaaatacaatggggtctcccgcattaataatgtatccaggaaaatggcccctaccccgccagccaacgaaattaagaagtaaatagcaaccgccgcccatgcgtgataaataccgcttaatcccataagtaaaatcccctccaacaaaggcataccagtcctcccttcaccggagcaaatcgcgaatgtcagactgtattcgtttctataatcgtcaaggcataaattcatatattcagagcatactaagccaacaaactccaatatcggaggattttacgtatgccaaatcagaataaaagttgtccacttactcatgtgtcctctaacttgagggataatgtaaaccatattgaaagctcctttggaaacagcggagatgtaatcattaaagagctattatggatgcaaaaatggccagcagctttgttttatatcgatggtctgattaacactcaattgctccatgattccgttctgcgttcattaatgcgggtaaaggagcatcatgtaccggagggtgcggaaccgttcgactatttaaaggatcaagttttgattgcaggtaactcaggtagtgtggacgaaatggatgccttattcaaccagatgctatctggcggtattatcattttgctggacggatacgcaaagggcatatggattgatgcggtcggttgggaggatcgcagtgtcagcgaaccccaatcccaaagtgtcgtacggggtccaatggaggcttttaccgaaaatttacgtacaaataccgccctaattcgtaggcgaatccgcgatccgcgtctctggatggaaacaagacagatcggtcaagtgactcataccaatgtggccgtgatgtatgtcaaagggattgctgacgaaggagttattcaggagctgagagaacgtttggaccgaattgatattgacgggattttggaagggggttacatcgaggaggaaattcaggatgaaaccttcaccccgtttcccaccatttataacagcgagcgcccggattcggtcgctgccagcctactggagggccggatcgctatcttggtggacgggaccccctttgtactgttgatacccgcattgttcgttcaatttttccagtcggcggaggactattaccagcgtgctgacatcagcactttgctgcgtttgctgcgtttcttttctttttttatcgctttgcttgcaccagcagtttatattgcggtaactacctttcatcaagagatgattcctacaaacttattggtcagtctcgcagcacaaagggaaggcgtaccgtttccagcctttatcgaggcgatgctcatggaaattacttatgaaattttgcgtgaagcaggagtcagaattccgaggacagtcggacaggctgtatctattgtagggacactggttattgggcaagcagccgtggatgcgggggttgtctcggcggctatggtcattatcgtatccattaccgccatctccagctatgttattccggaaaacggcctgtcgatagcggttcgtattatacgcttcgccttaatgatgctagccgcagccttcgggcttcttggaatattgatgggtttaatcgtgcttttactgcacttaaccagtctgcgatcgtttggagtatcttatatgagcccgtttggtccctatgtggaaagcgatatgaaagatacgctgtttcgcctaccttggcctcgcatgacgacacggcctcaatccatttctatccaaaatacgatccgccaaaaaacgaaaaaaagacggattggccataaatcaaaaaccagaagggatcaaccatgaagcagaccatacatttgttcttcgtctggggactgattgctttactattgggtggatgctgggatcgcaaagaattaaacgagctgggcatcgctattgggatcggagtggatatggaaggtgaccagtatcaggtgacggctcaggtggttattccttcggcagtagcttccaaatcttcaccaagtgcaggctcgcccgtcgttacttatgaggccactgcgcccacaattcaagaggctattcaaaaaatgacggatacaagcccgcgaatcatctatttatctcatattcgtatgctgattttaggtgaagagtatgcgagaagaggaatttctgatgcgattgaagccttgatgcgagagccttttactagaagtgacttttatattgcgatagccaaagataacaaggcttccacgatgctaaaaatccccactccacttgaaaagttaccggccaataaaatgtttgcttcattggatacgttaaccaaaacatgggctcctgccaccaaagtaaccatggatcaactgctgagcaacttggctaatcctgacatccagtccactctgcccgctttggaagctttgggagatatagagtcgtccaatgaaaaaggtatagatgacaccaaaagcatatctcctggaaccacactgaggttctccggtatcggtgtcttaaaaaaagaccgcttgctgggctggatcaatgaacaagacagcaaagggttcaattacatttggaatacagtggaatcaactacaggacacgtcgactgtcagggaggagggaatatcgccttattaaccttgaacagcaacacccaaaaaaaagtgcttattcgcgatggagaacctgttatctccatatccgttaccaacgatagcacagtacgagaggtcaactgtaagcatatgaagttaagcagtatggctgatattaaagaaattgaggccgcaagcaatgaaaaaatcgttgaaattttgaagcattccgtagagactgttcggcgtgagttcaagtcagacattttcggctttggtcagctgatccaccagtccaaaccagagctttggaaaagactaaaagaagaaaaagaaaatccatttatggacttacagattgaatataaggcaaagactacgatcaaaaaaattggttccttgtttgaatcgttccaaaaagaaatgaaggagtgagcttggtggaggaaaaagggcgtatcagcataccaaatatagccgtactcgtatttttgagtattatcggagactgtgtactggtgtatccctccctcattacagccatatccaagcaagatgcctggatcagctcattcctaagcatccctgcaggactggctatactactgctactcctgcgggtacatcagctgtatcctgatctcacctttgttcagctctgccagcgaattttgggtccgtggctaggcgccctcatctccatatggtatttgttccatttactaataaattcagcgatttacttaagagaagtcggagattttatgaacagccagacctatgtgatgacacctcttcccgttatcaatttactcttaattcttgtgctgatgtgggggatgtatatgggattggagcctattgcccgtacggctcaaatgttatttcctctgtgcctggtttttacattatttttaatcctatgcttgcttccccaatgtgaaagtcagcagcttaagcctattatggagcaaggtattcctaagattatggaaggcagcctatttgcgctctcctacccattcggagaattagcttttttactcatgatttttccctatgtgagcaaaaaaccgggtctaaaaaaatcagttttattagccggccttactgctagcgttctgttaagcgtactacttctggtttctctcatggttctgggcccttttgtaaccgaaaacagcgtgtacacctcttacacgctttctaaaaaaattaacataggaaacttcttacagagggttgaatccatgatgagcacagcctggattatcactacctttgttaaaaccattttacacttctatgcctttaccttaggaatgactcagctactgcgtttagacaatgtacggacttttctgggccctagctttatgatcctatttggtctgattatcgtgtcggcacccaacattacttattatctggatacgatcgttcacgcctggatttactgggatttgactgattccgttgtccttcctttgctgctgcttgtcgtatacaagtttagaacaaaaggaaatcatagcctgggacctggttgaccctcacccttaatggaaggagcatacatatgctgatcaccattgtcattatctgtatcggtctagccattgctgccaaagatttaccaggcttgtaccgaaagcatcgctttaaggatatgttcgtatacatcattatgctcggattaggcacatggcttagtgtccttgcggccaaatcagaggttacgccaagcccgctggttctgattgaaatcatctataaccctgttaacgcttttgtgtcacatgtatttggcttttagaagggaggcagccacaaatgtcaaaaaaagaacgtatcagtgttcggcaagtgactgtccttatgtttatgtgtttaatcggggatatgctcttaatttatccgactattattacacatattgctcatcaggatgcctggatcagctctatattgtccataccgttaggtttaattattatttacgtgctcattcgtgttcatgaactctacccgggccttacacttattgaagcgatccgtaaaattttcgggcccgtattcggaaccattgtctcctgctggtatttgttttatttcttcatgaacaccgctcttattgctagagaggtaggcgatttcctgaataaccagttatttgtacaaacccctctgcgtgtcctgctcgctatgggaatatccctaatggtgcttactgcgctaatgggaattgaagctttcggtcgtgttagcgagatgctattaccagcatatatattaatcttctctggtctgatccttggactcctgccacaaatccagctttctaatgtacggcctgttttggaaaacgggttcgctcctgttgccaaaggaatggttccaggcgcggcaatgccttttgccggaatgtctattatgctcatggtttttccttatgtaaacaaaagagcccattttaaaagagatatgctgctcgcatcacttataggcggagtgctgattagcctctttctgctgctctccctccttgtcattggacccttcgtgaccaactacagtccatatatttcttctgcactcacaacaaagattaacgagctcaattatattacacgagttgaatcgctagtaactttaatctgggcacttgctgcctatttcaaaggtgttcttttcttttacgcgtttactttcggaacaactcagctattccgaatttctaatatccgtccctttgtcatccccgcaggagggcttgtgtttggcatgaccatttcgataaccccaaatgtgttttattatgtaagaactctggtttatcccatgtctacctggcattataccaacggcttgatcattccgcttttgttatggggtgtttatctctgcaagcaaaagtggaagcatcgacaaaacgtatccaaaaattaacaaaaaccttttgaaaccgatgcttaaaaaagcataatccgatttcaaaaggttttcttgtattcttcacttacgccatatcctgaatgtatgccagcgcagcatcaatatgccctttcactcttaaaccacgccattcatgaactaaaatgccattttcatcaataaggaacgtagaccgaacaatacccatgtactgcttgccgtacatctgtttttgctgccatacaccatacgtctcagcgacctgatgctcttcatcagataacaactgaaaagggagtccgtactttgcaataaacttgtcatgctgcttgagtggatctgggcttatccccaaaatcaccgtgttcaagccttcaaactccgtatgtttatcccgaaaatcacaagcctgggtcgagcagctagaggtcaaatccttgggatagaaatacagcaacaccctattacctcgataatcagacagcttaacacgctttccctcactcccaggcaattcaaaatccggtgcctcttgcccaataacggtaaatatcgtggacatctcatcatctcctatcttgtgggggcttatgtgatctgacctatgagcctgcccctctgtagcggcgaattccccagttccatgccagtaagcccaaggtcagaaagacaattcccatcacaggagttaagagagccatatggcgcatgtcctctcggtggaggaatagggaggctggatatacaccaacaaaagcaaaaggtagtatccaagtcagcacaacctgaatggctcggttatagatcgtcactggataacgtccgtagccctgaatattgtacatgagcgggataattcctgtgggcgcatccgaaaagaatgaaagagaagtcaatatggtgtaaatgcctgtatagattgccacggcacttaggctcaaaacgatcagcgctggtacgaaccaccactccatagccaagtccatctgtgccccgctgatccccattataatcagaccgatcactgagcccaccaacgctggcgggtccacattttcaaggaaaatctggaacagattatatgcaggacgagtcattacccgatcaagctcacctttcacaatataacgctcgctaaagttccaaaggttgacgaaacagctgaatagtccgtaaggaaccatgaaaaatccataaacgaacacgacttcattttcactccagccccccaaactgtctgtatgcataaaaataaccaggataaaaataagattcgtggcctgaaacagcaggtctgaaatcacttctacccaaaagtcagcccgataggtgagccgtgacttcatgtaatttttcaaatattcgctaatgagacccaaatagtacatcatcggcttaccctccctgcacgaacagacgtctgcgcgccagtcgccaaatgatgatcatcggcacgagcagaacgaccagccaaatgatttggatacccagtacattccagatgccaacgccctttacacgtcccgtaaatacagaacccggcaaataggtaatcgcctgaaacggcatccattgggcgatcgtcgccagccagcctggaaacaaactgattggcaaaatcaatccagaaaacagatctacaactacgcgcttcatacgcatcatgccctcattattttcgataaaaaaggccgttaatcccgtaataatattgatctgagtgttgatcataaagctaaaaaacagcatgaccagaaaaccaacccaggctaccggatccgtgggaagctttaccggaaataacagcatcgcaatcgccatgcctggaatcataaatagcagaaaacggaacataccctcgcctagtccttgcataaatttaacaagtacatagttataaggtcggatcatttgaattgcaatgcttccatcacgtatatccgtcgagatctcacgatccagattgttaaaataaaacgctctcgccatccatgatactgctacatacgtcgtcatctgagcagcggtaaagcctccaatgctacccgcatcgccatatatcgctttgtatgtgaaataatacacgccaatattcatgcaataaataaggattcctgaataatagttcacacgatacgcaagcatcgtgagaaatcggatacgaataaaatcggtgtatacgctaagcatgaactttggcctccactatcggattgccttggcgttcagccgaaccagactgatagatactgcggacaatatcatccgtgttggtttcaatgattttgatatccgtaatgtctgtgcgaccgactacgcaagcgagcacatccgatacattaatatgaagaggaatccatactttggcagccaaatcattatccatcgtccaagccagtggcatatcagcagtccatgcctgtaattgctccaattgggtcgatgtgccaaactggaaccgtacttctcgacctgtcccccaacgcgccttcagatcctccagaccaccatcataaatgatatttccatcatccagcataatgacgcgcgagcacagcgcttcaatatcctgcaaatcatgggtcgtcagcaaaatagtcgtaccgtgatcccggttcatgtccttcagaaactcacgaatttcggatttcaccataatatcaagcccaatggtcggctcgtccagaaaaacaatagacggattgtgcagcaaggcagctaccagttcacagcgcatccgttgcccgagactaagcttgcgtaccgggcggcttagcagatcctgcaattgcagcctctctaccagctcatccagcctacgtttgaagtccgtagccggaacctgatatactttccgcagcagttgaaaagactcgatcacaccgatgtcccaccaaagctgactgcgctgaccgaacacaacgccaatgttgcctacaaatttctcgcgttcctcataggggacataaccgcccaccttgagatgtcccgatgtcggcacgagaatacctgtcagcatcttaatcgtggtggactttccggcgccattctcaccgatataaccgcatatttctccttgcggaatacggaaagatatatctttgaccgcggctacctcgttgtattctcgggcgaataaatcaaggaaggcaccctttaagccctcgcgatttttttgaaccttaaatgttttgcgcagatcctgcacatcaattgccagcatgttatacctctcaatcaggatttgtaaaatccatagttaaattgattgtgctccaaaaagaaattataatgtaatgaactgaaaagcgaaagggagagcatccatgacaagcagaaccaaaaggacgatatggtcggttctagccgtggtaatcgtcgcgattgtcggctttgccgtgtactattttacatccatttataatcagctggataatctgcataaagagggcgctaactcccccttcaaaaatgtaaagcaggtcgatcaggttcgtacgccagaaccacccaagtgggaaggtaccgatatggttaacattttactgatgggtgtcgatgggcgcggtatccagaaaggggaagtcccccgatcagacagcatgatggttgtatcactggaccccgttaagaaaaaaatccacctgttctctattttgcgtgatacgtacgtggatattcccggctatggaaaaaatcgaattaacaccgccattactcacggacccaacacggccatgaagacggctggcgatctgttaggcatcccggtgcaatattatgtctacacggatttccagggctttatcaaactggtggatgccgtaggcgggattgattttgaagtggaaaaggatatgcattatacaagtaatgcggataaacatcagtacgatattgatttgaaaaagggcatgcagcatctagatggcaacacggcgcttcaatatgtgcggttccgccacgatgcaatgtccgatttctcccgttccggacggcaacgggcattcttggaggccgtagcccagaaaatgcagaccacgacttccatcgctaacttgccgaatattttagagcaggttaacccgtacatcgatacgaatctcagtgttaacgatatgtggaagctggcaaatgtggggtaccaaagcaactttgcaggcagcgagcaggttccaccgatgaagatgctcggagaagagaatgtgggcggcgcggcagttcttactgtccgcgatccagaagaactgaaaacgtatgtgcaggatatatttaataatccacccacacaaacacaggaacaaaacaaggatcagaacgaaacgaaacagccagacagtgcatcgtctaccaagaaggataaagcttcttttacagggggcagtaaaaccagtaatgaggatgcttccacacaatcaacaacaaagacaggtcaaaaagagctataatgatgtatgcaggggcagccgtgaacgctgccctttggcgtgtgtataccctattttaatgaacggaaaggaagtttttgatgatgaaacgggaaaactccgaagcactatataaagaagccctggagcatattgtcgggggcgttaacagcccttcacgctcctttaaagctgtgggcggcggcgctccagtattcatgaaacgcgctaaaggtgctcatttctgggatgaggatgataatcgatatatcgactatttggcggcttatggccctattattaccggacacgcccatccccatattaccaaggccatcagcgaagcggctgcgaacggcgtattgtacggaacctcaacagtcttggaaattaaactggccaagatgctgaaggaagcaattccttctatggacaaggtccggtttgtgaattccggcacagaagcagtcatgacgacgattcgtgtggcacgggcctatactgggcggaacaagatcatcaaattcgccggctgctaccacggtcactcggatctggtacttgtagccgcaggctcaggcccttccacgctgggcataccggacagcgcaggcattacgaccaacattgcgagcgaagttattaccgtgccattcaatgatctcgacgcgttgcgccaagcattggagcgttggagcgacgatgtggcggcagtcatggttgagccgattgtcggtaatttcggcatggttatgccgcagcccggttatttggaagggttatgctcgatggcgcgtgcgaacggctcactcgtcatttatgacgaggtcattaccgcattccgattccacttcggttccacccaaacgtatgcaggtttggacaaccatgatgcgattcagccagatttgaccgctctgggcaaaatcatgggtgggggtctgccgattggtgcctacggcggcagcaaacacatcatggagcaggttgccccacttggcccggcttatcaggcgggcacgatggcgggcaacccggcgtccatctcgtcaggcatcgcctgccttgaagtccttcaaggggaaggcgtgtacgaagagatggaacgtctggccgtgagactgacggacggtattcagtcctctgccgaacgctacggcgtgccattgacgatcaaccgtattcgtggagcgttctcgacgcatttctgtgatcatccgatcacgaattacgcacaggcgcaggatacggatagcgaagcgttcgcatccttcttccgtcacatgctggatcgcggtattcatctggcgccatccaagtacgaagcctggttcctcacaacagcgcataccgacgaagatgtggatgctacgctggaagcggcggacgattcgttccgggcgatgtcacagggtaagtaaacccagcagtaagtgatagaatatgaattttgataagagctggaagtagtcttagggaagggtattcgacctctgggacttcgttccggctttttttatttgacaactgtacccgtacagttgcagattttatggattgtatcaggtgatgccatccgggtatattgagagaacaacaggttaaggtcatgattacggaggtttattatgcacagtcgttccagaaatggagccgcctatctggcagctctcagctatgcagctatacttggattttcatttttatttgtaaaattgacagtcacagaggcgagcccgctggatgtgattgcccatcgctttgcgctgtcatttatcgctttgaccgttccagtgctgctcggttggattaagctcaacatcaagttacgtgacatttcgcgcattttaccactagcactgctctcccctttagtgtattttccactacaagccttcgggctgatgagcacttcttcatcggaaggtggaattattcaagcaaccgttcctatttttacgttgctgttagcttcctattttattaaagagcgtacaacggtagtccaaaaaatttccttactgctgtctgtctttggcgtggtttttatatttgtgatgaaaagcggagcaccactagcgtccaatagctatggaggtattcttctactcgtgctctctgcgatatgcctatccggctataatgtgctggcacgacccttaacacaaaagtacagccccatggaattgacctacgttacctctattttgggatgtatcgtttttaacgtggtggcactaggataccatgccatagacggctccatgagcgcctataccgctccactggtgaagcctggttattggatggcactgatttatctgggcattctgtctaccctcgtcacctcgctgttatcgagctttgccttgaagtggatcgaagcctccaaaatgagtgtgatcggtaatttatccaccctcatttccatgattgccggtgcttacattttgaaggagcagctcgcctactatcacattgttggggctgtgatgatcattatcggcgtgctgggtaccaatttcggagggcgaaaaaacttcacgccgatcaaaacaacttcggcaaaatcacaaaaaacgggctaaaaatagacactcatttgcctgcaaaaaaagaaatctcccagctgcacaattgcagccgagagatttcttttttcacttcttagtcttcgtcggattaaataggatacgccatgacactcattaatgccaattccggctgtgtcgtgtccaatctgctatattgtacgatgatgggcacatcgctagtgaccgtaattgcgtaaggaatgcctgtcggaatccgttcgccggatttctccaacgaggctgttcggatatgacgggttcgtcttccttccaccacctcgatcaatccctccaatggctcgcggtcttcaaaatagatgtctatacttagatttgccacacggctcccacaattcagcacacatatactctcatgactgagcagctctccccggctttccggtggaatatacccatcggggatgacccagaatcggctgcctcgcggctgattagccaccttttcctgagaaagttcagcatttcccatactattggcctcctttacccatcatactttttggcgcttatgccccttcttctagccgtacggattctccttggtacgcaacagttgagccagaaaagcaagcgccaatccctgaccccagccctgaaggcgtttgtacggaacgttacgatagccgtcaatatcgttcatcacagcagttccagcggatacccccgttactgtgccgtcgtccttaatgcgggaaagaataccgtcgatcgccttttgggtgtatttgttaaacaatcttccttgcataagcaaggcagtcgcaattccagccgagcccgaggtttccagataagaggtatcatcgttcagcaccgtatgccacagcccttctggggattgcagccgcaccagtgcattgagctggtcacgcagcgagccatcgatgatcatataagatggatgctgcacctccaccaatttcagcgcttttgccatcgtgagggctgcccatgaattgccgcgcgcccaatatattcctgacatccggctttggttcgcatgatcccatccgtgataatacagattcgtatccgggtcctgcaaaaattcttcatgcccgtgatattgacgaactccatcctcccaatactccttgttccctagcagatgaccgatacgaagcaaataataaccggccataaacatcgtatccacccatgcttgctgcggaaatacatcatgaagtgaattcaccgtatgctggaaaatgccgtcggcaaaccgctccgctttttgggccaaaaattctgccatctcgatggcaatatcaaggtatttttgctcacctgtggcctgataaagcgtcaacaaacagtgcccgacagaaacgccgttcaccgagagagatggaagtccatcctcgatattttcgtcaacccattctttcagcttagtcaaatacttttcgttccctgtcgcttcatacgcttcgcatactccgtaaaaggcgactccgcccggccaatcccagctgtagtgcatttgaaaggtgcgttctacgacccggtcgatcacctgcttaacttgttcttcatcaaaaatcaatgcaggcatttccacgtctccccctttggtaagtttcacgtgagttacctccttgacgcccgtacatgaaaaggtcgtccttcaacgtaaatacatgcgcagcggttgcaaatccagttccttcacagcatccaccaccatgtctgcaatacgaaccgcgccattctcatgaaaatgcgtgttatcctctaagccgctggaaaagttcatgtattcaccaggcagcagccacataaaaagctctttactctcttcgggacctagctgctcatataactcctgcgtgcgggcagacaaatcaattagcggcacattcgcttcttccgccagctcacgaaccgctgttacatagtcaccatgtgtgtcggatagcgtaccatcctcgttaaaatagcggcgatgtacaggcgtgaccagcaccggggttgccccatggcttcttgcgacgtcgatgtagaggcgaagatgctccttgtaggttgtaaaaggctctgtagcccgctctggatcaggcttctgatcattatggccgaattgaatgaacaggaagtctcctgcctttatttcgcccaaaatgacacccaaccgtccttcgtccacgaagcttttggagcttcgtcccgatacggcatgattatccacgcagacatcatgcttgaacagggcgggcaaagcctggccccagccagtatacggatagccggatgcgtcctgatccgtaaccgtggaatctccggctaggaatagccggagggtctgtggcgctggcgcaatctccagcgcattgagccgtggcgcggtgcctgacacggtgaggcgtagtttgccaccccggacaggcaccgcaaacagtgcttcggtgaactgacccggcagcgtgtgtactgggggcagcatgtgcttgccttcaccagccttgaatcgcgtgagcgtttccgcctgcgaatcgccgaccagtatagtgacgagatatatcccgtctggcacatctgcaacaaatgcagcgttcagtggaatacaaaagctgcttcgtagccgcgtgcgtgcatccttggctgcactctgcctttttcgaccgtacacatgctccgtagcctcgaagccatagccctgttcagttgtatataagcaatccggagacactcccttgtagccatccgcaggctctcccggaccaaaatcaaacttccacaatgtactcacctctcagccatcgccctcaaatcccgtccattcaatcgtacaaacccggatgccttccatttccactcgtaagcttcatatcctcacgttatggattttggatcttaccccttcaaaccactcgtactcattccttctacaatttgcttctggaatgcgaagaatacagcgataactggaagcaggcttaggatagacatcgcgaacattcctccccagttggaagccgactcgctgtcgaggaacatcttgagtgcaatagatacggtatatttctccggcgaattcagatacagtaccggaccaagcaaatcctcccacttccagtagaaagagaagattgccgctgtagccaacgacgatttgagtaagggtaaaataattctgaaatacagccggaacttgccgcatccgtcaatcgtcgccgcttcatccaactctgctggaatcgtccgtataaactgcaccatcaggaagatgaagaacggcatcccgaaaaaggagggtaccaccaacggtaagatcgtattgatccaaccgagcttggtgaaaataatatattgcggtaccagtaccacatcccctggtagcataagtgtcaccatcatcaaagcaaaccacaagttacgccctttgaatttcaagcgtgcaaagccaaatgcgatcaaagaggaggaaagcacagctccaatcgttgaaatcaccacgatcgtgagcgagtttagaatgtacgtgccaaagttgtagccagttgtccctttccagcctgttacatagttttgccagatccattcagtagggaaaagcgaggaggccgtgacgaatatcgtccgactttctttaaacgagctgaacagcatccaaaaaacgggatacagcatcaggagcgccagtgcagcaaccagtatgtgataaattggccatttgaccgttttccatgccatcggtatcagcgccccttttccgtctcataaaatacccagtatctggaggttaaaaataaaatcgctgtcagtatcccaatcataatgagcatgacccaagccatggctgccgcatatcccatgttgctgaacataaacgcctgccggaacaggtacagtgaatgcagcatcgttccatccatcgggcctccttcacccttagaaataacataagccgggacgaaggtcataaaggcgctgatcgtctgcataatcagattaaatagaataatggggctaagcaacggcagcgtaatactgaaaaattttcgtactggcttagcgccatctacactggacgcctcgtacaattcaacaggaatgttctttaaacctgccagaaaaatcagcatggaggagccaaattgccatacggacagggtgatcagcatcgtaagcgaagcatccggatcaccaaaccatttcaccggagtcgcccctaaggtcgaaagcaagctgttcactatgccgttattactgaaaatgttccgccacataatggataccgcaacgctacctccgataatcgacggcagatagtacatcgtccgataggtgccgaccatgcgcgatttggtattcaaaatcatagccacaaacaacgcgaaaatcagtcgcaacggtacaccgaccagcacatacgtaaacgtgaccctgattgaattccagtatttcgggtcgcctgtgaacattttttcgaagttacccagaccaatccatttgggcggggtgaacaggttgtaggtggtaaaggacagatacagcgaaataaacattggaattaacgtaaacgccagaaagcccacaataaacgggctgataaacgcatatccagtcatattggctttcaagctctgatgatttcgcaagctcatcaagcctcccttctgttgcatttaaagaattagtaaaactttatagtgttaataatccgttgttatatgaatattattgtgatgtctgcaaagggtgcttatgcagttggttcgtcgaatcaaccgtgcgcaatcatgctttggactacgcacggttaacttaacgaaacgttccttggatcttgtcgttcttatactaaaacgatgtcagatatcctaaaggtctcattgcgctcattattgcttgttattcgcaaggatagtattcgcatcagcccggaatttggtcgctgcgtcttcagccgtcatctgtccgaaattgacctgctcaatataatcggtcagagtcgcaatcacttccggcgatccgactggtggcggcgggctcattggagaagccttcggctccatggaagctacaaattcaaacacctgcttcgtaggctcgtttaactctggcgcaacagcctccttgattttggaggaaatcggcacgccccgttcgcctttaatcaatttattcgcttctacatcattcatccagaaatcaataaactttgcggcctcatccttcacctgtgaacgggaagcaaccgtccagtacatcgtaggctgcatatatacgcctttttccatattcggcccaaacattggagccagtgccattgggcggttaacaacctgctgcaagcccacatactgattggaccactgccaaataccgatgcctgttccttttacgatatcggattcctcaagaatccccttggtctggttcataatttcaggaggtggggtcgctcccttcttaatcagatcagccaatccgctgaagaagtcaacaaacagcttatcatcgtcataccccaatcctgttccttccgcattgtagagagtctttccttgcgtacgcaaatagtagtggaagaaaatatcagcagccatcgagctgtcaaagtatactttattggaaccagcctttaaagccagttctttgtattgatcccatgtccagttgtcagggattttgtctatacccgcttttttgagcaacgccgggtcatactggaaacccagaacattgacaccggttggaataccatattgctttccggcaattacgccggttttgagtacattttcggtcacatcagcgacctgaattttttgattcaagtaaggcgcgagatcctccagttgaccatttttcgcatattggctaatgtacgaaatgtccatttgcacgatatccggcaactgattagccgcagcctgcggggcgagctttttccaatagtcatcaaaagaggcatattccacatcaatcgttacatttggatttttctgcttatacaaatcaacgaccttttgcgtgtattcatgacgcgtatccgatccccaccaagcgatccgtaactttactttcccgtctgcacttgtgcccgaattgctgccgccgtccgctccgctacatgccgtcgtcaaaacgagcagcatagctatgatcagaaaccatccctttttgcccacctatctctccccttttcgttgttctagaaaggagccaaatcacgagtgacaacgcatttacgcaattttgatagcgtttacattagctcctgttgttattttcccaaaagcagagaaacattggaatacacaaatcaggtttcctaggtttaaaaaacagtggggccatcagctcatccccgttcatgtgatttaatatactcggaaggcgtcatacccgcccactttttgaacacctggctaaaatattgcgcgttcccaccgaagccgaaccattccgccagttcaaataccttcacgtccccggtctctcgaatatgctcagccgcacgttcgatccgataacgattgacgtagtgtgaaaagttttcacctgtcacttttttgaaaatttttcctaagtagtcggaattcatatacagcatttgacctgccactccgttcagcgacaaatcggattttctgtagttttgctcaataatagtgatcattttatcaacggtggaagattggcgatacacattacttttataatagattgcggtcattcgttcggcagcttcctgtacaaaagatttgagacatgccagcgttttttgctctgccagcaccaccattcggctcgtaaatgccgcacgctcttcttcagggcatatacggatcatagcagcatagagctgaagcacataggagcgggtcacggaaatttccagcttcatccgggacaaaataccgaacaaccgatccacttcctgtgccacctccaccgtatttccagccttgattagcagaccgaacttctcctcgtccagctccaaatctgccatctcccgggtatcctcagccgctaaatcctccttcgtaatcaaactgccctccccggtgtaaaaacggtgattcatacaatgcagtgtctcccggtacatcccccgtgaatgctgcatactatccgactcactaactgcgactgttacctccagcttgtaaaagcgatgaaatgtcgcacgtaccgcttcaatctgtttcataaaccgtgacgtgtcatcctcctcactttccagcacgatgagcaattgcccctgcatggtcgtactgagcaagacatcatccatcaaatctgccgctatattttgcaatgcaaacaaatgctccggctcatgggattcctccacccgcagcagcagcattcgaacctgcttatcttgcaattcaattccgaataatcgctcataaaatgcgatatcacggctaccgtaagttttataggaaataaactccttcaaaaagtgttccttcacatgaggcagcatacgctgaaaatctagcttcatccggtttacaaactgcttgcgttcttcctgctcctcccgctcctgccccaactcggtcagagcctcatgaatttgccgctcattacatggcttcaacaagtagtgcttcaccccgtattgcatggcccgacaggcataatcaaaatctttgtaaccagacaacagaatgaaacggacgtctggaaaatgctccgtcgttttggcaaccagtccgatgccgtccaatccaggcatagagatgtcgctaatcacaaaatcaggcgggctggcctgaatctgatcataagcctcaatcccgttacgtgccgtaccaaccaatctcgttcccgctttcccccaatcaaccacctgtgatatgccttccaaaatcatacgctcatcatcaaccagtagcaccttgtacacgaccctgatcccctttcacatatggaatacagacatgaatcgacgttcctgttcctgactcgctatgcagctctatcccccaaggtgtaccaaatgtcaggttaatccgttcctgaatattcgtaagtccaatgccctgcccacgagtcatgacctgcccgctccgcagctttcccaagaaatccggcgtcattccgggtccgtcatcttcaactcgcagaaataaagccccctcgctttctctcgcaataatagcaatccgacagggttcaattcgcggctccaacgcataatgaatggcattctccaccaagggctgaagcgttagcttcggaatttgtgcatccatcagttcttccgggacatccagatggaagacgagacgttcatcaaaacgtgttttttgaatcgttacgtagctccttacaatatccagttcttttcgaagcggaatcagctgctcttcaaaactgaccgcactacgcaatagaaaagcaagtgcttccaccatctctgaaatccgatcctgcttattggccttggcgagccagttcacggattccagcgtgttgtataaaaagtgtggattaatctgtgcctgtagtgcctttagctctgtttcccgcagtaatagctgcttggcaacattctcattaatgagctcacgaatgcggcgaatcattttcttatatgtccgatgtaacaagcctacctcatcctgtgtggaaagggggacggcgccaagtgcttcttcttccaaacggtcgagatcacctttttctattttacgcatgttctggattaattgaacaatcggtttggtaatgctccctgacaacctagcccccagtgccaatgcgataagaagcataattacaaaaatagcgcttacaacttctttaatgatcgtaatactgcgaaacatatcatcgaagggggtcatatgcaaatacgtccaccccgtataagaggatttgatttgagcagcgaaaaaggtccctcctgagtaggtcgcaatcccgtaaggctgctttcggccaagctccgcctggatatcactctcactcaaaagtggtgtttcgggataaatcatccgtcttccatctgtaatcatcagttgtccgtcacggccggaggtctgcacacgatccgctacaatccggtcaattctcacacgaatcgcaagcgttccgagcccattcagtgtaaaattggaatcggtaaaggatttgaactgccgagctgccagcaaggaggaatgacctgccgcataccatgcattggaaccgtcatgttcgtctgccagctccgacagggtggatcgaagctcctggggaataccttcgcggttgcccgcgctcatgacctgtccctctttatcgattactatcatagaatagacataggtctcagagccggcaaaggcgacgagcctattcgttatttttttacgaagcaccattttggtataaggtgacgtttccttttccaattgcagcaaataacgttgaagctgctcgtccgttgttaccttgaaagtaactttttccacatccttcagctcattttctatgccgattgaagaaatattgagtacttcggatgtttttttgtacatttgattatcataaatatgaaatacgtacttaagtatgactgcaacaactgcaaaattaaccagcataagcaccgtaatcagcagtaccattttatgatggattccagcatttttgtaagcgcttttaaagtaggtaatcagtgaatgtcgcctccttcgctcatcctgcccggtccagcccaaaatggagaaaactctacatatcatacaaaataccccatgccttggtcattcggcaagaggtatttgtatttgcttagcgttgatcggttggtttcgatttgtccgccttgctcatatattcgtcgtatcggtcatcaagttcccgtgccatactccggtatttacgcgtctcttcaacaatgggatcgatatgagtctgaacccgcacctcatatttaggactgagtctttcccgcttctgggcctcattctcacgaatttcgccttccgtcagcagttcactgagctggcgttccaattcttcggattggctcatcgagatttcctccttcaggatgatgttctacgtagaattataacccggttgcgtctgcttctttcagcacttgaataagttgagaatgaatagctgtattcgtcgctgcaatatgccgcacactcaggtcataaggtctgcccaatgtatcggtaatggtgccgcctgattcctgtaccagcaaagcgcccgctgccacatcccacgcattcaaaccaatttcgcaataggccgacagccgtcctgatgctacataagccagatgcaatgctgccgagcccagcgcccgaatgccgcgtacctgaggtgtaagaacctgcgtaattttcatatttagcggttgtgcatacgtacgatccggcgggaagccgacgcacaccagactatctcccagtgtttcttctctcgatgcttgcatgcgattgccatgtacatatgcgccttttcctttttccgctacaaacatttcatcacgggacggatcataaataaccccgacaatcacctctccacgatgggccaatgcaatagacacactgtaatacggcagactgtgtacaaaattggtagtcccatctaccggatcaataatccatagatattcctcttcgcgggcagcctctaatgcgcgggccgaagcttcggctcccggctctacaccctcttcacccaaaatagcatgatcgggaaaatgggtcagaatcagtctgcgaatcatttgctctgcacctttatctacctcagtcactagatccgtaggagactgtttggtattcaaatgttcaacagttcccagcctgctcttaatccattccccggctttggatgccgcgttaatagccacggcagtatagctttttcctgatacgatatagggaaccttttcgttttcattttcgttcaacgtgttcactctactttctatatcattgttacgtggtttacgaatctgccctacagcacagtctcttaaccatctctgtttcagtacaagtttgctagtttacacattctagtatacacaataatctgcataaagtttctctaaatgggagctttatccgtaaaatgctactttctaaggcataatttctacggaagctccatccagcactttaaccccattagcttcctgaaggcgcagttcattcatcaacccgaataacgcttcatccttaagtttggcttcaagcatgacatcaatccgatccgtatatccggcaatattgcgcaaaaaggtaagcaacggctccacttgaacaccgtccgcatggccccgaggatctttttcacttttggggctggacgcatggattttgggcggcaatggatgatccacagaagatccggcttgggccaattcccctttccaggtatccaaaatatccggccatagctcccacggcttctccccctcattattcacccattgatgatgaatatcgagaaccatcggcaatcccgtcaacttgcaagcctccagcgtttccaccgcattgaatgttttatcatcattttccagcgttaaccgttctcttaacgaaagatccagagcactaacctgctctacaaaacgctggcctgaggtcaccttatctccgtatgcaccaccaatatgaatgttgttcttggcttcggcaccgagccccatggcctccagcatcgctttgtggtacttcaagtcattaatggagctctccaacacctcaggacggggagtgcttaacactgtaaaatgatcggggtgaaacgataccctcatcctattcgccctgacatagttcccaacctcagcaaagtcagcagcaagcgcctgaaaagggtcccaatcccgcagatcctgatgggtcgcgagcggaatcagcttggatgagaaacgatagacctggatatcactcgcgcgattatggcgcagcagcctcaaagtattatggagattttcggctgctatccgttctagcttgcggattgcagcttctcggtctccaatcttgttaaagctgctcaatgtcatggttttagagggggatgcattttgaacggtaaccgacatggctacataaccgaaccttacgatcatagagtgtcttcctttcagcagtcgcagtagatgataaggtcgctttggttcagtgacctaaaccccttttctactgatcatacccggaaatgcacctgctgattcggtgttatcgcacaaattgcaagaagaaaacagctaggattgctgctgtgctccaaaaaacatttcatccgccaatgcggtctgaattcttgattcctcatcattcagcttacgaatgaggatcatttcaacttcggtcacttcatcgccttggaaattaatttcggcgatacagcccataatctgcacgatggctactgccacgttgtccacgttgtaagcgatgaccttctggcctgtcggaaacacgcgcagcccggatttaaccattttgccacgtccgtattccagcagttcgtatagttcttgttcgctcttgaatttgcacacggagttaaattcagtttgaaagcccatgtgtagccgccacctttcatcattaagggtttagtgaaatgctcaagtatgtgccatatatatgaacaaaaaggagagtgatcagctcccctttgtttcgtttatgagttctcgtagtgcagtgcggatctgcgctcataacgctccagtgcaagagcaatcatgcggtccagcagacttgcataggatacgccagtttctctccacagcaatggatacatactgaacggtgtaaagccaggcattgtattcacttcattaataaggatatgtccgtccgagcgtctgacgaagaaatcggcacgggaaatcccgcagccttccagagcgcggaatgcttgcaatgcggcttcacgaatacgatctgccacttcctcatccaacggtgccggaatgagcatttccgattggccatccgtatatttggcagcgtaatcgtaataatcactcgacgatacaatttcacccggtaccgaggcaatcggctcatcattgccaagtacgctgacctcaatctcacgggcatcgacgtactcctcgacaatcacctttaggtcaaattgcaaagccagatctacagccttttccagctcttctcggttactggctttggaaatacccacactggatcccagattggccggtttgacaaagcaaggataacctagctcggtttccatgttacgtaccagatcatgactagtttgggcccactgtgtactattaaaataacagtatttcacttgcggcaatcctgcatgctcaaacagcttcttcatgacgcctttatccatacctgctgccgaagccagcactcctgcaccgacataaggcatatccgccatttcgaacagaccctgaatcgttccgtcctcgccaaaggtaccgtgcagcaacggaaacagcacatccagcgtctgctctccgtacagcttgccgaacaatgtatctaatgccgccttggtgccgccctctgcgcgttccagcttcaattgctctacagaagccagaggagcgcttaatagcgcccctctacgccaatcgccagccttcgtaatataaaaaggaataatctcgtatttctcatagttaaaagcgttcattaccgcatacgccgtttgcagcgaaacctcatgttcgcccgatttgccaccgtacactagccctacggtcaatttttgatttgccatgcctatcctccgctttcctgctttcgtcattgtgactgatttgcatcactgtacctgttatccaccatctcatttaaaaatagtcggcgatgtgataaaagcgatataccgtgttgtccgtccacgcatacgaatttttatagtcccaataacgatgtctggagcttaccgtatgtgcattgactagcggcatgccgcccgcatcaaaggccgtgaccaccgtgctgtgctggaaggttccgtcaccatcccaatcgtaaaaaatgacgtcccccaacatgagctgctctgggcgactcacctgctcagcggtcaacccccatgagctggagcccaaataccgctccagactgttggaaactgcccaactgtagctccacagctcatttccggcgacccgtcctttataccaccagcccgattctcttttaccagtatagtggatcggtgctccccctgcaaagaggcattgcgagatataattggtgcaatccacatcaaaaccttcaaactccggattgaagctatcccaccactgatctgcataggccgctgcttcttcgcggcgatatcggctgggacgtgctgatgagccgaagcccagcacaccgcgattcagcagcggcagatttcctccttgattaaacgaagcctgttcaaaaggaacctctccccccgctggcttcctttctgccggatcgcgctcaattctcgctacctgccaggcttcgccctcgcgtgtgaacgtcagacgctcccgttcgatccgatcctcccggtgagtcatcccacccttctcataaaagagtcggacatgcagttgtacatctaccacagcctcatccggggtatcctgcaccattcgtagcggcttggcgcgtgtctcgctgcgtaggggaacagcatcccgttcgttgtaccactgctccaatctggccgcacgtgctgcccgttccatccgctgacccacctccagatactcatccggctgcggtacaccattcacttcactgcgattgtattgattcacgtaagcaaaaagggcctgtttccattcccgctcccccatcccaatccctccatattcgtcccgctatccttttccggggataaccggaatgatgaataacttcctttcttgcctctctggtctgaaatgctctctatctataagtatgaatctctaaagcttggtatgaacatcgaaacgcgagggagcggaacgttttattttccaatctgcaacgcatcatttaggccaaaaaaactttacggaaccgtctgaaaacggtatacttaatccaaaagcaatcattttgaaatcatgtttcatctaatgaaacaaattacattcatctcaacctctaacacgttatgaagcactgaagatgtaattgagaacgcaaccaatttaaaccaactgtgcaagacgtcgaaaaaacgacatccctattttcccccaagcatccacttcaaggaggtaatacttatgtcaggaaaagatcaattctccatcgcccgtagtctggaagttaacgggaagccttatcgctactacagtcttaaggcactggaggaacaaggaaaaagcggtatcgccaagctgcctttctccattaaagtattgctggaagccgctgttcgacagtttgacggtcgcgccattacggaagaacatgtgcaacagctgacaggctgggctgaagatcgggacaccaacaaggagattccgttcattcctgcacgcatcgtgctacaggattttaccggtgtcccggtggttgtcgatttggcagctatgcgtgatacggtgaaaaaagcaggcggggacccgaagcaaatcaatccgctcgttcccgtcgatctcgttatcgatcactcggtcatggtcgatgcttttggtaccagtgatgcgctggattacaatattaatgtagagtttgaacggaacgaggagcggtaccgttttctgcgttgggcgcaaacggcgttcaacaacttccgggccgttccgccatccaccggtatcgtccatcaggtcaatctggagtatctcgcctccgttgccgctaccaaaaccattgacggtgaaacggtcgtctttccagattccctcgtaggaacagactcccataccacgatgattaacgggctgggtgttgtaggctggggtgtcggcgggattgaagcagaggcgggtatgctggggcagccgctgtattttgtcactcccgatgtgatcggcttcaaactgacaggcagcctgtcggaaggctctactgccaccgatctggcgctcactgttacgcaaatgctgcgtaaaaaaggcgtagtcggcaaattcgtggaattttacgggcctggtctggcaaacatcagcttggctgaccgtgcgacggttgccaacatggcaccggaatacggcgcaacgattggcttcttcccggtcgatgcggaaacgctagcctacctgcgcagcaccggacgttccgatgagcaagtaagcctcgtagaggaatattacaaagcccaaggcatgttccgcacatccgatacaccggaccctgtgttcagcgatacgattgagcttgatctggcatcggtagtaccgagtctcgccggacccaaacgtccgcaggaccgtgttgagcttagtcgcatgaaggaaacgtttgaaggcattatccgtaccccggtggacaagggcggctatggactgagcgatgaaaaaatcgcacagaaaattccgctgacccatccggacggctccaccagcgagttgggtacaggagcagtcgttattgcggcgatcacaagctgcacgaatacctccaatccaagcgttatgctcggtgcaggcttgctggccaaaaaagcagtacagcgcgggctcaaaaagccaggctatgttaaaacaagcttgacaccaggctccctcgtcgtgacggaatacctgcaaaaagccggattaatcggaccgctcgaagccctcggtttccatgtagctggctacggctgcgcaacctgtattggtaactccggcccacttcctgacgaagtgagtcaagccatcacagaccatgatttgacggttggcgcagttatttccggcaaccggaactttgaaggccgtgtgcacgcgcaggtcaaagccaactatctcggctcaccgccactggtcgtcgcttatgcgctggcaggcacagtgaacattgatttggtgaatgatcctctcggttacgatcaggacaatcaaccagtctacctgaaagacatctggcctacttccgaggaaatcaaggaagccatcagcctgtctctcagcccggatatgttccgtcgcaaatacgaaaatgtatttactgccaacgaaaaatggaattccattccggttcctgaaggcgaactgtatgaatgggatgaaaactcaacttatattcaaaatccgccgttctttgaaggacttcaggatggcgtacaagatatcaaggaaatccgtaatgcccgtgtgcttgccctgttgaatgattcggtcacgacggaccatatctcaccagcaggcaacattgcccctgccagcccggcaggactgtatttgaaggagcatggcgtggaacgcaaggacttcaactcctacggctcccgtcgcggtaaccacgaggtcatgatgcgcggtacattcgccaacatccgtatccgcaacaatgtggctccaggcaccgagggcggcgtgaccaaatacttgccaacggatgaggaaatgtccatctatgatgcatccatgaaatatcaggcagccgatcagaacctgatcgtcattgctggtaaggaatacggcacaggcagctctcgtgactgggcggccaaaggtacgctactgctgggcgttaaggctgtcattgccgaaagcttcgagcggattcaccgcagtaacctagtcggcatgggtgtactgcctctgcaattccaggagggctatggctggtctagcctgggtctgaacggtcgtgaaacgtttgacattcttggcatcgacaatgacgtgaagcctggtcaagagcttacagtggtggctaaacgcgaggatggcacaaagttcgaattcccggtaattgcccgtctagacagcaccgtcgatatcgactactaccacaacggtggtattctgcaaaccgtattgcgtcagatgattcaagcctaatattgtaacattatatatacagaacccccgagtgccgatttatctgcgattcgggggttctttttatcttgtttgagactctatcatcacaaaaaaagccgatccctcaggaccgacttcataccctattctcctataacctgaccttcgcacgcgagctacttcgaaatatccagaaaaccctctccgaacacgtcccgcacgtcatgaatggtaataaacgctgctgtgtcgatggctttcactatctttttaagcgctgacacctcttgtttactaatgacgatatacagcacttcttttggatttttagtgtaatagccgtggcctgacagcacggtaactccacgatccattttcgtaatgaccatctcggcaattttatcttggtgctccgaaatgatcatgaccgcttttttagggtttagtccttcgatcatgaagtccatcaccttcgtaccaacgtacaaaataacgatagttagcatcaatttttccggaccaataataaaataggaagagaatgcgacaatcaaatcaaaaaacagcaagccatagctgatattccaatccagatacttgttggcaatccgggctaaaatgaccgttcctgccgttgtgccacctacccgtacgattaagccaatgccgacccccaccaaaactccggcaaatacagcattaatcgtcggctcatgcgaatcaatccgccagttgaccgttaaatgtaaaaacagcgagttaaaagcgaccgcaattatagtgtacaaggtcgttctcttgtccaaaaatttatatccgacaatcagcagcaaaccattaatcaccagattgacgatcgagggagaccactgaaacaggtagtacaggatgatcgtgacccctgtaacgcccccctcgccaaattcattcgggatcacaaacagattaacagctagcgcgaaaaaaaacgctcccagaataataaatgcgatgtctgcaatactttttttcatatatgttctaatcctctctctaacatttcaaaggatgaatcgccagatggattggctgactcttgttgccaaaatacgctgacaaccagttcatggtatctactaccaaacataaagtcaatacaactttgacactttaattcgccaccagactgcctcaatcctgacttgaggattccgcaaaatcctccttttacaaggttattcgacaaaaaaacacaatcccgactactaaactaagaaaacgggcctctagcccttgttttagacctaggcacattttcccctaaaatgaccatcctcctaatccaaattttggacacatatgaccatcttcctgttttatgtcaaaagcgttttactttgagaaaatgtgggtataatgattgaaacattaccaagcaacctacacggtattacgacatcaagtacatacaaatagtcctatacagacgtcctaagcaactcaatctgaatttgacaatatggaattggaggaacgacctacatgaatacaatgaacttaaccgtccacaccctgatgccctttcaccaccaataccaacgtgccaacgcggtgagtatgcagaagaaagaagatagctcggagaagaagctcagctttcaggacattttgaatgaaaaaatgggtaaaaaataaggcgccgtttatccggttgaatgatcccactttacataagaagctaaaaagccgtagtttcctacattgactgtagagaaccacggcttttttaattcatacgttcctaaactcacacgttcgttttactgacctccatcccgatactgctctgccttctcacgcatcccgacagctactgcttcttgggtgttcagccccttatccgctgcataggcgcgaatgtcctgagtgatacgcatactacaaaatttagggccgcacatcgagcaaaaatgtgcttccttggcgccctctgccggtagcgtttcatcatggtaggacaaggcacgctcgggatcaagcgacagattgaactgatcccgccagcggaactcaaagcgcgccttggacaaagcatcatcccgctgctgcgctcgtggatgccccttcgccagatcggcagcatgtgccgcaattttgtaggtaatgacaccctcgcggacatcatccttattgggcagacccaaatgctccttaggcgtaacatagcacagcatggacgtcccgaaccaaccgatcatcgccgccccgatggctgaggtaatatgatcatatccgggggcaatatccgtcgtgagcggtcccaaggtatagaaaggagcttccttacaaatctccatttgtaaatccacattctctttgattttatgcatagggacatgtcccggcccttcaatcatgacctgaacatcatgcttccatgcgatttgcgttagctcgcccaacgtttccagctctgcaaactgtgcttcatcattcgcatcatagatactacctggacgtagaccatccccgagagaaaaggccacatcataggctttcataatttcgcaaatttcttcaaaatgtgtatacaaaaaattctcctgatggtgcgcaaggcaccaggctgccatgattgacccgcctcgggatacaattcccgtcattctattcgccgtcatcggaatataccgcagcaatacacccgcatgaattgtaaaatagtccactccctgttccgcctgctcaatcagcgtatcgcgatacaactcccacgtcagcgcttctgcttcaccgttcaccttttcaagtgcctgatacagcggcacagtcccaatcggtacaggagaattccgaatgatccattcacgtgttgtatggatattagggcctgtggacaggtccataaccgtatccgagccccaacgcacagcccaagtcattttctccacttcctcctcgatggaggaggtgaccgcagaattaccaatgttcgcattgatcttcacgtgaaaatgacgcccaatgaccattggctcactttccgggtgattgatattcgaaggcaaaatggctcgtccagccgccaattcctgccgtacaaactcaggctccaccccttcgcggatcgccgcaaattccatttcgggcgtaatgatcccttgccgcgcataatgcatttgcgtcagtgtacgcccttgcgaagcacgaagcggacgattggtcacgccgggaaattccactgtctcccgtttggagccaggtttcagtccattatcctccggcttgacggcgcgtccctcgtaagcctccacatcgccccgttccagtgcccaagctcgccgtaatggaggcaggccctgacggatatcgacctgataggctttgtcggtcatgggaccgcttgtatcatatacacgcaatggctcatgatgctccgtgccctgcggcgtatgtgtaggatgaagagcaatttcgcgctctggcacggcaatgtccggccgcgagccttgaatatataccttacggcttcctggaaagggcgttaccccactggcttgctccccgtttgtcttctctacctcaacttcttttgttccttctgcttctgtcggtttcattgtccattcctcccgtttcgatgaaatgacacaccgatccggaaccattcccagggtggcgctgatctatgcaaaaaagccggttccccagggaaccggctaatctaacgaggcagctgtccagacagtgcgcatatggaatatccattccaatgcgccactgaagacagcagccgcgtatacatttcaatggccgattacttccctacgctggtatgatccagatcaggtgcaaagggtccggaatcttgcacgattccatctcagcccggcattacaggctcccccagtaactgtgatacttctattcacatgaggcggatataacagacatccgccttccttaccagactacttcaaatttatggctttggcaacccttctaggtacccttttaccaagaagacactccctatcaaatcactctgcttgcttcaactgtgttcattcttgttacggaagcataagccccatttccttcgccgcttcgatcaaaatcggagcaaagtcatgtagcgtctcgggtgcaagtcgactgaccgggccggatacagataaagccgcagtgacctgtcccttccggttcacaattggcgctgccacagcagcagcccctggctcccgttcttcatagctggtcgcatagcccttctcgcgaatgtcctgcagctgggctttatagacctccgggtctactgagggcggccattcatccccgcttagcagggcttccagctcctgcggcggcataaaggccgccagcaccttgctggaggcccctacagccagcggcatacgcgcacctacaggcgcgaccctgcggatcgcctgattgctctgcacggcttgtatgcgaatacgcatactgccgtcccgtaagtacaagctgaccgtctcccccagacggtcacgtagtccttccattgcaggttgtaacagcaccgccggctcgtcactttgggacaaatgcgtggatagctcccaaatgcggaagccaagtcgatatttttccgtttcggcattccgaacgacaaagccccgatcctccaacgtagtcagcagccgatgaaccgtgcttttatgtagaccaattttggaggcaatctccgtcaggccaagatccgaatttgcggtaaaacacagcagtatatcaagtgcacgctctacagcgcgaacggttaatttacggtcttccatcgtgaaccgctcctcttgtatccatattcgtttcacactatgaaacatggttacataaattatatagaatagtcgcggctactgtaaaccgatgtttttgtgacaaccatattacagaacgagaacaaacatcgacaattctttgcatcatttttacttttccggttcaggcgttgactttggataatccccatcatacgataataggtatctatacggatctacactactattttcaagtggaattatacctatattctatgaaacgaagatcaattttatataaggaggctcttacatgatttcgacatcccagcgcaacgctcagctacagaccgctgttcaggagccgtccaccccactctttaatccccgtctgctgcggttcaagcacgttgtgatagctctgctgctgtcggtcgtcttttttctgttgttttgttttattgccttgcatgcttacatcgcatgggtacttacgaatcccaccgttgcaccactgtactctaatccgatgcaggccaaaagcatgccttatgaggaagtcagcttccctgccaaggatggtagccgcatggtacaaggctggtatatcccggcggatcaatcgcggaaaacgattattttcagccatggttatggggctaaccgcgaagaaagctggattcccatgtatgatctggcgcattatgcccacagtttgaactttaatgtggtcatgttcgattatggatttgcgtcacaaaacagcaaagcagtcgcaaccggaggcaaagcagaatcccaacagctcctcggagcaattcagcttgcgaagcaacgcggctcgtcggagattatcgtatggggcttctccatgggggcaggaaccgctcttcaggcgggcttgcaaaccaaggatgtggacgcaatgattttggacagcaccttcctgctggaaccggatacgctgtaccataacattcacaatcaaattaatctgccaagacatccgtctttggaaattctggagttgctgtttccaattttgaacggcaccagcttgcatcagattccatatcaggaggttaaaaaggaaaactacccgttcccgattatgtttgtgcatggtacacaggatgaaaaagctccttatcctattgcggaaaagctcgctgccaatcaaaccaacccgctttccagtgtatggattgttaaaaacgggatacatgagcttattttcagagagcaccctcgtgaatatttgcgacgggtatcgacgtttctaagcagtgtacaggagctggaggacaagaaaaccaccgctgatgcccacaaacaaacgaatacgaagtaaaaaattatttttcgaagaactatattctattcttccccttgaagaagcctgtctatggacacttaacccgtgccgtagctgggcttctttttcgtgttccatgggtattcattgttttagtaacagatgtgaccggattaagggagttcatagacatatttccgatgagacagtgaatatactgggtacgtatgcgtccagggcagatctgccagatcggccggatagccatagtgggatacgggaggtaaaaaacgatgctgagtacttatgggtctttcctgcccttacgtgtgctggaggaaattcggcattggaagcagcaggaaagttggcatgtggaagtgattaaatccgctaccgagggactagagcctacttatgtacggctgctggatgattggcggactgtattcgaacagacggaacgcaccgccatagagctgcttgaagagcaacggagcgcactcgatccggcagatcaggcgtggcatcaggagtggaaacagatgtcggctgctccacaagcacatacacacgaattcactgaacattcaaaacagtcaagaggattagacgcatcatcatctgtaaagatgccattgtcagagtcagcctcaaactctcagcttgactcacaagaattaaatcgtcgattagacgatttgctgcaaaccgcaaaccgtcagtcacaggagtatgtacgacagctcgggctgctaagcgagcacagtcatgcattgcgtcagcaaccaaaatccgccggagttgtattacacgcggcacatgaaagccaatatttcctgatctcgacaaccccctttcaggaacctggctccatcgcaagggctgctaggttgtatcatgtagctacagagggtgagaattacccagaggaagcgtttcgagaacggcaggcaggcataaggggagaaggcgcatggacgactaaaggcgtcaagtccagccaggcgcaaccttcggcaacggaaaaaacctcaatcggccggtcggttcctattgggggacatcggctaccgccgctcccttacccctataatgcgcttgaaccgtatattgatgagaaaacaatgcgtattcaccataacaagcatcatttgagctatgtgaatgacctgaataaagcggaaaagaaactggaagaagcccgaaaaacaggtgattttgacctcgtaaaacattgggaacgggaactggcattcaacggcgcaggccattatctgcatactcttttttggacgatcatgagtcctcaaggtggtggaaacccaagcggcccgctggctgaacagattaaaaaggattttggcagctacgaggcattcaaaaagcaattcagttcggcagccgaaaaggtcgagggtggcggctgggctatcctggtatggagtccacgcgcgggacgacttgaaattttgcaggccgaaaagcaccagaatctgactcaatgggagtccattccgctgctagcgctagatgtatgggaacatgcatattacttaaagcatcaggccgaacgcaacaaatacattgaagattggtggcatgtcgttaactggccagaggttgcagagcgctatacccaagcctccaaactgagatggcaacccttctaagcttctaagctaaagaaaaactacacctgcaaatcgtatcgctctctgagcgctgccatttgttcggtcaattcttccggttgtaccagccagccatcggcaggtaaaacggctgtccggctctcaacaacacggcgcagagatgccgtgtacgcctcaacagacggcactccagccagctctgccaggctacccattgttgctggattcacccgggggtaatcctgctgctgcacgcctgccgacgtgtccccggctgcctctgtgtagaactgctgcaccgcctgtgcacgctctacaccactgccctcaatcatcacgaaggctgtgatgatatacgccttggcttggcgccgctgtgcaatgccgcaaaacttgcggcctcggacgctgacatcgtaatccccgggacagaaggacccggggatttctccggtctgcgcctcgccagaccacggaaccagcgcatcggcaatgagcgctgccatgagccggaaatcctcatgcaggctgatggcccgctgtggattcggcaggatcaaggacaggttcagcacccccctgtccagcatgacggctgctccacccgaggggcgtacgcataccgaggttcccgcgctgcgcactcgctccatcgcctgcggggcgtagggaagcctgcggtcccggtgaccgatcacaagcgctgacggatgccgccaaagatgcaaaatgggtgcagctcctttccctacttgccgacaggccagctcctcccaagccagcggagacaaaacgtcctcctgagtggccgcgagtggcgcttcaaaccactgcaactcaggcaaagctgttgttttttctgttgatctatgtacattctccatacgttatcccctatctataaaaattactgttatccataggcaaatcgtaattttaaggcggctatcccgtcgtctctatttctgatgttaacaaaaaaagggggctacgcctatgcgtaaaccaccctttttttgttcatcacataaacgtcttgcgatgttcgatcaatccttgagcagcgacagaaattctgcgcgctgcgctgcatcatcacgaaacgtaccgcgtaccgcagatgttaccgttttgctaccaggctttttgacacctcttgcacacatgcacaggtgctcgccttccacgaccaccataaccccgtgagcggagaccgcttcatttaaaatatcagcgatctgtgatgtaatacgctcctgtacttgcaatcggcgggtcactgcctctaccaggcgtgcaagcttgctcagtcctacaattttgccgctgggtacatagccgatatgcacttttccgaagaaaggagccatatggtgttcacactggctgtaataaacgatgtccttcacgatcacaagctcctcgtgattctcgtcaaatgtcacacccagcgcatcccggggatcaacctcataacccgcaaatatttcctcatacatgcgcgcaacgcgtgccggtgtttccaataacccttcacgcttggggtcctcaccgatcagttgtaaaatctgctccacatggtactcgattttatcccggttatccgcagctttgcggttaatataatcttttacgccagccacagtaatcctcctctatgcagcaacctcatgcggcatccgtgctcacgttgctcattatttccgacggccctgatttttacgcggaccaggctgatttttggagaactgttggttcttcatcatctgctgggctttttgcatttgtttcccattcaggttgtaacccatctgtttggccattttttgcagcgtttcagggtcgttttgcatcttttcaagctgtttacgaagataataagcaccgatgaaaaatcccccaaccaaaccagcaatcagggtaataatcggaatgacaatattccacaccacgaagtcgtcacctctgtatatttatatgaaacatcttgaattacacacgaacctatcatagcaaaacatgggacagctagcaaatcactttttgcaaacatatgtccttattgtttctccaaatccagcagcttcgtcttgactggtaagcctccagcataaccgaccaaacttccgttagcacccgatacccggtgacatggaaacagaatgggtaacggatttttgttattggctccacccacagcacgtaccgccttggctcgtccgatcgattctgcaatatctttgtaggacacactttgtccgtacggaatattttgcaatgcacgccatacctgctcttgaaaaggagtgcctctcaaatcataggctatactgaattcccgtcgttctcccgcaaaatattcacgcagttgatccgcggcttcgcgcagcttttccggctcctgcacatagacatattccccaatccatgttcgggcccattgctgaagcagtgcttccttcgcatggaaaacgccatagtctattcggcacagcccccgatctgtagcgcacagcgtcaacgtgcccacaggtgtctccatctcatcataataaatggtggttgggccctgcgagtcctcggccgttacttctgattttgatgattcagacgccttttgctgttctgtctgctcttgttcctctagtttggaatgcgcttgcgcgatcatttcgcgtacttgctcatgttgttccttctctgatgcttgcttgatcgctgtcatagcgttttcccctcctattcgactcaaagcccacgccgccgtgcctcgcagctcgggacgtggatcatccaataaaacctccgttaatttgggcaccgcactgatatccttgaaattgcccagtccaatgaccgcattgcgttgaatgggcttcttcccccgccaagccgccgcactttgaccgaatcggtctttaaattcacggttgctcaaatccaataacggcagcagcaacggcttcacaatttcaggatcgggtgtaagctcgggatggtgatcccagttgagaccccgatttttggggcataccatttggcaggtatcacatccgtacagccgattccctatcttccgcataaactcctcatccagaaagcccttcgtttgcgtcaaaaaggacacacaccgctgggcattcagctgcccaggacccacaagcgcgcccgtaggacaggcatccaaacatttggtacactcgccgcaaccatccgttaccggttcatctggctggaaaggaatgttcgtcaacagctcacctagataaatccatgatcccagcgtcggtgaaatcatcatcgtatttttgccgctaaaaccaatccctgcgcgttccgcaacggctcgatccgacagttctccggtatccaccatgtttttcaatatggcatcaggcacccgctcacttataaaagcctcaagcttttccatcgcttcgcgtagtaccagatgataatctttcccccaggctgaacgcgccaaaatgccacggtacttccccttgtccgacttcggcgggtccttcattttagaagggtacgccaccgcaatagcaatcagagatgcaggctgtgagccatacagctccgggtagatccgcttatcaatatctggctcctcaaagccggattcatagcctttcgcacgatgctcttccaatatagctttcagagacagaaaggggtcagcggatgcgaacccgatggagtcgatacccagccctggagctgcctcaataatttcctgcttgagcgcagcccaagtcaaagcggttccggcagccgcctgagtcaatccgcgttgcatccgatactcacctctcttccactttttatcattacagatatgaggatttgcaaaattcccatacctcaaatttcaacagaaaatagcagcagatgctaccgtaaatttttaacagcactggtcgccagaaaatcacagcgattattcagttcgttgtcactgtgccccttaacctttacatattcaacctcatgcttacccatcagttcccacagttcttcccatagttccttgttctccactggctgatttttactgttgcgccagccattacgaagccaattcttaatccagccctgtttaaagcaattgacgacataggctgagtcactgtgtactttcacatggcaaggctccttgagcagctttagcgcttcaatcacggacttgatctccatacggttgtttgtcgtcattttctcggcacctgacagctccttacgatgctccccatacagcaaaacgatgccccagcccccagggcccggatttcccgaacaagcaccgtcggtatataccatcacttctttcatcatcctcttcctttcctcatcggtaaccgcctgctccgtcatggtcctgatcggtttggacgtgttccgcattgatttcagactatagttgctctatagccatttccactcagatatcggccaaaatataaattctgcacgtcccagtaaatcttgagatttaatgctgccaaaatagcggctatccttgcttgctgcaatatggcgattatcccccatgacaaaaaagtgctccggctccaccgtaaaaggaccataatcaccatcctccacgtcagagttggtgtaaggttcatttagtagttcaccgttcacatacaattgattatgttcaactcggatgacatctccgggaatacctatgactctcttcactaaaaatcttgggctcgacagttttgaatcgggatcttttaaaatcacaatgtcccccctgcccggatcatgaaaattataaaccagtttgttaacgaacaaatgctggctttccattagcgtcggctgcatcgaatgtcctctgaccgtggacaagttaaatacgaacaggttcagaagcagcaagacgaccatggcgatcagcagagtgactaaccaatcgcgtatgtaaccagagcggcctgcttgtttggacgtttccggcgagggaagcgggcctgacgaaggagccaaagcgtccataattaaacctcctcaaccctgttataaatagaaaagcatatcccgtacccgattgcaacggttactcagatatgctctaaatgtaaatattatacttaatgttattcaattctctttatttcgattcccgattaatgaggcgccaaaatactcagcttctgaaaagcctgtaaaatctggcttgctccatagcccatcgcttcgtacaaaggcatggccgcactgttatgcttgtcccctgctacccaaatacggctaaccttacgttgctgaaaacgctgctccatggactccacaagcgatttgccgattcccatccgacgacgatccgggtgaatagcgatacgatagtaacaaccatcattctgatccatcgtgccgatcaaagcaccaacgatctctccctcttcttctgcaacgatgatcaaaccggaatcccacgaaagctgacgggcaaacgcactcaccgtctctttgtagcactcctctgacaaggcaatttgcatgagttccgttactgagttcacatcacttaattgaaaggaacgaacgtgcataagtaatatctcccttttcgtaagcataataaaaaaattgagacagcaccgtcatttttacataaatccttaaatttcttatcatggtgttaatcacaaggcattatgataaaaatgcatacgatctgctatatatgaaatgaagaacaggaaaagggtgtatgccctcaagttcgtcatgtcatagacatgacagattatagcagacgacaaaaaagccgaaatttctgcttccttgaccattaaaccatactttttgacggaatacatccctttttctcatgtaagcgctgtatataaagcgtttacattttaaagttcacaatttacctcttattacctatgtattgtgtattccaatcgggtttttggacatgctagctaccaggccgtattgcccagtttgctattttacaaacaaaaatgttgataaaataggctgaatgcggtttaatataactatcgagggtattattacataggaacacttacccaaccatataaccaggagggattttactatggcatttcaattaccagaacttccttacgcaaaagacgcactggaaccgcacattgatgcactgacagtagaaattcaccatgatcgtcaccataacacatatgtaacgaacttaaacgcagctctggagagcgctcctgaactgcaaagcaaaagcctggaggatctgatctccaatctggacagcgttcctgaaagcatccgtactgcggttcgcaacaacggtggtggacaccacaaccacagcctgttctgggaagttatcggtcctaacggcggcggacaaccgacaggtgctattgctgaagcaatcagcaacgagctgggcggctacgacaaatttaaagaagacttcactaaagcagctacaacacgttttggtagcggctgggcttggttggttgtcggcaaagacggcaaactggcgatcactagcactccaaaccaggatagcccgctgtctgaaggtctgactccggtacttggactggacgtttgggagcatgcttactacctgaaatatcaaaacaaacgcccagactacattgcagcattctacaatgtaatcaactgggatgaagtaaacaaacgttacgcggctgcaaagaaataagccagtaacaacatctctatcctataataaagggctgtctcaaaagtagattttctacgaatgagacagcccttttggcattccatggtaaactggtggagttgattctcaaatacagctctggaggttgatggatgcagactttttttcgttacaactggatgattcgggaacaatggtaccgctggtgtgaggaggtatcacaggaggaattactgaaacaacgcgtcggcggagtcggcggcattctaaagacactctttcatatcgttgatgtggagtggagctggattcaaacgattcagggcaaacccgactttcaagaggacttctctctctatgatacgctcgacaaagtccgtgagctggatgcaaagtttcgactcgatgtcgagccgttcgtgctcgcctggcatgatggtctggaacggaataggttcgaagatcacctcccggacggcaggattgtaattgatgcctggggcgaggtgatgcgtcatgttatcgcccaccagattcatcatatcgggcaactgtccgtatggtcccgggagctcggcaagcctccagtttcggccaatgtaatcggcaaagggctgattgaaagcgatagtggaatcgattagctttaacgaacatacaaatatattcatgtgactcagagccgtccccggtcgtttttaacgactgaggtcggctcttttactttatcatctatgctctcttgtccattccacgaaggttctattatttttacccgttttcataaaaacttgatggtaccttactaattttgtccaacctgttcatactctcttggttcagactgttgacctcttactcttgaaagcaccgtaagccaatgtaaataatgctccacataacagggcaataagatgagcgatcagataattcatatgaccatggttctctgacgcggcaattgcaaagccaggaagagccgtggttccgaatcctatggctgtcagcttgcttaaatatacatatgctcccgcaatcattcctccgaggcatccagcaaccaaggggaacttatactttaaagtgaccccaaagatcgctggttccgagattccaaaaagtacagacccgaatgcagagtaacccatttctttaaccttggtgtctttgcgattcaaaagaatataccccaaaacggcgcccccttgagccatcaaagctactgatgccaatgggttgataaaatttctgcctgtatcggttaacagctgcgcttctaccgcacccataacatgatgtaagcctgtaataacaatgatctgctgaatgcctgcaaaaaacataaaaccgaatattcctaggttttgtgtcatccaaagcagcgaaacagtcaccagactagccaactctcgcccaagagggccgataatagtaaacaatagcagggaagaaacaaagaccgtcagcaacggagccaaaaatagtttaatcatgtctggaacctttttgttaaaaaactgatccaacttggctaccacatatcccatcatcagagagataataataccgccctgaaagcctaccaactgtacgggaaggccgaaaagactgatcgattccggattttggctccctttagctacctcaaaggcgtccgccaaggctggatgaagcataattgcacccagcacaagccccagaatcggacggccgccatatctcttggttgcagaataaacaacaagcagcggcaggatggtgaaaatacctgtggaaacgatttgaacaaagcgattgatcccttggaaaattggatacatctccacaatcgatttagggccgaataaccccttctgacctaacagcccggttatccccattaacaatgcggcggcaagaattcccggcatgatctcaatgaaaacatctgacagcgatttaatggctttttgaaaaggattttgcctttgtgcggacttcgatttgacgtcacttaatgacatatcttccgttccggtcagtttggaaaacacggcatagatattattgaccaaccctgctccaaaaatgatctgtagttgatcccccgctatgaaaacgcctttaaccagatcaatatcttcaatcatttttaattccgctttttcattgtcctcaagtacaattcttaatcttgtggcacaatgggccacaccgataatgttgtcttcaccaccgatatattttaaaatttcttgagaaatttgcttatactgcttttcttttgcttccatctagtaaaaccccctctagctgaatcagatgtcttctttaacaaatatccagaacatccctaaaaagtcctgctttaccctggcaagcgttatgcctacatgcattaattcatcaccgccaaacagctcaccagtttctatatttctataaatgtagtctggattcagacctttgaattttaacgttttaatcgcggcagcgggttgggataaaaccttgaaatagctggccgccatttccgtttgatcttccgacacaaagttccatgcggcttcattttcatcaaacggattaattattctataaaacttcccaaattgaatgagcgatctaatttctttatatagagctatctgtttttttactatttctttttcctcaacggttaatgtcgtcagatccagctcatatccaaaattcccggccatggcgacataacctctggtctccaagggagttattctacccacttgatggttgggtaccgtggagacgtgtgcccccatagtaatcggagggtagacaagacttgttccccattgaatcttcagtcggcaaatggcatccgtattgtcactcgtccaggtctgaggcatgtaatagagcatgccggcatcaaaacggcctcctccactagaacagctctcgaataagacatggggaaatcttgatgtaagctcttccataacactatagagtcccaggatataacgatgcgcagtctccctctgtctctcaggtggcaaggctgccgaacccacatccgtcatgtgacgattcatgtcccattttacataattaattggaacgtccgataaaatatcggaaaccgacttaataatgtactcacacacttccttccttgataaatccaacatcagttgatttcttcccaacgtatacggacgatcagggacatggatacaccaatccggatgctttctgtataaatcgctgtctatggataccatttcaggttcaaaccacaaaccaaactccatacccagatttcgtatgcggtttgcaagatccagcaatccatctggaagtttgcgacgatccaccacccaatcgcctaatgaagtattgtcatcatcccgttttccaaaccacccatcatccaatacaaacagttccactcctacactttgagcttccttcgccaactgctcaatcttgtcggcatcaaagttaaagtaagtggcttcccagttattaatcaggatcggccgctctttgtcacgaaaaggcccacgacataatctgttcctgtataattcatgataaattctcgacatgccgcccaagccattttcggtgtataccatgaccacttcaggcgtttggaacgattcctcaggttcaagcagccatgtaaaatcaaaaggattaatccccatcgtgactcttgtgttccgataggaatctacctgagcctgggccgtaaagttcccactgtacaccagattaaaggcgtacacttcaccctgttcttcatctgttccttctcttacaagtgccataaagggtgcctgttgagggctgctggctccacggcagctgtctaccatttgaattccaggtaaaatttttcgccttgctatatttttttcattattatgcgcaccgtacaaggtaattagttcatattcatcatcacgaaaatccacactagcacttaacgctttaagcagttttagctgctgccgaccttcattatcgaaacggactgaacgggtaatgacatcccacttttgatataggctataggatagtacaacctttacattaattaatgggtcttcaagaacgatttccagagtttctacttcgctagcatcttctgcataagtagaaggaagccctttcaattctggtttaccttgataaacccgatgttctttataccgaaaatctgttactgtagagccattctccaattgaagctgatacgcaggaatcctgaaatcactatttccaaatgacggatattcttgtgggatggtatccagtgaaaaggctcgatccttgccatccggattgggtgaaaatcctctatccataaagatgattttattgcttccccgatagttctgaattttctttccccaatacagatgggctaaataaccatctcgtataacctgcatgacataactcgtattgctgccttgtaaatggaataaaagcttctctttatcgatgtgtatagccatagcaacccccttatagagccaatagtatgatttccaaaaagtataaattatgttgtttactcattgtttacatcctaataataattgaatagtttcaataattatatggaataatgtagactctatatgaaacggtgtgataatatgcagagatgaattaaggggtgaaaacaaatgagttcacacttttccaatcattcctataacaacctggacctcaatttatacacatgtggcaaagaaagctgtaccagcaagcactcttatgggccagccattcgaagcgggtatatggtgcattatattttaaaaggaaaagggatctttaaagtcaacgataaaatctatcatttggagaaaaacgatgctttctttattgagccgaaggttttaatttactacgaagcggatgaagtcgacccatgggaatatgcctggattggttttaatgggatgcaagcaaaagaatatctaagccggacctgtatcaatagggacaatcccattttccggtttgaagcagagggcagccttgcccgctgtatggagagtatcgtcgtttcttctacactgaaatccaacaaagacctgctgcttgcatccaagctgtatgaatttctgtatctgatgtttgaacattaccctaatcaggaagtcaaccctgaggtaagacagcagcggtatattaaagaagcgcttctcttcattcaacaaaactattcacacttcattaccgtaagcgacattgccaagtacatttcaattgaccgttcgtatttgcatcgtttatttaaacagcaactaaataagtcaccacaggaatttttattgcatttgaggattgaaaaatcgtgctccctattaagaaatacttcccttaaaatcggggatatcgctcggtctgtagggtataaagatgtactcctattctccaaaatgttcaaaacggtcaacaaggtgactccatccgaataccgaaaaaacccccaaaaataacacacttcgttcgcaactaaattaggcatattcattccaaaaacagaaaaatagcggcagcatggatcaacctcatgtccatactgccgctattgtcaaaagaaaataaagttctagactgaaaaataaaatattagactgacatccaaaaaaacacataaacaagaatgatatttcagcgacatagcctgaagtacaaaagtcatatccataatttccgtcggctgtcgtcgcctgctgctaacgaggcggccttccgccaacatgtataatttgcggccgtccaccaattatactatttgatgttgcggcgcatggttcttttcaaagccgatatcgcttctaactccaatttgtttccccattatttctggaatatttgtactttgcaccagggttggagcaaagaatatcccttcacattcaatagatcggtcattgttaaacgtaattcgactcacatatcattgatgggattcaattcgttggatgctctcttcaactaaggcaataccgtgaatgtttatttccgcacgttgctcgtccgttagcaaggaagcattggtgagcacggtcaagcgctttgtccagcctgatatcatcttcacataatgcaaatttgaatcattcggagcaatcacgctgatctgccggtccctcaactcccatccatcacagaacggacagacaaaagcgctggtgccatacacttcgggaatcccctcaatgtcaggcaatacatctttcatgcctgtggcaaacaagagcttgcgactgcgaaccgtcgctttcgagctctctaactgaaggcgaaaatcaccgtcacctccagtaacagatgacaccaccccagattggaataggaccgaagggtacttcaatatctgttcccttgcaatccgccggaattcagatggcgtaatcccagcacgtgtcaagaagccatgagattcttttgtcacatgatttcttggcatctccttatcgattaccagtacccgtctgcgtgaacgagccagcaccaaggcgcgttcagtccagcagggccaccgccaacaatcgcaacatcatatatttcggcctcagtctccggtcatcttccttctacctccctgatcaacatcgcaatctttaaaagctattggcaagccaagtttgcacggattcggcttcaggcttccatccaagcaagtttcgagcatgcatagagcgaattcggcaattcgtcgcaagtgtatattgagcaagaaggccaaattcagcaaccgcttcttccagagaccagctcatcgtgcgtccctcatatccaagcgcctcactcacgtaacggcttagatcacggaacgattcctcgccattttctgcgaaaaagtaagaggaggatggcgctttgtctagcgcaagaagatacaattgggccaagtcacggatatggacgttcgaccatctgttcagacctttgctaatatagactccggccttcatttctttcgatttctgtacaatcattggaagctgaatgctgtctcttggaagtccgagagacgttccatataccatggaaggtacgatgacaatgcctcgcactccttgatcaacccctgctttacgcaccagctcattgactcgaatcgattccaagtcccttgttacaggtgtttcttcgttatagatttgctcgctctggaattcgcccttggcatcatccccaacgttgcctgaaccggatgtgtgaatcaacggctttcctgtaccgcgcaaagcgctaataaacgtctcaatagccttgcggtgagcaacgtcagctgtatgaatcactccatcgctccgttttgcgtaatcagccagtatttccgtatctccaagtgtgcccacgacaggctccactccaagctctttcagctcgtttatttgcctggtgctccgggtcagaccatagatagaatgccctgcatcgagcaatactttagccacagaacttccaatatatccggtaacgcctgtcataaatattttcatcgttcgtcatctccctaatctaagttcttaaaagtaaagtgatacgatctgtcactgcctcctatacttaaattaataataagatattatagacccactatgtctataatgtagcgaaaaaaaggtgcgcgattcagcttgcattcatacaaagaaccagctcctttgatcgcatggacacgaagtgcatagtcgagttaagaataattcatttgcgctccaattatcgactcatcgagtccataatcgactgacttagctcattttagggctacggattacatatgtcaagtacctggctcgcctaaaccgacataaaccattgtaatcttaaatttgttgctcttagcatcccgtatgagacgggttgcatagcaacgtattccacatgctatcaagcgtaccagaagactgaaaatatctggtcatagactctgtcgaaatcaactggcagtggttaaataatttaaaattttaaaaacaattatcaaagctgttcgcaatttctttgttagctttatgtcgttctcgtgccaaatgtttttaacaacgagcatccggtttttcgttccgcaattatctcagctcggccgatgaagctatcaacattaggatatcttctgcatattatttcaataaattggcttttaccacgccatatttaatgccaaagagagcctatccctttattaattggaaatgatttaactccaaatcaaagtgatgggcttattttctttctcctaagcactacactacattagactgacgctatttcattaagctaacgagcagattagtttaaagtcaatcgatatgaaccttatcacaggtaaggttatttttttgtgcgcattcatcaataaagaacaaagctcgctatcacttcagcgagctctgttctttatagtcaaaaccaagtcagagtaaaaccctgttcgaggtctgagattagagcaggatgaacaggctgccatctcaagattctccgggtcaagttatcgaaagaagtagcgcattaggcgcgttctcatccgcaggttaacagtattctggactgtttaaacagatttattatacacgtctgcaaaaactttcgcaaagtctccgaccttgactttaccgaggtggtagtcggttgcacggaggctagcgtagaactcgtcggcgttctcgcaggcgcggttcatttgggcaaagccgttggcagtgttttcgtggaagccgatttttttcatattctcagcgagagcttcaacggggatttgttggtatttggcctcgataccattctcagcaagggcattgagccagtcgttacctgtggcccagtcactaactatgaacttcgcacttttacccgctggggtgtgagaaatcagggcgtaagcgacatccgcgatatcaacggggctgacccagccttgtgagatgtcaactgaaattgggctgaagatagtctgctgggttttgaggctttgcatgtcggcaaaaagattgctgtaaaagccgacaggccggatgtggacaacgttcacgctttcaagcgagtttagcgcgtcttctgcaaaatgatagctgtagagaatgccggcgtttgggttgtcggcgccgactgagctgaggttgacgacgttttttacacctgattttagcacagcggccttataattttcagaaagatcaatggcggtctgccacatgtcggtgccagaggcataattgatacctgaaatcatgaggtagacgacgtcgctacctgcaaaagcctgcgcgaggaattcgacgtcgaggtttgagccgaccgctggtttggcaccgagcgctttgatgtcggcgatacgatctttggagcttgtgatgacggtgacatcgtggccgtctgcgattagggatggcaggtagttgcggttgatattgccgagtgagccgagaactgtgattttcattgtattttctccttttaataatgtgatttcgagaaatgtatatcgcttttgagaccgttatcccttcctcgattggctattcattacaagagagattatacaacgataaattaaccgagtaaactaaattaacgaaattagttaatttaatatatttattaaatattgtttattgatacctctattttgatataatatgatttgatgagcattagaggaggctttaatcgtgagaaaacccgtgagcgcagatcaatatctcaataaaatcaaacctgtaattagaagaaccagattcagccaactgaaaattgacgatatcgcaaaacatatggatattagtaaagtgacgctttacaagcacttttcatccaaagatgaaatcatcgaacaggttgtagagtatggaattcagtatttgcagcaggctgacaccgttgtatatgatgattccgtttcatatattgatcgatttcaaaaaacgtttctggaatcgttaataggtgttatttatttatccgatttgttcctgcaagacctcaaggagttttatccacgactttttgaaaatatttccgttgctcaacaaaatagaattaaaaatttacaatctttttttcaatccggtatggataagaagatttttaacagaatgcacgttgcgctgtccttagttcaagacgatgctacgcttcggcgcattatggaaccgacctttagtattcaatggtatgatctcaccttgaaacaagccgttatggaattttataagatgaaacagtatcaagtgattagtcctgagtatctggatactgttgacgattccgttatcgaaaaagaaatcattcgtattttacaaaccatttcgtgaacgcattcgcttctcccgacttgctcttagtgatgctgtcgtccgttatctgagtaatcgttgtaaagtttgtagcttattacgctaagaaggccatccttgtagatgaccattaaacttgccggttagagacagcgcagtgaaccgtatcacaagtagggcaaaatttatggttataacaaggaacctcttcgaaaaagtcggagaggttccttgctaaaatagaaagtcggttggttatctgatatatattctgctaagtgatgttgacgtccgctccagtccaattgcaacggattattgcatagggttgccttgtgctgcattcgagacagtctcccaggcttcccaggtagctagacggtcagcatagataccgcgtgccataggcaagacttccgagccgagcgcaaatcgtagggggggttccgctgcgtccacgatcttgagaacggcttctgcagtcgcttgagggttgccgcgtttttcgtttgatagacgcgtgaacacctgcttccgtacatcggcatagacgtccatttccggtactcgcttacctgaagcgccaaactcggtcgcataggcagcgggttcgagcagcgtcaccttaatcccaaagcccttgacctcttgcaccaggctttcgtggagtccttcgaccgcccatttggaggagcaatagaagccgatgagcggccttgcctcgatcccaagggagcttgaaacgctgagcaaatgcccgctgccctgcttcctcagcaatggcaaggcggcttggatgactcgaagataaccaaagtagttcgcgtcaaacagagcgcgaacatcggcttcgcttgcctcctcgaccattccgaccaaggtgtaaccggcattattgaggacaacgtccagcttgccgaaatgggaatgagcctgctgaacgacctggcgaacctgctcagcatccgttacgtcgagctgcatgggaagaacgagatctccgaaacgttccttcaaatcggaaacgtcttccaatttgcgggcggtagccgcaacctcatctccacgcgcgagcgcggcctctgcccatatgcgtcctaaaccgcgagaggctcccgtgatgaaccagacttttttgtccatggtatactcctcctttaaattccctgttctgtgtgggatacttaaattaaagcacctaaatacggaactttaaagttccggaactgtaaagtatcgaaaaaagggagttaaattttatgaataagattaaaaatgaagagtcagtcggatccaaattagctgacaaagtagcggaaaaaccagcgaaaacattaggccgtaaacgagatcacacgcgggatgctaaaatcctggaagcgacaatcgacatcctcgccgaagccggttttgatggaatgacaatggacatggtcgcagctagagcgaaggccgggaaggcgacaatgtatcgccgctggtcctccaaggcagagttagtccgagatgccttgacctggatgaatcgaaatcatcttgagcttgacctcttgcccgatacgggaaccttgcgcaatgatctgctcgcgctattgaagccgcaaacgatcgaagaaggtgaacgcaaacttcgagtactcgcaggcctgggctccttttttttgcagaatccggaatcggttaacggagggattttcgaaccgtgggctgtagtgaatcgtgagctcatgcaccgggccgtcggccgcggtgaaatctccacccacgcggacattgagatggcttgccaggttattacttcaatggcttcttatcgcggactcgtacagcgcaaaacattcgacaagcatttctacacttcgctaatcgacgttatcctactccctgccctcaaaaatccgttaacgtctccaaatgaaatggaataaggaaggcgaccttttgcttgtggaaagaaaatcctaccacgaattggtcatgatggaagggtcatcccaaaaggatggccttaaaacttgccgttacagacagcacggtgaaccgtatcacagtaagtcattatgctaacggaaaacgatagctcataaaagacaagaaggcagccgatcatagtgatcggctgcctttgtttaactaacgggcaggatagtttaaagctttcgataaatcgtatggccttacgaaagacaataaaagcgcagctcatgattggaaaagaccgtttaaaagagcaccaccaattccactggcaattatgcaaatttattagcattagcgctgcgccactatgcgtactcgtcccattgggcactacggaactcatgctggttgctatacaagaagcgcgtgccaattgcgacgagccgttcgctctatatcattcagcggttactttgtatattgggtgcagcaggtcgtatcccatgccgtcagcccatatgtgcaccctgagaacacataatcgtcctttaagtatggccagacgagattcccagcaaacgcaaagcgagtttcaagctgtggcgttcttcgtgtattcggtcaaataatacacggggaatgggaaagtcattttttcaactataaacagttgcctgaaagggcagagaggatttcctgtgttgtccgggtacgcccgatgcgtggaaaaatgaaattttttacgtaatcatgcccggtttcggaaaatccagtcatcgcgtcaatcgccaaaatcagctgatacccatgcataaacgcttcccgcgcagtcgtatcaacgcccaactcagtagcgatgccgcataagacgatggtatcaattccccggcggcgcaactgaaggtcgagctccgttccgtaaaaagccccccattgcttcttcgtgatgatatggtctgtctcggtgacccgcatttccgggacgatttgatcccatccttcaggcagattcaggggtggtgcaggcgaatccaacttaggacgcgggatatccttcaaatctttactagatacccggaccagtgcaaccattgagccttgctcacggaaagtatctgccaaggctgcggcgttagacactacctgctcagcagaataaggggcgtattgatttcctatccacttttgcaagtcaataacaaccaacgctgttttttgtggatcccataatcgttccattctgtatgttctcctcatctcttcgatttgaccgtatgtttagttatgtgaacatatagtcacttgacttcatgtttcgtattttgtactatcattcatgaatagtcaagggggagatttttcttatgagtgtgacaagggaagaggttttaaaatcggcgatgaagctttttaaggaacatgggtttctttcgacgacgatacaggatattgccgaggattgcggtattgccaaaggatcagtctataaatatttcccttccaaggaagacctcttcagcgaggtgtttgatcaatgccataacgcctattttgatcaagtcgatgaactgaaacgctttcccgaactctcgccagaagagcagtttctgcagcagatcattctgcgattccgttattttatggaatacaagcatattctggtcgaattcacggagctccccatccaacaggatcccaagttccagccgcttagacacaaggttagagggcggctcatccgatggcataaagagtgcttgatacaggtttatggcgaagaaatttatccgttcctgtgggatttggtttccatctatcgtgcgattctgaaggagtacttattttggatcgtttatgaagaaaagtctctatcgcttgaggaaacggcaaggttcattttggataaactcaatgtgctcgttaagcatatgatagcctctaacctgaagcctctgctgaaacaggcttcgttcgagaggtatttaagctgggggctcgaggaccgccaaggggagagagagcagttccttaccgagctgttccgggagatggattcggcccttaatgttcttccatccggcgcaaaacatcgttcggagttgaaagaggtttaccattttatccagaacgaaactcgtaaagcggaaccgaacttcccgttgctgcaagcttcgctctactttttggagagagagaaagagcttaaaagtcaggtcatccagttaaggaatattatttattcaggtaggggtaggtagcttgttatgtgaaatcaaatctaaccccatcggggacaagagtgaagactctaggggtggagagaacaatacgcgaaaaaggtacgtctaacgttgttacggttagcgagcattccgctaacgggaaacgttagttcaaaggaaacagcgacagtcttggactttattttctcgtacttggttgtcgctgtttccattttctaggctcagtctaattttttgctgacagctattcaactaacatcagttctctttttgcttcgcataatactcggtgatcagatcgaggaacaccttgggaaacgccaaggtggccatatccgcttcgctgatccagcggtaccccgctggcagcgcattatgcgcgtgctccgcctgctcagccagcgcaatcaatgcacctggcttcgcttcggtgctgtagctggcccgctgttcggcagccagcggatgtcctcccgcctccccggcagggacggcgacctcttcacactggaacacacgcaggttccagtgaatgtggctgaacgtgtgctccgcctcacgtacaaaccgcaccgggcgcgcaagtacgccctctgccagcaaatgagccgccaaatggtccatggcgggctcatccggcaccgggccgttgtagccctccggcccggcaagttcatgcggcagctcccacatgcgggccaacaggcccttggctggccgctgccgtacgagcaggcggccggcattcgttccgctgccctcgatgagggctacggaacgtggctccagccgcggcggcttcgccttggtcttgaccggcagcgtctcctcgcgacctgccaacctgcccgagcaatgctccatgaccgggcaggtcagacaatgaggcgacttcggcgtgcagaccagcgcccccagctccatcagagcctgattaaaatcagaagcccttccttcggggatcagctcccgtaccagactttccatatgcgcccgcgtgctgcccttcataatatcctcttcaatgagaaaataacgcgacagcacacgcatcacattcccgtccacagcaggctctggtcgattgaaggcgatactcataatcgcccccgtcgtatacgggcctactcctttcagtgcagcgacagcctgtgtatcatccggcacctgcccgccgtgaagctcaactacttgttttgccgccgtttgcaaattccgagcccgcgaataataacccagcccttcccacagcttaagcacatcctcctcgggtgcttccgccaacgcttcaattgtaggaaaacgtgcaataaagcgattaaaatacggaatgaccgtatccacacgtgtctgctgaagcataatttccgagatccagatataaaaaggattccgatggcggcgccacggcaaatcgcgcttgttacgtgtataccaattcaacagttcaaagctgaaataacgcttttgttctaatgtatttgtagtcatcacatcacatctccttatattcgacaatcacaaaagcagaggcaatgttaggctgatgtgtaatactcaagtgaatgctgtaattcgagtcacctgtagacggcaatctcagtctatcccacgcggatgaagacaaataaacggctggcttccccccaggttccggtaaaatatccatatcgccgaacccgatgatttgcccaattccgcaaccgaaggctttcgttatcgcttccttggcggcaaagcgccctgctacgaactccgttagtctacccttgcgttccacagcaagctcacgttctgccggggtcagcacccgatgcaaaaacgcatctgcatatttacctgctaaaatatgagccatacggcttatttccagcacatcatgtccaattccgtagatcatttgggtattccccgtcctttttactttactggatctattgtaacagtgcgtccacaccctggcgagtcataaaggcgtaaaaacgacaccaaaatatgttaaaatgagaaaggctataggtgaatgttttgaattcagctcatatgcccattttaaaaaattcccgtagaaaggaaggataggatgtcaaaaaccattattgttgaagcaggtaccgaagcaagaacagatgcggtgatccgggcttcctggtttcccgctaaaaatacagccaaaagcctgctcatcatcgctcacggctacaaaggattcaaggattggggcatgttcccctatatagcagaagcattgagtatggataaccatgttgtgacctttaacttttcacataatggcattggtgaggatctagagaattttaccgagctggaaaagttcgcacgcaacacctatagccgcgaacaagaggatttggaactattgctgtccaatctgagagcacgtcatgagttcagagaattgccgttgtttctgttaggacatagccgaggcgcgggaagctgctttgtatatgctctagatcatcccggcgagattgctggcgtcatttcatggaatggcgtgacagatcttgatttgtttactttaccgcaaaaagaagaaatgcgcgccaaggggcgcagctatgtggagaacgctagaacaggacaacagcttccgctggatgctgtcatactggaagacctggaacaaaatcgccagcgttttgccattgtagacagacttgccaacagccagctcccagctgtactgatccagggaaccgaagattccaaacgtctacgggaaggctctgccctgctcacatccgttcgtcccgacatcgaatgggtacaaattcaaggcggcaatcatacctttaataccgttcatccattccagggaggtagccttccactggatcaagcgattactgaaacccgccgcttcattgagtggatcaccaattaaattattgccccttcaatacaaacggcgatccgccgggcggatcgccgcatttatttacttcaggattttacaattccataatgattaatgcttacactcctgggatgcttgtccgcttatgcgctgtacgtgtaaagaagctttccagcttttcgcgtgccgccgggtcaatttccttgccttccaggtagtcgctgtttgcttcgtaggagatccccagttctttttcatccgtctggccttcccacaatcctgctgtaggcgctttgtccaaaatggcctgcggaactccaagatagctagcgagcaagcgcacctgacgtttgttaagcgtgctaagtggcgtaatatcaaccgcaccgtcgccccatttggtataaaagcctgtgatagcttctgaagcgtgatctgtgccaacgacgagcagattcagctcattcgcgagtgcgtactgaaccaccatacgtgttcttgcctttacattccctctcacttgcggagtaatggaacgctccagaccgatatcctttaacgtatgctctacttccacggcaaccttgtccacagcttccttaatgttcgtttccccagcatatttcaggtcgaacgctttggctaccgcgtagctatgctcgatatcctcctgttggccgtatggctggaatacacccagcgttttgtattcgtctccttgttcctgcgtcaattcatctgtagcccgcttgcacaaagcggctgctacggcactatcaatcccgccactgatggcgattaacagccctttgcttcccgttttcgttacatacgacttgaggaaatccacacgcttacggacctccgcctctacattaatcgtaggctgtactcccaattcagcaataatctgttcctgcaaactcatcagataagcacctcttttttaggaatttccttcacaagccaacatgcaaaagccccggcaagtttcgcaggcgaaaaatgcggggcatagcttgagcagtcttaccggcaaaaacgatcaaatgcactggtcaaatcagcagcgatctgatctgccgaacgatcctccacctgatgacgctcgatgaagtgaaccagttcgccgtctttcaacagcgcgatagaaggggatgacggtgggtaaggtgcgaaaaattcgcgagcctttgccgttgcttccttgtcctgtccggcaaaaaccgaatacagatgatctggcgtaagatcatgcttcagcgcttcagccacacccgggcggcattggcctgcggcacaaccacataccgagttcacaacaaccaacactgtccctttagcattaggaagcttggcctccacatcttcagaagtacgcagttcctgaatcccaagattcgtcagttcatcgcgcattggctgaactgaatctctcatatattgatcgaaagacatagacatattctttcactccttttccaaaaatcatgtatactacgtttttaatttcatcctttgccgtagtaaaggcatggacatctaaacttcattatacaatctttttcacgtaatttgcaaaaatccggctatatatttgcacgattatttctgtatcgaatttatgacagaaggttcagcgtgatcccggtaagtcgggacggttctgcgcaatcggactttaaactgcgtgcccattccctccaccgagtctacggcaatcgtaccgtgatgacgctccactatactttgacataaggccagccccaaacctgtacctttcgttttggtggtgtaaaaaggttggaacagcttttcaagctgtttttgcggaattcccggacctgtgtcctttacttcgagttccacgaaatccccttcctcatgagtcgaaatggtcaacacccccttttctcccatagcttccatcgcattacgtgataaattaagcagcaactgcttcatttccttagggttcaaatgcagcatcgtcacatgctcctccagctttagctcaatcgtctgccccctcagattcgcatctgcccacaataaaggcgtcagttcgcgaataatatcatgcagatgacattgctccttctcgacaatccgattctgggccagtgaaaggaaatcgttaataattccgttcgcccgatcgagttcctccatcacaatgcggtagtaatggttgagagactctggacttttctcacgcataagctgtaaaaaaccacgcacaaccgccatcggattacgtatttcatgagtaatgcccgctgccatctgtccgaccagactgagcctctcgaaattgcctagctcactgcgcagcgtctccagctctgtaatatcttgcaaggcgataatgacgcctgtcgtttggtttacgtgtttatcccgaataggaaggaaacttgagaagaatactttgggagtaacatttataaaatcagcacccgcctctccttgcaacgcttttgcaactcgttcgttaaccacaggcaaagcgctaaaaccatataacgaggtcaatggacggcctactacctcaggcagtgtaatgtagggatcgaagtcctggtagagttccagcatcgttttgttcatatgtataactcgttcttcgctgtccagagtaacaagagataacggcatcaaatccataacttgacgcagcttatccacttcaattaagtatttgctcgtaaattcagtcacatcacgccgcagcgccagcttctcaaaggcattatgcatcagactcacgaccgtaaaacttgccagcacacctgcaccaatattccagaacgttgtaagtaagtcaggaatgtataccgaaatatcctgtttgccccacagtagcggaaatatcgccttaaacagcatatcagccacaacatatgcggagattaggagttttttgtccaccaaggttcctctttgaaaaaacttgacatgcagcagcataaaaggaaaaagaataaaacccgtacccacatacatcggggacatttctgtcgactgggctataatcaggacacccatcagtgcggaagcggcgagcacgaaggcagtgcgacgtctaccgtacatgatgccaacagcaaggggaataataccgagattggaaggtagaccatacggagactgatattgaaagagtgtacatagcaatatggctggcaagcaacacagatacagtattccttgattgggtccaggaagcagattgccgccccaaacctttttcttatccccataatccgttaatatagagaaaaaacccgccgatataacggcaaggagaacttggagcacactttccttcaacgcaattaacaaggacttctccccctcatcatctttccttgacgccgttagttgaattaaagcacaggctacaatatattacaatatatgtgttaaaatcccggtgtagaacgacaaaatctgctaaataccagatgtatataagaggaacgtttttacgtgttttaaattctttgaaattgaaatatatacgtgtttgctgtgctctaaggctatctaaagcgacggtattacgatatgatggaaaatcggttacatcattctgaattttttgaaaatttgtcgacgaaaaggaagaggtttatgacttacgacgttattgtaatcggaggcggctcagccggattaatggctgctgccgctgccagcggtgagggcgccaaggtgcttttgcttgaaaaaggaaataagctcgggcgaaagctggggatctctggtggaggccgttgcaatgtcacgaatgccaaagagctggacgaactcattcgacacattcccggcaatggccgttttctgcacagtgcactggcggctttcggcaatcgggatatcatcgccttttttgaacagctgggtatagccttaaaggaagaagacaatgggcgtatgtttccagtgacggacaaagccaaaacagttgtcgatgctttgatcaacaaggtacgctctcaaggagtcgagattcggacaagctgtcctgttcaagaggttatttacaatgaaggtcatacggctggggtgcggctgcgttccggtgaaatattacatagccgtaatgtcattgtagccgttggcggcaaatccgtcccgcatacaggctcggaaggtgacggctatgcatgggcagaacaagcagggcatacgattacggaactgtacccaacagaggtgccgttgacctcaggcgaggcgttcatccagacgaaagagcttcagggactatccttacgcgatatcagcctgaccgtatggaatgctaagcaaaaaaaagttgtcgtccatgaaggagatatgatttttacacatttcggtttatctggcccaactgctttgcgctgcagtcagtttgtcgtcaagggaatgaaaaaggataaggtaaacacggtgttgttgactctggatttacagcctcacaaacatgccgatgaagtctaccgtgagacgctggaattggcatcggttgatgctaaaaaagcgatcaaaaatgtgcttaagccttatttaccggaacgcttgattccattgttgctccagcaagccgaactgcgtgaggacttgacctatgatcatattcccaagcagcaatggcaagaacttgctcatcgcattaaggcgtttccaatccgtgtgaacggtacgctctctctgaaggaagcatttgttaccgggggcggtgtgaatttgaaggaaattaatccgaaaacgatggagtccaagctgatgcctggattgttcttctgcggtgagattctcgatattcacggttacacaggtggttataatattacagcggcgtttacgacagggcatacagcaggaactcaagcggctgtaagcgattaagacactgcgcgtaggctttgatcttacgatcgctgttgcttctccagattcaaatcctccgcttcgctagaaaccgccattacaaccgaatttttaggaaaaacaggaaatcaaaaagacttaaatcagttgtattgctgatttaagtctttttttgagtaatcgcgtattgaacaagctctatcttgttttgacatttgtcgctattctatacctcaataatgataggtaaaatcatgggtcttctcttcgtctggctgtaaataaaccggccaacatcatcttttaacatctgcttaatcagtccccactgactcatttcgatttctgttaactcgttcactgtggacataatcgtgtcgtggatctgactcatgagctcttccgaatccttaacatatacaaagcctcttgaaatgacctctggcgttgcgagcatttgcttctcgtttttgctcaacgtcatcacaataatcagcattccgtctgaagaaagctttttacggtctcgtagtacaatattacctacgtcccctgttaccaacccgtctaccaagctattgccggctgatactttgggccccagggatgctcttccctcttcgatttgaatagtgtcaccgttatggacgataaatacattctccatcggaatccccacagactccgctagctgacgatgctgatacaacatcctgaattcaccgtgtatgggaatcaaatactccggtttcatcagggtcatcattaattttaattcttcctgactgccatgaccggatacgtgcatccccgtggaactgcctgatccataaataacctgggcacccaacacatacaagttatcaataacctgggaaaggttccgctcattccccggtatggctcccgcagcaatgatgaccgtatcaccaggcaaaatttcgattttgggatgcagggaattggctaaacgtgacaatgcggccatcggctctccctggctaccggtacataaaactgcaatttcttctgctgggaaccgctctgtttcccccggctcaatcaacaaatcctcaggcatatgcaagaagcccagctccttggccaccgaaaccacatttaccatactgcgtccgagtaaaaccagtttgcgacctgtttccacagccgcgtcaatgacttgttgaacacggttcacattagaagcgaacgtggagataaatacctgctgcttggctctggcaaatgcatctagaatatgcccgccaaccaaacgttctgaaggggtaaatcctggcctttccgcatttgtactttcggagagcagcacttttacccccttctttcctatttcagccattcgatgaagatcgggaaaaggtccgcttacgggagacatatcgaatttaaaatccccggtatggaccacattgccttccggtgtctgaaaaaagacacccaggcaatccggaatactgtggaccgtggtgaaaaaggaggcctgaatcgttcccgcttgaacggttgaatctgcatctataagatgaagctcagcatcacgtaaaagattgtgctcccttaacttaatcttaattaattcgatggtgagctttgtgccaaaaacgggcatattaatctgcttcagcaaatagggaatacctccgatgtgatcctcatgcccatgagtcacaatgagcgctctgactttatcttgattttccagcagataggtgacatcgggcacaataaggtcaataccaggcaagttctcatcaggaaacttggagccacaatcgataacgacaatatcctgatcgtattggatgaaatacatgtttttcccgatttcattaacaccgcctagagcagcaatgagtaatctattatcagcgtgcatcaattttatttcctccttaggaaaatgctatccatattattcatttttcacgtaaacttatgcacaaaaagaacccttgtctctaaaagacaggggctctcacttgatttattagatacccaccgcagccgaaatcgcagcaaaaatagcagcaactaaccacaggatggggaatagcttgaaaattaccctcagccactgtccaaagctgatccgggcaatggccaatcccgccagcagtactccgcctgtcggtgaaatgagattggttaacccgttaccgaattggtacgctgtgactactgcttcacgattgatacctacaagatcgccaagcggtgcaagtacaggcattgttagtgcagcttcccccgaagaagatggaaccaggaaagtaataatattgtgtgcaaccaacataatggtggtgaacaagtaacttggcaatccttccagaatgcttgcgagtgcattcaatacggtatcgatgatcataccctgctcggcgatgatcagaattccgcgggcgagacctatgatcactgcagcgtagatgaattctccacacccttttacaaaattctcagctatttccttctggctcattttagtaactaccccgacaaaaagaccgagtgcgaagaaaagggcgccgatttcagtcatataccagcctttgaccaaaattccccagacaattgctccaagcgttacaataaatccacctataattaatttgtcccgaaacgtgaagacgacgtcctcacctgtattttcttttataaactgctcgcgatttataatatcactctgaaaaacaatggatttctccggatttctcttaacccggtgcgcataccacattgtaaaggcaatagaaatcatagtaaatacaagccattcaataaatctcagccagagctgaggattcccctccacccctgcgatcccctgggcaatcaatactgaaaaaggattaacagtcgaaccaacatagccaatttgcgttcccagaaatagaatgagaatagcagtcatagaatcgaagcctagggcaaacattaatggaataaaaatcgcataaagcggaataatttcttcgctcatcccaaaggtagagcctccgagactgaatataaccatggcaattggaataagcagaatccccttattcttcagccgtctggcaagagctgtaagggcacggtcaatggctcccgtctgcagtataatcccgaaggagccgcccacaataaggacaaaagagaccacatcggcggcattgataatcccctcaataggagcgcttaggatttgggggagtccttgtcttaaatcaccgttctcacccgttttgggtacagtgtgataggttcccgaaacgatcgcagttttggtcacaccgttcactgtcacttcatgccggtcaaattgtccgctgggtacaatccatgtcaatgcggcgactgtaataataatcaaaaatattaaggtatagctatggggcaaggttaatttccatttctttttctcgatgttcatgtctatccctcattccaagaatggttataagtaaccttccctcccataatggtcagtatcacttgggcatccctgatatcaccagcggatgcattaagaaggttgcggtcaaaaacggcgatgtcagcatattttccagcctccagcgtgcctgtgacctcttccatataacaatgtctggctccattaatggtccatgcttttaaaacttcggatggcggcatcccacgatcgggataccagcctccagtaggtgatccgtccggaaataaccgatgagaagctgagtacagtgaatcaggaacactcgtgataaataaaggcagatcagtcccaatggttattggcacgttagcctccagcatagatttataattataaaatcggttttcattacctttgcctaccacaacaggcatataggcctcttcataggttggattcagtagcaggatttgggcgtagacttcggcaaaaatttcgtttttgcccattctgatcaaatcatctggatgaggatactctagatcactgatagaatgtctgataaggttattaccttgttgttcgcggcatttttcaatcatggataccgcttggcgaatcgcagcatcaccttctgcagttaggcagcatttgataccttggctgtccgcttccagcacagaggcttcaattttttcgtaatcaaccgtcctcaaattcgtgacttcaggcatatctgcatacggttccagcatgtcccccgtatgatctgctacgacgccgtcaagcatcagcttgtatccttggaaacgaataaggtccccattataaagtgctttatacttcataccggtgccaatatccaacggttcaacaacgggttcaagtgagaaatgaaatcggagcggcagttctcctgtttctttcaattcttctaaaatcggtagcagctcgctatgctggtcaaagccaatatcttttatggaggtaactcctcgtgcagctagtatgtggcaaaactccataaactcttgtttgacaaggctgtgatccttcatcatagcttggagcagcaaagcgcgtgcctcagcattgcattgatccggcaaaaattgatatttctcctgtgccagtcggttcatccagcagtagcttttatttaggttaatagcaattaccgcccgatcagggaataactcgtctaacaagctttgctcaggcaacttgccccaaccttcctcgctccagccgtaagcggttacatctttccctggcggaaggttgtttgctgcttgtagcatggattccattgcttcttcaatcgaggctgcatgagtcaaatccacgccccgatgcatcgacatatatccggtaaaaaatacatggttgtcatgaactcctggcatgataaaagcatcacccaaatcacagacaaccgttcccgctcctatccaagcttgtgcctcctcgggacgccccactgctgcaatacattctcctcgcagtgcaataaaccccggtgaggcttcattttctaagccattaaaaatagcatttgacagtaaaactttgtccgctaatgtgtcattcttcccttgcacaatttcaccccctcattatttatctgcctcactacataacgtaatataacgttataatatagcttctgcttctcttatggagtggaagcagaagctgcgccgtacctgaatacatttacataacaggcaacggatttatattgagaattgataacgatctccaatgatgtactgtttacctacatgaacggggcctccatgctgatcataaataatcgtgtgcatgtagaacaacgcctgtccgatggccgtctccagcagctttgcttggtattcatccgccaaagcgatttgtaatatcgtctctcctggttggttaggatcaatgctgtatttatgacgcaacagttcgtatacagagtcctccaactgctcttccattagaaaagaaaatcggtcataaggataaaaattattctccagcattagtggtcgatcaccggcgtatcttttgcgctgaatatataacactttttctccttgtggcagccgcagctgatgtgcaatttcctcatctgcttctatgatttcacgttctgtgaccacactgtgtgaagataggccgttggatttgcaggcagccgtaaagctgatgacatgttcaatcttccgcccaattttgggtacattgacaaaggtaccttttccttggcgtttggtcagataaccttcatgaaccaattcggcaatggcttttcttacggtaattcgacttacattgtaggtctcgcttagctcagtttcggtcggtatacggcttccctgcgtaaatgttccattatgaatagcagttttgaccgctttttgtaattgaatatataatggctctgcttggtccgaattcaacataatgtgccctcacttgtcatataacgttatattactcccacttagagtatcaaatgttacatattcttacaagtgaagatatttgaacataattttttagtagcggacgccgtatccaaaagaaccttctaccagacagctctgagcagcaaccctcgagccttctaccatagcgtcctgaatgttgccatttttcaaaaagctcagtaaaaaggcggttatataagagtctcctgcccccatcgtatccacagcgtccacggaatcaggcatttgaaaatagaacttagtaccatcataggcaatagatctatctccgccgcgtgtggctaccagaatttgcccctccttttttcgattggagcggatatagttctgcgtctcttcatccgtcatatggctgcaagagaagaaagcgaaatcggcgtacgcaatatatttctccacctgtgcatctatgaaatcatccgagaagtcaaaagaaagagggattcccagcatcttcaattcaggcagcaagtgccctgtatgactgtacaagccggtgtgaataaggtcgaacccgccaacataggccttgtcatcttcactcagcttcagcggatggagacgtgtaactcctccctcattgctgcccagaaatactctgtctccgtcttccagggttacacgtgcgcagccgttctcaccgctgtgatatctgcaccgtgaaatgtcgatttccagctcacggagaatgtgttctacatgctgtgcttcgttatcatctccgaatactccgataaaggctgcatctactcccgcttttttggcaaacacactgaaattaagcgcattgccgccaggataactcatgcgcagatgaacatatttatctaccacattatcgccaatgcctagaactttcatgatggtttcctcctgttggtaagtgcgcttagtaagctactttgcccatataacggcgagtttccagtgggtgattgcgtacatttgcgagtgcttcacgataaacacatacaatgctgtaaaataaaaccgggttaaaaaactcgacgacctcgtcggcaatagttccgattccaagctcctttgcatcaatcacttccactttctcggcatattgattcaggaaagtctgtgcccgctcatccaatgcccgtgtgcgtccttcgttgatcatcagaataaatggagtttctttatccgttacttcaaacggtccgtggaaaaattcacccgaatggattgaagccgcatgaagccattgcatttccattagagagcagatagcaaatccgtacgcatgtccataagaagctccgctggtcaggatatagaagaggtcttcattgcgatatttgtcagcgaatacactggcacgcggttcaacttgtattttggcccggttaataattccattaattgctcccaagccgttctggaaagcttgataatgcacatagccttcagcgatttgaagcaactcaacagcaagctccaaaataatagccatcgggttatttttgacatcgctctcatctccccactcgtagaggaatgaataatcagaataattgagtagtgtcgcttcactgttgtgggttaagccgatggtgtaagcgcctttctctttggctgatttagcagctgcaaccgattccggcgtgtttcctccatgggaacacacgatgactactgcgtttttacctaatcgttttggcagtgcgtgcacaaactcattcgccgtatacatccctgctaccagcttctttgcttcactatccagaaaatattttgagggatacatatcgactaatgagcccccgcaggctactaaatacacctcagaaatctctccgcttgcttgttcataaatcgtctgaaccgtctgttgtacattcatttttacctctcctttttatataacgttatataacgtattgtttacgagataaatataagcgctttcaataaaagtgtcaaccccaattattcgatcaaataaactttttttataacctgtcattaaaaaagctctaatccttgtgtgaacggaattagagctccttttttagatttaattcattgataggttggttggcaataacgaggctactcctacaatatacgcacaaaaaatatggtcttataaatgggtttgtccgaataaacttaaatagacaaaatacataacatccaataaaaatcaaggagggagtcaccattaatacttttatcagttatatttttcttggtctgtcactttcggcccctattggaccgattaatgccgcacagttggatcggggtatcaagaatggtttttggcacgcctggtttattgggcttggtgcaataaccgcagacattatctatatgctgcttgtttatttgggaatgattcaccttcttaatgctccgtttgtcaaagcttttttatggctgtttggttttttcgtacttgtgtatacaggtattgaaagcatcaaaaatgcaggtgtgatttcagaatccgaattaaggggaaatggtaatacattaagtaactcatttatgtccggttttctaatgtcattatttaatcctctctccatccttttttggcttggcatttacggatccatactcgcaaacgtcgctaatacatatccagtacaacagctaatgatctatagcggagcgattgtattaggcgtgttactctgggatgtgaccatggcagccgcttcaagtattttccggcggttcttaaaaaccggattgcttaaaaccatctcttggatgtccggattatctcttatcggttttggcttttattttggcgtacaagcatttcaattactttttttacgctaacgcttaactcactgacaacgttaacgagattccttgccgtgctttcggcgaacccattgtacaatgaggtcacatattgcaattaacaagacaagcagtaagctgatgtacactcccgggcggctaagtttatgaaaaaatgatccgaccacagccatagctatcaacaataatccaatccaacgtttaatattgtttgatctgctcgattccagtagcttacctgaagacagcaaaataaagcaccaattatacaacagcattaaacccgctgctgtagtgatatattcatatacttttcccggtagcagcaacgacattacgatggctgatattaatccaacggagatcaaactaagtgcaaaaagaggatatttgcccttccacttccgtgaaaataatttgggcgcatctccttcctgtgcaagcgtaagcatcatagatgtctctgcgtatagggatgctgtcattgtggagaaccctgcaataataagcactccattaaataaatgaggcacaaaaaccaggtgatcactgctaagcgcaagcacaaaaggactttctttcgggttaaaggcacttaatggcaccatagacacagccagaccaatcgaaagcacatacacagcaaccagtgtaatcagcattaccttgcctgctttaggtgcatcctccggtttttgaagccgattagacataattccgagcacttcaatacctccgtatgcataaaaggcaaaaatgaaagatgaccacaatcctatgcccccagtcggaaaaaattctttgtaactgatggggaacttcggattatattttcctcctccgatccagcctgccaaaagagcaacggccaagaccagaaacataacaatagctgccatcttaatgatggccagtacattttcaactcgatcaaaacccttattgccaaaaaaaacaatcacaagccctaaaatcccgaagcctgctgcaaatatccacatcggtacctgaggaaaccaaaagcgtgagaatatagatagcgcggttagttgactcccattgataagcaattctgagaaccaatacacccatccactgccgaatcctgcccaacttccaaatgctttttgggcataggaacggaaagaaccctgttcaggatgatctgccgtcatgcgcgaaagggcatcaaacaccacatatgttcccactgctgcaaaaaagtatgcaattagcactgctggaccacctatggagatcgctaagccagacccgaggaaatatcctgtaccaatggtacctgcaactcctaataagcttaattgccaccattttagtttttgatctttttgcttaacagctgaagacttgcccataatgaaaatcaccctattcctgatattgagacctagttctccgatattatgattgccttcttcaccatatttcatgtggacagcaattcatttcgtcatttgtgatttctagattagaagtgtgactatttatgtaataaaaaagcaccagcaaactcgtttaaggtttgctgatgctttttctacataaaaccagagacttcatttgggactaaatagatcttttgttgcgttaatgattaattatcaaaatttagacatagaaagtgccttgtccgcattttggatatccatttgaatttgctgctctggatcataagcattatagtagccattgttcttcatataattaaaaatttgttcatgaagattaacagctttgctcaattggtcacaaagaacattgcgaacttccgaactagttgactctgtcagggcaattgcatagcttttaattccacttttagccgaaatcaacaggtctgaagcgatcacctgatccgtcattccgcccattccagtcatgttctgaacaatagaattcacgttaatcctcctttaaattacacgagcagatttttaagctgttgaatatcttgtgtgccaccgttaacatcctgctgcaaaatgttttttaaatttgtgtctgatactaaaggaatcatggtttgggcttttgttaggcaagttgttttaaacgtaagtagctcatgcaattccaatttttcgtgaactcctaatttttgcaaggtcaagacctcctttctgaaattgttattccctgctgtcgttgctatttatgcatatcctacagaatttcaattctggtgaaagctctaactgagtttttctcacacaaaaaaagctccttcaaagccacaataattaatggtcttataggagctttatcctaatatgagctgaacagtgaagactcaaattctaatcatgacttttaggacaaaatcagatatggatgcttccagaaaatccatccacttcgtcttcaggttgttgatcagagctgacgttgtgctcctccatcgtattagtgtatgtttgagaggagccatttttataagcttcgctccagtcttcgttgatcgtgtgtgccgggataatccaatcttccgggctataacctggattatgtacacctgtatttccttgcaaaccgggatattgatccggtttagagaaaagagtccctacctcaatcatgcttccttcataggcttggcaaatttccaatgcagacagcacatcctggttctcaatatgaacactgagacctgtgtcaccatttgtgctggcagagtatccaatttcctttaatgtttcacaggcttggacggcttgctgcggatcacgaaattgaaaacggaaagaacctgtatccatgtgtttcatctcctctgaagtagcttatttggttaattggggttcatcaagctaggtatgttatttttaatataaccaaccggaacagtatttttacattcaaaacctttatttttcaaaaatttactttaaagctttgaaattaaatagttaaaaaagcagctactgtgacaaatcgcatgttttcgctacgtaaatccctttatgctagtaacaagggtatggttgcccggtcatccgagccgagcggtcaaaggatgcccaaatccatacataaaggcggaatgaagatgatagattaccgaacattggtgacacagcaatccatgcatttgtatagcgtgtttgccaagtcattcaaaagtgtaaacgaacatgcggttgctggcatcaaaacggtgggcttcaacccaacggccttcgccgtgatggaagttttatatcacaagggcgcgcagccaatccaacaaattggagcaaagctgcttctgcaaagcggaaatgtcacttatgttatcgacaaactggaaagccgcggttatttgcaccgtcacccgtgcgaccaagatcgtcggattatatatgcagaattgacggacgaaggacaacgtgtcatggacgaaatttatcctgattatacacgtcagattgaacgtgcctttagcggaatcagtgaaaccgaaagagatcaactcatcggcttgctcaaaaaattgggccgtagcgctgataacttgtcaccttatcacaaatagaatgaatagtaattttagcaactaatcgtttgtgaataaacgaacaatcttatagctgtgctaaaacgaaaatttagatttacacagaaaagtccacccttatattcatgggtggactttttatataccagaatagagcgaaatatgcccaagcttacgaatagcataagtacctgctatcggctaaaatgtttgaccactacattgttaaacacagccggaccgccatcggaaaaaagagtgattttctgatcctctaaccgtggaaatattaaagaggaataagctacttctccaccatctacaaacacttcaatgctggttttatcgacgagaatgttcaggtggacctttttcttattagcatcaaaaggcgccttgctctctacatattttccactctgatccggctgcccggtgttggctctatttacgtaggagtattgaccgtccactgagacacccacatcgacatgacgcttgccatccgtcgactctcgaagcctcaatcctacatttttaatcgtggaccaagatacatccgcctctaactgataggcatcgcctgctaccggaagccggtgagcaccctctactttaatcgttcctaatgattttttggatgtttggaatcgctccaaatggggtaccggctgtgaaaccaaacgatatccagcatctgccgtaacttttagtcgaatttggcgaacaatcgaatccattccattaaagccttcctttagggtaggcgtgttattggcataatcccaattattcatccaggccagagcataacggtggctatatttatctttatcttttccttcctcgaacgtaactgcaccataccagtcaaacccataatccaaccactcaggttcactgtgattagggagaaatgcttctccattaaaatctcccgtccaataggcatacgtgttgggtccgcctgttggtttgctattggcgctcacgcccagaatccattgataggttccatcatctgcacgcatctggtaaaggtcaggacattccacaagcccgatattatccgtttgaaagccactcgtaaactgccaatcctttaaatttttagacttataaaagccaatcttcgttccctctgccatgaccatcacccattgattacgttgaatatctcggatgattttgggatctctgaagtcctttataccggggttggacatcacaggcttgttgcggtaagaagtaaacgtcttacctttgtccttactgtaccacaaaaattgttcctgctttccgccatctgcggagggctgtgtcacaatggctaccagcgtgccttttccaaaacctgcggtattattatcatcgatcacgaccgaaccggaccaaggatctccattcgggttcgtatattttggaatcgccaccccttcatctttccaatgaaccagatcggtggatgtggcatgtcgccattctgtaccgttctttttgggataatcacgattatataaatagtaataatggtattttccatcaaaataaatgggccgttgcggatcattcttccacttatccggaacggtaaaatgataggctgaccggtaggtcggtgttgtttgcttactttgattcgcttgattttttggagttgcagcagattttgggggttcggctgtatcctgttggtacatactccaacccatagctataaatatagttaagcctgtgatgattacaacggatcgtatccaaatattcttgggagctttttttctcattatgacgatcctccttacctctcattgcatcgttatgtatcgtccgatggacgacagatcgggttgctaccaagctgccgccttcggacatactgcttatacctacttatttcttgccatactcattttggggttcttttttgtccttttctggatcaatcgtgatttgcccttgttccagaataccgtttttcacaacagaggttttcgaacctttaatattcagcaggaagcttggcgcgaaagtagatttgtgatccgggaaaagccctcgattggtcatataactcgacacgactacgttattgcctttgccttgcgggatagcaaaatgggcatacgtccaggtaatatcatcacgatccagatcctgatgaagaacgagaccggttccattcaacggtttataaggccctgtcaaggaagtagaaacataacccagcatgtaaatatcatcgtcaccgatcgcatctacagtcaccttggaacctcttgtactcgtaaataaataccacaaaccgttcattttaaacacattcgcccgttcaatttcatctgttaccagattggatgcaatcaaaggaggcattacatttttcaacgtataatcatcattcaattcaacgatacccagtgcgccgttcgccagctcagctccctttttcttaggactttgcagcaggttttgttgctcttccgtgaagaatttcttattgccgccataataagctgggttttgaatcgaatcttcgccctgatagcctgtttctgtccctgtgttggcttcaaatataatatatttgtggccttgatcctcgacatagtgagggtctctaaaggtatgattatccatttccactccgacgctttgctgtacattttgatagattttcccatctccaccgtcatagatcgatttcaaatcctcgactccatctactttcagtgtcttatcatcaggctgagagacattaatttgagccgtgctcaaggtttgcttgccgtataatttgttattcggatcatacggctgtctgctggtatagaataaacgtacttgtccatcagaggttaaggtagctgaacctgaccattcttctgactgattttttagaatcggatcgttggcaagcagtttatcattgtctttaaatactctgccagcgtttttccagccgctcagtgaagtattgcccgctttttgatagaacaggtatatgaatgtatcctcgcctcttttaggatcgcctgccagtccaaaaacgatattgtaccccttgtaattggctactgtgccatcggcattttgtaacggccaagagtcccagacatcgaaatcaatcagcttgcctgagctgtcgcgacccatagcagaaggaatattcttaattgtagacgcatcgaaggacggaatctcatatttctctttgccttgctgtttgaaaatattcagcatgtcattacgcgtaatttgcgtaaatgcattgtctgttttgagatcagatgcatcattttcctcagcaaaagcctgaacgccgcctcctaacagcaaggtagttgctactgttgcagtggctgctttactgaaccatttgttaaacttcaagtactccatctcccttaatctaattatgctctagatttgaaacccaactttttggttggtagggccattttatatggtatgtcaaacgattgatatagactgaaaagccctattatgtgaggtaagaaaacaggttcctctatgaatttcatcctcatattttcctagtaattttctgaaaattccttttttttcattcctattacatttagaaatatttgctacttgatttttttccgtgtcccattttgctaggttggttgcttcatttacatgcaaaatcgttctaaaataaatcatacaaagcccgatttgtaagcgggttcataaaaatggttccttagtaccctacagctcaattcagaaacacattttttgttacaatttcttaagacttttttaccattttgttacctatactctatgaatatatagcaactctagggggtttttatctcctttttgtatacttgggaatttatcggtcctatacgaggtggctattttgctgaatcagtaggaggagagaccattgcataaagagacagcccggacccttatttggtgtaccggactgtctctttatcctgaaagatgtatattattttttatgcgtgttttctttgtggtgtctttacgcgctgatctgcctcttcttccgtacccggcggacggttccgcaatccgaggacgacaaaccagctaataactgcaataacgaccatgataacgaacagggaatgcagactgttttccagtacagaacgaagtaatccggcaaccttgtcacttagagtttgtgaagcatgcggggccagcagaccattaatatcctcctgcgtaaccccttgctgagttagctgtccatcggctgtctgggctgcgatgcgatagttcagccatgaaccgaaggctgcaaccccaatcgtttgccccaacgtgcgcaggaatgtattcaaagctgtagaggcgccacgcagctggaacccgaccgaggactgggcaataatcgtgaacacagttatcgagaagccgaatcccagtccatacaataatgtagacaggaacagcagccagatcggagccgtttggcccatcaaggtcatgacgaaggcacccaatacaatcagggtcagcccgatcaaagaggttcgacgcgagcccagcgtcagcaaaatgcgtcctccgatcatggagccaaatagccaacctacggacattggagccaaggcgagaccagatgaagcggcatctccaccgtgtataccttgaatccatagtggaagatagctagtcagtccgatcaatagagtgctgactaacagggctgcggcacaggaaaaagcaatatcccgtatccgaaatagctttagtggcaccatcggttcctgagcgcgtttttcaataaccaaaaacagaatcaggaacaaaatggctacggcagccaaggccagcaattcaggagaagcccagccgatatactgcccacccagtgccaatacgagcaagagggccgtcatcccgatggtaaaggtaaccgcacctggcacgtcaatacgtgcggtacgcttgcttacctgttcacgcaagtaacgggcgatgaagaacatagccagcaatccaaaggggacgttaaagccgaaaatccactcccagccaaaataggtaaccacataaccgcccaagagaggcccgatcagggaagaaattccccatacggagctgatcataccttggactttgccgcgttcctccattttgtatatatcaccgatgatggtaaaggtaacggggatgacaccacccgcaccaatcccttgtatagcccggtagataataagctgctccatactaccagccatcatacaaagcaacgagccaagtacaaacaacgaacagccgattaaaaaaatgggttttcggccaaacaaatcgctaagcttgccgaaaatgggcgtggtcacagccatcgtcagcaaatatgccgtgaaaatccaactgagcaaattcacgctacccagctcgctaacaatcgtcggtcccgctggaccgataaccgttccttcaattgcggccagaaaagtggccaatagaacacctgtcagcacgagtccgcgcttcatgggtttatcgtttcccaagcaaatcacaaatccttcccttataaaaactgtgttgtatctgtgcggtttgcctttccagaatggattattacccgcaccgcataatcgtaaacaggcggcctatataggccgcctgttttgtacgatgtatatatattattgtctacatatccttaatttttgtcaactgtaatcgtatgttaactcccgctatcttccgttttatagagatacccctcttccatacgaagaacatggctggcaaagcgttcagcaatctgcaaatcgtgggtaatgatcagaaaagccgcgccttcagcagactgctctgtgcacatacggagcaggatgtttgccccttcgtaatccgttcccgcagttggctcatccaaaatgtaaagctttttgggtaggataaactgtgccgcaacgctcaaaagccttttttcgcctccacttaacaggtatggcgaaacctctagcctgtggcccagcctggcggctgccagtaagcgctgcgcccgttccacatatgcgacgggaaccggctccccggtccgtaaaccaagcttggcgcgcacgctgtacaagcattcctcccacaccgttgcagctgcaaactgatgctctggttgctggaatacataaccaatcccggcagccagtcggtgaatgggtagcttcgccatatcctggccctcccaccacatgcatcccttcggtgctgggagtagacccatgagcagcttgccgagcgtggttttacccgagccgttctcacccagcagcacggctcgttcaccgggcgcaagagctaggctcacgccctttagcgctgcccgctggctaccaggataggtgaaggtcaatcccttcacctccaacaacggctgcccagcgcggtccgctgctgagccgggattcacccccggctcacgcggcatgtctcccctccctgcggaagaggggagcagccccaaggcggccagctgcgcaccatgttcgcgcagcagcgtttcgggcggaccctgcatctgcacagtcccgcccttcaagacgatgacgcgctgtgctgcccgcgcgccatcgtctatgcggccggacgcggtaaccaccgtccggccttcggcatggagccgccgacatagcagggcaaagtcgcgtacagccggcgggtccaactgcgcagctgcgtcgtcgaacacgaccagcggcgcttccaacgccagtaccgctgcaatcgcggtgcgttggcgctggcctcccgagaggcgccgcacgaaggagtcgcgctcaggagctaggccgacggcctccagcgcagcagcaatgcgctgcgctatttctgccggaggcacgcgcaggttctccggcccaaaagcaatctcgtcttcgacgattccctgcaccagctgggcatccgggtcctgaagcacgacgccgacagtggtggcgacagtagccaaatcagcggtaccggggtccatcccatacacggtcagctcccccgtccgttcgccttcaccggaacgggacaacccgccatgaagtagctgacatagcgtagactttccacttccactggctccgacaatggctacatgttcgcccaccgcaatgtccagtgtcagaccatgtaaagctggctccacctggtcatcataccgatagccaaaattcttcaaggatacggctattttactgctagagttataatcgctatgttcattcataactgaaatatcctcgatccccattgttgaagatataaccacatgtatagccacggctatgcacgtgaagcgcgtcccagttcaaaacgttttaacagtcccgtacgatttaaagcatcacccaacactttcgtcagcagaccgcacaggacaatgccgctcaggatacgaacgaccagtgcaatcgtcagcaccttccagccccaatgcatatagccaaacatattggctgcgacaataaaccacagcggaaccatagccccacccactagcatcagcgaaactgcgttccagcgtcgataccgcaacaaggcaaataccaactcagccgcaatcatatagcagacagccgccgcgataatagaagcaattccataggcagagcccataaaggattgcaccaccgcgccaaatgcataagcaataaccgccgtacccggcttacgaataatataataagccaacaagccgtatatcatgtacagcccgacaattgaggaagtagcgataggccctcccagactgtttaatgttttgttaatgagcgacaaatacacggtcatgacgccgttcaacgtggccagcatcgccatgagtacgatatccagcgttgtaaactttgcaaacatacgagattccttcatatgtatttcttgactcctctccctatctaatctataagattacagctctgttccttgtacaagctgctactgtataaatgtattcatctgcgaccttattgtcaacctaattatattcaacaggttgacaataagaccaaaaataagaggcttcactttataagctccaccataaaacagctgtagttaatacagcagtcaccgcacataagttgcctaaacgcccattgttcagtgtacgaagatatgtccgttctgcataagcaccgaaacctttgccctccatagccagcgccgtctgctgaacccgtcttacagcattcaccaacacggcagccgcatacccgctccaccatgataaccgattgctccaccctcgtggtggttcctgtccacgaacacgccgtgctgccataattgttctcccttcttcttccaataaggggagaaacgtcagtgccaccgaaataccgaacgcaaaccgataaggaacacgcaagcgcagattcaatgcctgcacaaaatctcggggatcggtcgtcgagagatagatataagatgccaaaaacaacacaaaaatccgcaacgttaacgcccctgcgatgtccagcccctctgctgtaatgacaatgggtccccatgcagccacggtatgtccttctcgaatcgctaggatagacaatataaaatacggaatacctaaaccaatcaggaacgacatagcccgaagttggcgtgctaatggcaaacatgcgcccaagccagccacagcaatcagtacagccaagagtgctgcttcccgcagcgtcgaatcccaagccatcgacaggaggctaaaacatcccacccatattagcttacttaacggccctaacctgtgcagcggcgacgaaccgccgttatactgaaacagcatttcgttgtgcctccagtctgagccattcttcatgcagtaaagaatacattagcatatccttaaaacctgtagatgtatgctgtacctgccgcaacagtccttcctgtgtccaggacatcgaggacagcagggcttgcgagcctgtattgcgcgggtccaccagcgcttcgatccgattcaaccgaatcgtgttatacccgaatgacagcaccaagtgtagcgcctcggtcatgtaaccctgccgccaataaggcttggctatttcataaccaatctcggctttataagctccctccgtctgccaataattaaaaccacagcttccaatcaacttcccgttttccttcagctctattccccagcgcagcgcatcctccgtcttcgccaactcattcaacagctcaatcatatcctctgcgtcctcacgtccggacatacctgaaaggttcatataacggtgaacctccgggtcagaccagcaagcgaacaatgtagccgcatccccgctttccatccttcgcagccgaagacgcgcactttcaagcagtggtatatgcccctcacatgcatatgcacacatgttcaatcatccttccagcattaaaatgacataaatatacgctacatttaagcatacaccttcaacaaacacaaccttatttaaagctgcgaagcttatatatataaatagccctcctattcctagggaggaattagaagggcatcttctatattataagagattaaactgtggtgcgagtcggtttcttcacaacatccttgtacagtacgcccagcatcgactgaatttcctgtaattcatcgatccctgcgccggtaatgctgaacatatcatcatgcggtgtcagaaagttttcctgcgtcaggttttcaagctcctgcttgacctcacgttctcctacacggtaaccgcgctcttccaacacaggttgaatatctcttatcgtgagatcgttctgatgtgcataagaaagcatctgtatacggataaacaagttctgaacatctgcatgcataattgtaactcctccctggcctaggccaccatgttacactgtttttacccatagaggataagctggaaacagatgagggcaaccctcgctgaattgctttctaaattgtttaccctgctaaaacgtatagctttcccccttcccaaaataattctgtacagagggtagagtacggagtgtacgaaaaggttacagagtgattttccacttgactgaatatatacaatcgttatatcttgaattaattaaccaatggtaaaagcgaattggataattacctattttttaagatatatacaacacttaatgtaaaaatttaatgttaggagcgtgaaccctacatgtttcaagctattccttacgaaggcacacgtcatgaacaattcgaatcggttctcggacaactccgggcacttattcatgatgaatccaataccattgccaatctggcaaatgcttcagcattacttggtcatttccttcctgatattaattggagcggtttctatctttatgacggcaatgagcttgtacttggtcctttccagggcttacctgcatgtatacggattccattaggacgtggcgtatgcggtaccgcagccgcagaacaacggacgcttgttatagatgatgtacatgcgtttccaggacatattgcctgtgacgctgcttccaatagtgaaatcgttattccccttgtcaagaatggggaactgattggagtgctggacattgacagcccactaaaaggccgctttgatcacgaagatcgtatattcctagaggaatttacggctattctggtagccagcctataaccaaaaatagcgcatatatatcgtcttccttcgccacaatataggagggtctgaaacccaaaactatccggcgaaggagattgatgattcatgtacaacaacatggctccacaacaacaacttcatcaatgtgaacaaatcatgcaacaattggtacaacaaacacagcaaggaactgcgatgtatcagcagttgctgcaacaggaacaacaaaatgcatccagtcttgaaagcctggtgcaacgtgaacgaagcgcagctcaaatgatccaaactgcaattcagcatcaccagcaggctatgcagcaataccagcaagtgattcaactgtgtagtcagttggaaaactccatccgttccagcaatcaaatgactcagcctggatttggcgatagctttgcttcccgcagtatgcaaccaacctcctttaatacaggaagccacatgaataacagctttccgcaacatatgggaacgactggacaacatttcgcaagcagtggcatgcaacattacggaaacaacagtcagcaaggcatgagaacagcacaaagcagcatgtaagctacttttcacaaaaaaagggtgaacagcaggccatcggaattggcttgttgttcacccctttgttaatttaattcccgttcggctaaaaccttcatcccgtctcgcaaatactcagccagtccggggcgatagccttcatacattttattgaaatcctcatgctctacatacaagtctcccagcccgctataaatttctgctgtaggggtatagaatcggcttacccattgaagatgacggcggattagcgcctgtacttcttcactgttatgcttcaatcctttattcatggcttctgccagccgccgatgaatctggtcagcctctgcctgcgaatccaaataatcctctttgctccagttcttcgtcgccgtcttgctctcctgaattgtttcctgagcctcttgaccataacggtctgtcaaatcatgttcatacatttcctgcttttccggattaaaaccttggtacatgtgctctggtttcattgcttgttcccctttcaaatgagccaccgtttcgtcgatggtctgtaggagagtatgcaagcggaagactttggcctcgaccttggctcgatgctcctgcaaaacctcggccttttgttccttggtttgctccagcacatttccaatttcagataaaggcaaatccagttccctgtacatcatgatttgctgaagcctcaacagttgttcctgttcgtaatagcgatatccattatttccaatatgatgcggtttcagcaatccgatttcatcataataatgcaatgttcgtacgctgattcccgacagattagatacttccttcaccgtataagccattccgcttcacctcccttgcttgacagtctacagtctcacgtggcgtgagagtcaacgcccccactcgcccaccttggtactacacttttaccctgtaagcgcgttgtgaaccgcccatttgccaaccattttccatacttatgacctagaatctgcatctttagaaatctatgcaaaaaagccctccagcacgtattctcaaatatgccgggggctccatatattcgatttgactttaccactatttacagatcatacgatacctaagagaggcttttccccataaccacatgatcataaaaagctatcttttgaataattttctccaaattgtgctgcgtttgtgccacatgttcctctactttctttttgtgggctacaaggaagtctcttctctcttggattgtggcttctccttttacatttagctcaaggtatgccttaatttcttcaatggtcatccctgtatctttcatagccataaggaacctaatccaatcgatttgtttttcggtatatacccttcttccacctccatcccgacccacatcaggtaatatgccttctttttcatagtaacgaagagtagatgcgggcaatccgctcttcatttgagcttctttaatggagtacatatttattcccctcctcgttcttttattttctcttcaagtcagctttaacgataagtataagttttcatagtaaagagtgcaaaattaagattcctactacctggcagcagcgaggcaaccttcttatgacccgttagttcggatagaaaataaaacgtgggcatttgtgcctcataacaaaaatcgtctagaataatctttatgaatatatatcggaaattctttataatctcctcaacacgtttctctccataacaaaacatattttggaaattacttgtatacttttcaacagtttactaaatatatgcgattgcttctctaagcctattcttttttatcataactatttagtattataaggatataaaaaaaggaggttatcatttgaaaagtacaggtatgacacgtcccctagatgcgttaggccgcatcgttattcccaaagaaatgcgaatttccatggattataatgtgggtgatcctgttgagatttttgcagatgaggaaactggtattctcgcctttcgaaagtacactggggtgacgtgtaaaatgtgtggttcaacagaacagttaacttattttagagacagctttatttgcggggaatgtattgaaagtttaaagaaggggataaatttcagccctatcctaagaccagccaaatcatctttatccaactcacaacgatctaataaagagtccaaacgtctacggcgatcgacacaacagatgatcgaaagtctaaaagaattaatgcaaaaacaccccaatgcagcacagcacgaatatgccaaaatacttgaggtttcccaagcccgtatatcccagctcaaaaaaatgctctaactacagcttgataccctacatagatatacaccagagatttcatcatgtgcagctacttttgaaccgtgatacgcagcatcatagctaaccgacaaaacgcatgaacgtccatgcgaaaattccacactaggtataaagaaccacttcatgacttgcaagcgataacgcctataagcagaaggctgtgctacatttaataatgattcctgaattaaaaaatgaccttctttaatctgagaaggtcatttcatttatttattcatttttctacggtaaacaaccctatacttttccatttttaatactataagccaaatgcttttcattcgtaattctatccattcttagcagttaaccggtatcgccccttagtttacttcttagatatttatagaaagaatcgacctcttgcttcaagtcaattaaacggccccaggattcaatatttgtaagtacgttcaggataagcatcactgcttggttatagagtcctctgccagctagaagctgggccgttccgtattggtaatagattaactcgatttgattaggatggtttttatcatatagcaaaagctcaaaggctgtttcagctttctcgtactgtgcctgctttacataagctactcctagattaaaatatgcctcaattgtcttctccccgccataagtgcggcttatctcattagcttgttcgtactgtgcagtcgcctcttcgaaattgcccttcattgaactgatctcacccttaaccaaaagcagacggtgaagaataataggggagtatggctcaaaggttattcccctaattattgcctgagcaacatccagttggtcggtttttaagtagcatcttgcctttaatacctcaccaagaatcttcaaatccgtagcgtcaggtttactttgatccattatggctaattcattcatcccttccccaatgtagtgaagtccattctcattttcaccggtctcaatgagtgaccaaccagcaccatcaatataaaacatagctgccaacatcgggttccctgcagagcttgcatattttgcagccttaatgcagtattctgtccgtgtctctagattaatccgacttaaaaaatgggttattcttaacatgatttgaattagagtattggaatcatgattatctgcccacttgagcaatttaaggatgtttggccactcggattttacgggagccagatctcttcctaataaaaaactccaatacacctcagtgggctgctccctcttgagatgagtatctagataagaaaggtaatacgaactccaattcctccgaagttccttttccaactcagggttgtcgttaaggtgttgttctccataggtgaggactgtttgatgtgcctgatagtggagacggccgttgcttcgctccgtttcgaccaatgagaagcttctcagcaaacgcagggcctcataaaagttcttctgattaagtcccgccgtattggcccagctgtcttcaacggtcgaatcactaaaaaatccgaatgtctgccataaccgtcgtgcttcttccgtacagcgctcccaacttcgaccgaatagaaaactaaacagtgaggagagagtgtgccccgaacgagcaatttcattaatcagctcactgacttgaatatcatcgtcagcaaggtcagcgacaatcagggagattgccttggggttgcctgccgtagccataatgagccgctgtaatgcttcttcatcatctgtcagaagcttattaaggcgctctttcttggcaggctgataactcatttgtatttggtaatttacttcctctctaaagtaggttagagcctccatgggctcaagtccattcagtgtaattgtgtatatttctttctgtgagagggcatgtagcaggctgtgattctcacgtgcagttaataggattttcacgccgggtggaactgtagccacaaattcatgaatttcattattggccatatctatactatcgattatcagcagcaacggtttctgtagtgcggccgatgcaagtacgttccgcacaactaaacgtttctcattcagtaatttttccagcaattcgctgcggcctagctgatatgcaatggtgtctaaaaaatcgttcaaggtcaaatttcgtagttcggcactcacccagataacatgggaaaggtcaggccaaactaaagttggggagctggcttcgccatgcggatcaccaatacaagcatatgcgatttcaagcgcaatcgtcgttttacccatgcctccccagccagtcagaagacagatgggggaaggtgagcgtagccataaagatatatattcgagatcatgcaggcgcccaataaaagagcttgtccagcggccggggagattgtgctcaagaaagtaggagtgttcctcttcagcttcaatggattgcgaatcagtgaagaacgtcttaaccaaattcttgatctctcgatctgccggagtaccgtacgatccgttatccagcaaaactttagctttgcgaaagcaggagatcagccaatctgcagttggaggatcaataaccggaatggaagtggtcagcaataggtcgttgaaccaacgagtattcattacttctttttccataatgatccacagaagacccaaaagtttgccgtcttccactcggctgggaatatatttagggcccatttgacccatccaacttttaatagtattagaagacacaccgatgcgggctgcaatacggtccatataagattcggaaaaggatctacctgagggaaccgattctcttttcttacggcgggttcggtattcaggatgctccctgagggttgaaatgccatcagcaagcaactcagcgaactctacccttttatccaattctgccaatattcccacactccttacttctttctcaataaatgtacagccgcgctgtacgaaatggacagttcaaaaagatagatagcaattccataactatatacaatttaattgaaaacaagcaaggtttctaatcaactggaaaggaaggatcgctaatggataacactttggcaagagcggagcataccaccgtacactcagaggaaccacataagctgagtattttagaaaagctatcttacggaagcggcgatctggccatcaacttctactggtcgatggtgctgacatatatgctgttcttttatacggatgttgtcagactgccggctgccattgtaggaacaatgtttcttcttgtacgaatcctggacggatttatagatctaggtatgggctttattatcgaccgaacccagacacgatggggaaagctgcgacctttcattttgtttggtgcggttccaatggctatcgtaggtatattgtgtttctctgcacctgaatttagtatgaccggtaaaattgtatacgcatacatcacgtacattgcaattatggccatgatgtccttcatcggaacaccatatggtgcgctcacatcagcgatgacacaaaatcctctggagcgtgtcagcctgtcatcttaccgtattgttggttccatgataggcagtatcattgtctccgtcatgacgccgatgattatcgaacatttctggccccataacgaccaggtcggctatcgtaacacgttgatgatctattctgtattcgcattagtgttctacatgatctgttttgcaggcacccgggaacgggtttcggccaagaaagccgtgtctcttccgtttaagaaagcccttaaggttttactgctgaataaaccactgctgttgatatcgtttatttatctggtattccaagctgcggcaggtatccgttcatcgatttctatttactacgtaaattacaacctggaccgtacggatttactttcattattcatgttgcttacctttggcggtaatctaattggtactctggctgccccgcttctaaccaaatggctggaaaagaaaaacgctatcattctgggactatccggcacaatgatctgcggtgttgccctgttttatacagattatagcaatctgtctatggttattgtctggacgctgttaagcagcttaataggtgggatgcctgcggcagtgatatggggggcgcttcccgatactgtagaatactccgaatggaagacagggtaccgtaccgaagggctcatctatggcatattcagttttggacaaaagctgtcaattgcggtgtcaggagcactatctggttacatccttgagatttcaggatatgttccgaatgccgtacaaacttcatcggcactcactggaatagcacttctactctgtctggttcctgcattgttaagcattatgggtatcgttgcagcattattttacaagctcgattccagactttttaaccggattgtatcagacttataccaaaaagaatcaaaatctcaattataaacagaaagggttgtaatctatgacaaactatcaagtcccccatacaatgaaggctgctgttatgcataatactcgcgaaatcaagatagaagaagttcctgtaccagagatcggtccagatgaagtgctgataaaagtaatagccgttggcatctgcggctctgatttgcactattatacgcatggacgaatcggtaactatgtcgtagagaaaccgttcattctcggacatgaatgttctggggatatcgtggctgttggatccaatgtaagtcgcttcaaggtcgcagaccgcgtggcggttgaaccgggcgtgacctgtggcaaatgtgaggcctgcaagtctggcagatataatttgtgtcctaaggtagagtttctggcaacccctccgtttgatggggcctttgttcaatatcttaaaatgcgagaggattttgtattccagatccctgataacctgacctacgaggaggcggctctggttgaaccattctcggtaggcatccatgcggctgcccgctcccaattgcagcctggatcttctattgcaattatgggtatgggacctgtcggtttgatggctgtagccgctgctaaatcttatggtgcttcgacaatcattgtaaccgatcttgagcctctccgccttgaagctgccaagaagatgggagctacacataccatcaatgtgttggaacaggatgcggagaaagaaattaaacaaatcactaacggtcatggtgtagatacagcttgggagactgcaggtaatcctaaagcactccaatctgcacttggtagtttggcacgcggaggcaagatggcaattgtcggtcttcctgcacaggcggatattcctttcaatgttcctttcatagcggataacgagatagatatttacggtgttttccgctacgccaacacctatccgaaggggattgaattcctttcgtcaggtagtattgacgctaaggtactaatcactgataaatatccattggagcaaacctatgaagcaatggagcgtgcactaaactataaaagcgaatgtttgaaggtcgttgtatacccaaatgaataaaatttactggaaatagtaaataggacggaagaggatatccggttaaggataccctcttctcttcatgggtctggctttaagtactatcggatgatctgaattgatacacctagaagccgctatttaacggctttttcatctataaaataatcgttgttgtctaaatgcggttgttacattgagcttcgtcatcttataacctttaataagaggatttaaaaaagctgctgaatatttagactatgcgcaatctcagtgattgcacatgttaaagccggatgatgatcttgatgcgatagatatgtctgtcctcgtatttcattaccgctgatgacatcgaagaatgaataattctgtaacgatccatctccgtgtatgtgcaaaattttcggctgcaattcattaaattatcggggagattaacgggatagataaatggtattttatagcgtaattaagttgaatttcgtgtgttatactaaaaaaacatgctaggacttataagaatgaatccactgttgaaggaggatacaaatgtataattttatagcccccccagtagaaccacaacagtaggatctactgtgaaggtatctacatgaagtttgatgttccttttccatagattctactgtatgcaagagtagactatatcctgtcagtctaaccatcatattagtagaaagcgggaaaataaatgaaagaaaaattatattttgttttgtctatggtgattttcggtgcagttggcgtgtttgcaaagtatatcgatttgagttcaattgaaatagctttattcatgagtctgattggcggtttgttattgttcggaatctccatcataaccaagaatagagtatattggcctaacataaaaaagaatgctcttgcattattacttgcaagcatcgccttgagcttaaattgggtctttctctttcagtcttacaaggaaacaacaatcgctaatgccgctttaagttactatttcgctcctgttttggtaataggtatgtcacctattgtgcttaaagaaaagctctccctaaaaaaatgtttatgcgcctgtgctgcccttttcgggttgattttaattttacagagcgcgagtaacggagaagacggcaatcatttgattggtatcgtatatggacttattgcagcaactttttatgcaatcctgactttgaccaacaaattcattaggaatatgaatggactagaaatcacgattgtacaactattattatcatcgatattcttgattcctgttctttttattactcaagagaaattaggaatatatcagttatcagacaattccgttatccttattttgatactaggtatcctgcatgcaggtgtggggttctacttattcttttccggaatgaaaggactaggtggtcaaagcatcgctatattaagttatgtagatcccctaacctcattattgatttcagcacttgtgataggcgaaagtatgacgttatttcaaatattcggcgctatcctgctactgggatcaacatttattagtgaagtaagcctaaaaataaaatatccttatagaactaaaaatgagtaacctctcattttattgaagtcaacttcaaaaataattaaaggcagccgtccagaagggatgggctgccctttttaattaacgggctgacaataggaatcgttgcaaaattcaatttaaaggggagatacacaccttgtctaaacattcttctcatcgttcgatggggtcgttacaaccacattttgcaaccactactgaagttagtaattttgttaatctatggggaatatttactgtgaatggtcaacagatcgttgcttaaaggcatcgcctgtagatgtacgcgatgccttttgggttagccactggcaacttcgattcctttaatgcttaatcctctggctctgaacataaatattaggctttgctggccatgtctgcaatctggcgaagccacttcttacgcgtattttcatcagattggggtaccgactcgaaaaatagatgatacatgatatcaagtccacaatattcaaatatgcctttgtcagacgtcaagcgaagggcttgatccataccattgctggcatattccgcatgtgattttccttgtgtattgaggataatggctttcttacccttgagtaatcccatctgcactccatttacatatttataagcaaatccgtaagagaatacgcggtctatataccctttcataatggctggcatccccgtccaccaaatcggataaataagggtgattacctctgcccattgcaaaaattcctgttcccgtacaacatcttctccgattccttcaatgacctcgctgctgctaatcacaggttgaaagttgattgcatatagatcacgaacaaccacatcatgtcctttttgcttcagcccctcgactgctgtggtcaaaattgcatgattaaagcttccctcggatgggtgtgcgtaaataataagatgcttcatgttctctcctccatttactttaaaataagtgattgatcaattacttaacttcgtactccttcaattaactgaatatgctcaatccatagttccgataaagatacttcagtaaacttgagcggtatcctgctcatgaatatcacctccgttgcttgttaatttggttagtgattgatcaattactaatgaatggcctcagtatagtttattcctttttactttgcaagtgctttttgttcaacttgtcaaaaagattatttaaagatctgatcccaaggcagtgttattatcgctgttcaaagaaaataaagtcccccagttgatgcccattagggtgtgatgtagagcaatcacttaatatgactttataatgtcatgttataaggtgtatgctaccgagagaggtgaagcgtatgccgttaagcagacattttgaaatcgtttatatgttactccataagaaaaaagtgactgctgatgaattggcagagcattttgaggtttccacacgaacgatttatcgggacatagataccttaagcgcagctgggattcccatctacagcagtagaggcaaggggggcggaatatcattgatggagggttatgtctttaacacctctttactgtccgagcaggaacaagatgatatcttaatggcacttcagagtgtggctacagctaccatcccacaggtagaagaagtgctaaacaagttgagtaggctttttaaaaaagacatgggaaactggatcgaagtagatttttcgccatggggaagccaaaacagccagagacagctattcactcttatacgcaacgcaataatcacaaaccgtgttataaagttccgctattataacgtcgccggggaacagagttatcgtagcgtcgaacctgccaagctcttgtttaaagataaatcctggtatgtggaaggttactgtttaaatacggaaagtcatcgtgtatttaagattagccgaatgaaagagattgcagttaccgaaattagttatgagccaagaacagtcgtagcatctacagatacaaagatgaacgacttgcttcataccattgaagtaactcttcacatttctgctcaaggagcttaccgcgtatacgatgaatttgccgagaaaaccattactcagaaggaagacggctcttataccgtcacagcacaatttcctgtaggcaattggctggacagttatctgctgtcctttggtcccctccttatagaggttagccccgaacaagtacgtacaagaatattgtctcatttagaaacgatgaaaagaaatttaaatggccctctataatatgacaccatgtagtcatattattactgctatgatgagtttgaagttatcgctcacaacatactcaccataggaggttgaaggatcaatgaatccacatagaaccatgccacccgcagtagaaacttactttacatcagcgaataaatcccagcttgaagtacttacttccgctttcgataaagatgcgttgatcttggataatcatcgcgaaatcaaaggtatggaagccataaaatcatggtgtgaagcagaaatatcggagccgaatgtcacctttgagatcgtggatatggatgacagtaataataccatcgtcataattgcgaaagtagacggagactttgataaatcaaatctccccgatccactcctacttaaacatcaatttctagtaaacaacaataaaattaaagaactgattattacacttccataaaggtattaaaaaaataagaaagggacaacgaatatgcccgcttatgttgtttttatacgtgaacagagtaccgatcaaactgaactccaactctattctgagttggcaccggcaggtttggcgggacattccgtcaaccccctagcaatgtatggcgcataccaagttctcgaaggacccgctattgaagggctggccatcttggaatttcccacttttgaggaagcacaagcttggtactttagtccagcctatcaaaaagccctaaaacatcgactgcgcggagggcggtaccggggtgtcattgtcgatagtgtgtaaggttcgcaagacaagtgaactcgaagtggagatacctagaggtatttctcaaccacattgtagaatttaggaggaattattcgcatgagttttcaattagaaagcattttaagtgagtttaaaggcaaaagggccttggtcacaggcggtaccaaaggaatgggagaagctattgctaagcgacttacagctgcaggtgctaccgtaataactacggctcgaactactccagctaatttagaaaatccagacctgtttattccagccgatattagtacgcctgaaggtgtagataaagtagtaaacagtgttcttgagcgcctaagcggtgtagatattcttgtcaacaatgttggaggctcgtcagccccatccgggggagctcttatcttgacagacgagcattggcagcaaacttttaacgccaatctgtttgctgccgtccgtttagaccgtggactgctgccggctatggtggaaaagggttccggtgttataattcatatttcatctattcaacgtcgcttgccgctatatgatgcaacattggcctatgctgcagccaaagcagctttaactacttacagcaaagggttatccaagcagttttcgcctcaaggcattcgtattaatacagttgcgccaggctttatcaaaacgaaggcagcacaaagtttgattgatcggattgctgaaacgacaggtgaccgagaaagtgcattaaagcaactgatggactcgttgggaggaattccaattggtcgtccaggactaccagaagaagtcgctgagcttgttgcttttctggtatccgaccgggccgcttcaattacaggaagtgaatataatattgacggtggaacagttccaacggtctaaaactttattttcatctgaaaatcgcgcaaaaggtgaaaaaaaaagccctctaatgagcagacatacgcaaaacgtattatctttgtccatcagataggcttttatataactactaccgtttaataacgaccagctttgtttccagcatctcttccagggcgtactttacgccttcgcgtccagtgccgctttgcttcacaccaccatacggcatatggtcaacacggaagcttggaatgtcattaattaccacgccgccaacctcaagcttgtccgctgcatccagcgcggtcgtaatatcacgcgtgtaaattcccgcctgcaggccataaatcgaattattcacatggtttacagcttcatctatagagctaacagaatgaatcagcacaagcggggcaaacacttcacgacaggacaccttggcagtcgggtccacattaagcaaaaccgtcggctccaaaatacctcccttggcttggccacccagagcgatccttgcgcctgcttgaaccgcttcttccagccactcacggactcgttcgacatccttggctgaaataagcgcggatacatccgtgtccggctctagcggatctccaatttttaaacgttgagttgcttctataaaacgggatacaaaggtatcatacagctcatcagcaacgtaaatacgctgaactgagatacatacctgcccctgattggcaaaggctccactcacacaacggtcgatgaccgcgtccacatccgtatcacggtcgataataacggccgcgttggaacccagctccagcgtgacccgcttcaagccagccttggagcgaatttctgtaccgaccgccgggctaccggtaaaagtgatatagctgacgcgcggatcagtgacaagtacgtcgccaatggttttaccatcgccgctgatcacgttaagagcgcccgcaggcaatccagcctgctccagcagctccgcaatcaagtaagccgacaacggcgtctgctccgcaggctttaatacgaccgtattgcctgctgccagcgcgggacccactttatgagcgaccagattcatcgggaagttaaatggtgtaatagctccgactactcctactggttctttgagcgtgtaggccatacggccctcgccgcccggtgcagcatccagcggaatggtttccccgtgaatccgtttggcttcttcagctgcgaacttgtaggtttgcaccgtccgatcaacctccgtcagcgcagccttccatggttttgaggcttcacgtgcaatgatgcgcgctgcatcctcacgccgctcttccagcaggttagccagcttctccaaaatggctgaccgctggtgcgctggcatggcccgcatctccgagcgtgcatcagaggccgcttgaatagcagccttggcatcctctgacgtggcctctgccacctcagcaatgatttccccggaatacggtgatttcaacgtcgtgtacgatgaagcagctttccattctccaccaataaataaatgttgctgcatgcttttccctccttctctggatatcaacgttcttttaccatctattttaccgtcaacaccggacaaggtgcatgctgaatcacctgatggctcacactacccagtatcatttcggaaacaagtcctttgccccgcgtccccataatgatcaaatccgtcttttcctgctttgcactttcgcaaatgacactggccggatcaccgtgacccgccagcatacggtaagatataccctggtccttcaaatagtcggatgcaggttctaagatatgacgaccttcctcttcgattcgctcatccacatcaaccccaaccggcggctcattcatggataaagccgggtttacatgcaatacagtcagatgcggattcccctgaagctgcttagacaacgttttggctgtctccaacgccttcatcgcgtgttccgaaccgtcaatcgcaactagaatatgtttgtactcgctcatactctgttcctcctcagaagtccaattttagtgtgcatccacttgaatatcctgcatatgtcgacgacgtacgatcagcacagctacaccaatcagtaccatcaatgctccaaaataaaacggggtttctgctgagtaccactctgacagcttccctgcaagccacggcgaaattgccccgcccaaaaaccgcatgaagctgtaggccgcagatgctgtcgagcgctccactggagcagcctgcataacagcagttgtaatcaatgtattgttaattcccagaaaaataccagctacaatgacggcgacaatgacagtcgttggcgaaccagctatcgtcccaatcgccataacacctaaatcaatggcaaacagcgtcagcatgatactaatggaagataccacgctcaagcgtgcttgaatcttcggtgctacaaacaccgaggtaaaggccagcataattccccaaccaaaaaacacataacctaaaccatgctcgtccagattcataacatatggagaatacgccatcaacgtaaaaaatccaaagttatataataacgctacaataccgagcgtgagcaaagccggataactgagcgctttgaagggatcggtaatggaaccgcgttttttgggctttggaatcgaaggcagcataaacgtaatgaacaaaaatcccaccaccatcagtccggctacaccgaaaaacggaccacgccaggaaatggaacctaactcaccgcccagcaacggccccactgaaatcccaaggcccaaggccgcttcatacaaaataattgctttagctgttccagaagtggacagacctacaatcgcagacaacgctgttgcgataaacaaagcgttccccaaaccccagcctgcccggtaacccacaattccgccaactgtattggccgtgccgcccagtccggcaaacacaataataaacaaaatcccggttagtagtgtccatttgacacccaatcgactagatacaacgcccgtaatcagcatcgcaacgcctgttaccagattatagctggtgaacagcaatgacacttggcttttcgtagcatgaagctgatcggcaatggccggaagaatcggatcgaccaatcctagacccataaatgaaataacacaagcaaaggcgactgcccataccgctttcggttgagacagcaagcctgagcgttcttttaactcttcaggtaatgcatgttgtgaactcatattatgatgttacctccacatctgaatgtaaatgttcttgttatgatgggtcgtgatcaagttcttcatccagaagaaccttgcgttcacgcaccctaacccgtaactcctccagctcagtctggagcatacggatgctgttgatttttccctccattaattccaactgttcgttcaatgtactttccatatcctccaacatggcccgtcgctcgttcggttgcaaatgctctgttcgctcgcgatattcctcccgctgacccttaagcatttccgctgcggacatgtaacgctgaagctcttgcaaggagaatccaagtacttccttggcactcactattttttttagtaaatccacatcctcctgcgaatacaggcgcatattcccttcactgcgctgcggagagggcaataagccgatttcctcataataacgaatggttcgcttcgtcagaccactttgcttggcgacctcatcaattttatacgtaaccatgacacccaccttatgaaaaagattatatataaatactacgactctataacgttaacgtcaacgtaaacttttatataaaaaagaaaccgcctctattggagacggttcctagtttggcttgcacggtcatagacccgagcatcggtgctcaagcccatgaatatcgctttagatgaaaatggtacgtgtgatgataaccaacaaaatgaagagtaccagaataacaccagtggaagtaaacatgttgtagccaccgccaccgcaacctctttctacttcacccatcttaagttcctcctccctctgtcgattacaacaaatcgcccgaaatcagattcatgagctacgaattagatgacgaatgctttggaaataataacgagcagaatgaaaagtaccagaatcgctcctgtagatgtaaaagctccataaccagcacctactccagacatggtgattcctcccttcatggtttacaaaagcatcttatgcttatgccatcattcatgatagggacaaatgccgcgcctgccgcccaaatctaggttgggattgtatagtcctgttattcttcggacccgagcatgccgtgatacaggaggtttcgtgcctgcttggcaagcacagacggactttcacgtccaggtagcaatttagttaacgtcagccgttcaatcaagccgatcacgcattctgctgtcagttcagggtccagttcctcacggcaggagccccaacgttgcgccgccaacagatgctttttaatatgctcggccatttccgccttaatgcgcaccgagtctgccgcctggtaaaatccgacacgagtgatcgctggattgttagacaacacgcgaaaaatagcttccagaaacacttgtccccgtctcaaaatttcagcctcgctttggtctgggccaatcttcatgctttgtaccgtatcattcaccaaagtacgaaagctctccacaagctcctcatacatttgttccttgctttcaaaatgaatataaaaatccggctgcgtcaatcctgcacgtgccgcgatcgaacttaccttagtctgataaaaccccgtctgagcgaactcttcagcccccgcttccagtaacaaccttcgactttcccgacttctgactcctgctctcatcacggtcttgcccccttacgccacaaatctatcgtattataaagttcctttgcagtaagaacaatgggcttgaggatgatatatacctgtccttcaaaagtcctaatacagaaggactgaaagttttggaagggcatctgcctacaaggtataattaaccaatctgatggtgagcgagcaggaatttattacgctcagtgatgaggacaatatttgcgcatcatctcaatcgttgtcagatcatcatccagcccccgttgttgcaagccgtcgataatctgctgacgttcctgacctttgacattttgaccgaatttaaacttggcagtccattcctctggtacaattttgatcagagcgacccctttcaagcgtgaagcataccgagaatcgctggcatcaatcgtatcatacccgccttccggttgcagcttactcataaaaatggaaaaggccgatgctttttcttccaaatccactacatgctccgcatgaccacgcacggtaatacttttaaaaaatgatgtcgcaggacatgccatatgttcatccgtaaaataagacggaatgagcgcatattctttggcagctgaaaaagtaacccgattatcctctttcatccgttccatcttttctccagcacggctgccatgaatataaaaaacgccgtttccataagcgaaattcaagggaaccacacgcggaaaaccatcctcgctgttcatgcctaaaaatccgaaactgacctcgctcagaaactgctctatttcctcttgttctgccaccgtaaattcttttcttctcacattgaactctccttccatctattgaccaatgatacatttcagattatgttgaaaatggattcataaaaagatccaatatgaacgaaaatgagtggtccaatcgaaggagaagagtatggatattacgattgcttatcagcgtgcgcttcaaaagtatcatttaaaatatttggcattgtatcatgctcttcgtgagggaatcctcaatggttccctagccagtggtacgcgtctgccttccactcgtgatctggctgtgatgtatggaatttcgcgagggagcgttaaagaggcatacgatatgctgttggcagaaggatatgtagactcggcagtaggcagaggaacctttgttatgcaacagacagcgacgctgcccgacaaatttctaatcaaccagcagaaccaaaattcacctgtcgcaaaacaaaaagcccctgctctatcagcatggggacaacgaatcatgcagatcgaaagggaacgaaacttacagtcgtctcctgtttctgctacagatagagacagtgcgcaaccgcctttgatttctttccaggcaggagaagttgtattggagggcaattcacagatcgcatggaaaagcgcaatgactgccgctggaaaagatctgcaaaggccctcggctgatacgacgactgcacccgtgaacggtgatgaatggctgcgcgaagcgatttgccatcatgttggcagaacacgcggaataacggctaccccggatcaagtcgtattatgcagtggttccatggaagtgatcacgttattaagtcagttgcttattcatgaacaagatcgaattgtattggaaaatccctgttattccggcatctatcgtgcagttactgcctcaggcggacagatacatgctgctgaaatggatcaacatggaattgtcccacaggattgggattccaaattgctgtttgttacgccgggacgtcagtttccaacgggtgctgtgttaccattagcacgccgtcaacacattttgcaatgggcagtatccaaaggtgcgtggatcattgaggatgattatgacagtgaattccgctgggcaggacgacccattgaaccattaaaagcactggatcgcgcggaatgtgtcatctatgtcggttccttttccaaaagcatgttcagcagccttcgactcggatttgcgattctgcccgttgaattggcccaagcgctgacagctgccaaacgactatatgatcccctgccgcctgcccgcttggaacagcgcgcactggcacgttttatgatgcgcggcgactatgtacgccatgtgcgtcggatgactcgaatatacagatcacgctacgacgtgtttcagcgtgaaatacagcagttaagtgaactgtttcactggcatcagaacgattgcggactacatgcctatgccatctggaagcatgagtctgtccagtatcatcatttgatgcagacagcacgatttttcggagtcacatggcgtgatgccgccgattaccaactgacaccgggacctccatctgcctgctttatctttgcccatttaacggagcaacaaattattgaagggtttaatcgtctgcgccaggcatgggaccgtaataaaaatcagtaaggaatcccttatttaatcactagccccaaaaggcccacaaatgatgaagcctgatgcggtgaaatgatgcagccattcaaatcttctatatccacctgtagcccatcaaattcgcaatcgctcagatcaatccctttgagcttggacccggatagcatcgcttgatccagattgcaacggttaaaaaaggttttttgtagtgttaaatgatacagatcggcacttattaaagaacaatcttcaaaaccaacttgcttaaaattagcaaaacggaacatcgaataatcccctaagcaatccgaaaaacgaacgttttggagcctgcttctggaaaagtctgttccaagcaatttgcagttcctgaactctacccgatggataaaggaaccggaaaaatgaacattagacagatcgcatttatcaaaaatgacgtctgtccattcactttccggcaatgacgattccatgatcgttacatttttaaaagtcatcttctctaatgaaaccttaaccgcttccacattatccaaaatcatatcctctacagaccccatacgatattcgcctttggatcgtaaggaatacatttcttcatttaatacgggcaagtcgacaggaatcttcggcaactccattttaattttcataatacctctacctccacgattgagcgccctctaggacatttatatgaatctattttctaccaattctcatacatagggtagcaaaagtatttctcacacatatattaacgtagtgagcacgctcacgaacctttgttaggaggttgatagcatggcagtacaactatctaatcaagtgttctccatctctgtcggagattacggcgatctctcttccttacggctggtaggggacacttttaataccaactatgtcatgaacagctccaacgcacctaaacagaatacgtcggatcatcagtggctgggtgaactcatgttcacctatcgtctcgacaatggagcgtggactcgggcatggacaagtaattctgctgatgcgcgccagatcacctcttctggaaacagtgtccaggtagcctatcagaattcatcaaacaatcagggaatacgtaatttcattttacatgaaacttattcgttggttaacgattatttgcattggcaaatgaaagtaacaaacacctctaatcaaacgctggagatcggagattggggactgccgcttccgtttaacgagtactggtccggtggcaataatgaacaaatttatgaaaccagagtactctcacactcctttgtaggccataatagctcctttattaccgccggacgacctagcggcatcggaccgtatgtactgctaatccctgatgcctcaacgggtgctggtctcgaatatcaggaccattggagaactgaggagcatcccggcagcacttgggctatggagcaaggtggctggtccgaaggactgaatgtgttctatatccactccaatgtcatcaagagcaccaaccgtggttatctcggaagcaccagtctgtcgctggctcctggtgaaagcaaaacgtatgcctttaaattttataaagtagcggacgagcaggctgtaaaggacaggctgtacagtgagggacatgtggatgtgaccgtggtcccgggtatgattttcccgaccaatctcaaggccaaattcgatctgcataccagcaaatccattacctctgtcacagcgcaatatccgtccgaaacgaccatcagctatctggaaacagcccctacaaaccataaaatatatgaacttaccctgggacgactgggacataacaatattactgtaaactatggtaacggcgaaaaaaccgttctccagttctatgccatagagccagtcgaagctgcacttcagcgtcactctaccttcatggtcaacagcacccaatggaacgtgccgggcgacctgagggacaaggtctttgatgactggatgatgcaatacaaggccaaacgcaacagctttgctggctactggggctggggtgatgattggggactaactcacggccagtttctggcggagaaaaacgttcagaagcccgtagcatctgaaatcaaggcagtcgatgattatttggaggtggccatctggacgaatttgatggaaggccatcataccgattatctggttcctgattttctgatgccgcagcctaatacgacaccaacgtaccggggctatgcctatccgcacatttataatacattttttagcatgtataaacttgccaagctgtatcccaacctgatcagctatcgcaatagcaaaaacacatatttgctacttgcttatcgtatttttaaagcgttgtatgaaggccctgttgcttataattggaacacgggacttatgggtgagctaactacacctgatatgattaaagcgcttcaggaagaaggcttgactaccgaggctaacgagctgattgccaaaatggctaccaagtacaacaatttcaaaaacaccacctatccttatggctctgagtataactatgacaacacaggtgaagaagccgtatatacactcgccaaaatgaacaacaacacgaccatgatgagcaaaatcaacgccaaaacgcgtgctgcacgcggtcatatgcctgtctggtactattacgccgatccggtcaccatcaccggagagaattggtggaacttccagtacaccacttcactggccggctatgcgatggatgactggacacgtcggcattcgtccaagcccgaagtggatcagcgtctgtcctatgccgccaagctggcgaacatcggggcgattaactcgggacagatcagccctgatcctgccaatatcggggcggtatcgtggacatatcaggcgggcaagggcaattatggcgcactcggtctggacggcggccccctctttaacggatggcgcgggatgtccggggaagccgacctggggctatttggagccattaaaatcctaagctcggatgttgctgtagatccaatattcggcttgttcggctatggctgtgacgttacagaaagcagtaacagctacgcgatcactccaaaggacggtgtattccagcgactgcatctgatcacccaaaagctgagtttggagctgaatcgggaccaatatagcttggccatcgtgtctaagtccaagaacagcatccgcctgacgctgaaaaacacgactccaggcacgactcacaccaccattatgagcttgaccggacttgcggcaggtacgtatgacgtgctcgtagacggcacaaaaaacggatcagtcacggctgctaacagctctacgaccacggtcagactgaatatcggtacggcagccaactatgatatccgtatccagtcgagtacagacaacccgtctcccgccggagacattgtagcccgttatgaatttgacgaaacggccggatctaccgcagccgattcgtcaggttatggacagcaggccagtgtaaatggaggtgcgtggggagccggacggaaaggcaatgccctgcactttaacggtacagacgcctatgctagcctgcccggtggtatcgttagcagcctaaatgactttacgattgccgcgtgggtacgggtgaacacgcataacggctgggcacgcctgtttgattttggagcaggcacgaatcggtatatgtttttgacacccaaagccgagggaaccggtatgcgctttgctatcaccgtctcggggaacggagaggaacaacagttgaatgcgccagagctggcaacaggggtttggaagcatgtcgccgtgactttgtcaggcaatactggaatgatgtatctggacggtgtagaggcgacgcgtaacacgaacatgacgctcaagccttccagccttggactgacagaccggaactacattgggaaatcccagtttgatgatccctacctgaacggtgcagtggatgaactgattatttacaacagaaccctaaccgctcaggaaatccggggcttggcctcggcaagcagcaccattacagcccatgatgtgggagcccattcatatgctgaaggagcagattagaatgtattcattcatgccgttaacgttttagattatgaatgatttgtaccgtgaatgatttgcgtcgtgaatcattatcgtcgtaaatgattggtatcgtgaatgattcttcctatattagctccacccccggattacttaagttaagtctataatcaggggagaaatccggggagatgatgcttccgaagcaagcagtccttcggaaagcttttaaagcgaccgctttattgggacgatcagcggcagcttttccatctggagggcgtttagctccgtctaatgcgtgtcgttcttggtcttaggcgaaccagttcctcactggtgagctgcctagtataggagcgaggggaagaacctgtatctaccctgagcaccctgcctgccccgttggggcgggctacccgtgtgttgaatacctgcatggcccactgcaccggaaaggctatagataagcgaccatctgccgtgcctgcatagttgaccgcagctgcataattatctgactgtctgagccatacagagccagaatccccaggtagtgatacgggagtcgtacctctaataaccgtctgatcttcgaaggtcagcaggcccaactccccgccataattgatttgcaggtccgtatagacggactctaccgtgccattaacccgtccggtcgtacgcccaaccttcttcaatctttctcctatgcgatatgcggtaacatgacctggaatcgctcctaccgtagcgtaacgcggattgagtaggttgttacggggcggaagcgaaagcgccgcatcaatcaggtttgtaccggtgggattcaagcgtacgtaacgatacagccttcctatacgatcctgagtaaccgtccccccatcggctccgcctggctgtattatagcctcccgattgtctgtattggagggattaaggacatggttattgctaaaaagataacgcgtcgccggcgctccagttggggcaacgatgagtccggttgaaccggagccttcaatcgtcccgacactgtagccggcgatgaccgggcgtatgcgcactttgtagtccgtggcattggctctgatctttccagtctttacaattcggactggaacgttcgttttctttcctaaggcggtggccgacaggagtccagtagaggccgacgctagacggtccgtatacacaatgacagcggctccctttttgggatgggccgggtccctgtatcctacgccaatgccgtggacaccggacatttttaagactcgcttggccatccgctttttcacatgaagcgcggccgagaaggtagccaacataatcatctccttttacattcagatgaaatattgtatggctagagacgtttcgcgttccatttgatcttacgatcgctgtattgaaaggcatatgaaaacattccaaaaaaatggtatactcattttcgaaattgacatcttatcattggattttaatgttcaaggaggtactttatgttttcaatcatgttgacatacagcatacaagcaattgtaattttactaattatctttgaatggttgagaaaaaacagaaaaaaaataggttggggatcactttcactgcttttatctcttcttggtatggctgtttctttcgaatttggcaattatatattgggagaccagttgctttcctttttaggattgcccgcctggtctaacagtgttgataatactaggtttcactacaccatttttctatccagtattttttttattcccagtttagtcattggatataaaaatcctaaagagtttggagctacgatcggaaaacgggtttctagtatatatctaactttgatcatcatttcgcttttattttttattataagtattttctcgaagtaacgttggatgtgcgtcgttccaaaacaaaagccttcctcagcggagggtttctgttttatcacattaaatccaaacaatccggggtgagtaattagatcaaggagttggtattatctataattcatttacctccatattttttgctgcgttaactgcaatcaccctcataacgttgccaaaattagaagctagggtgagtaagagaacaatgttgaaagtgagaatttccttaataacaacagttctgctgatcggagtcgtgttgtatatcattgaccctcagtggtggatcattgtagcctttgcaattttgtttgtaacccttcctatctttttattgaaacgttggcgcgaaaaaagctgaatcagagaaaaagccttccttgttgataggaaggctttccaccttatcccttaaccgctccctctgcgataccctccatgatgaatttctggaagaaggcatagatcaggataaccgggatggaggtcagtacaagtgcggccagaataagcgaccaatccttgttgtactctccaaacagcgtattggtcgagagaattagagtgtaatggttcacatccgtcagcattaacaatggaagcaaaaagtcgttccaaatccacagaaaatccaaaatcgcgatggtaactgtgatcggcagcagcaaaggaaatataatgcgaaagaacgtttgaaactcattacagccgtccatttgtgcggattcttccagctcacgcgggatggatttgacgaatccatgatacaaaaagatcgccatattcacacccaagccgatatagatcaaggccaagccgtacgtactgccttgaacggacaaatcttttgccattcgtgtaagcggtatcataatagagtggaacggcaccagcatcgatgcgacaaacaggaagaaaatcgcactgctcagtttcccctgtgtacgagacagcttgtagcctgccagtgccgaacagatcacaatgccaccaatgccgataaaagaaataatcgtggaattaagggcactgttcagcaaatgagtctgatgaaaagcctgactgtaattttcaaagtgaagcttcgtcggcagcgccgtaaaggatgcaaacatctcaccctgtgttttaaacgagttaattaccgccatgtagattgggaagaaggacacgacagcgcccacgcacagaatcagcgtaatcagcaaggaattggctttcttcagcctcatgcctccacctccctcttcttcatgacacgcagctgaatcagggtgaaaataagaacaatcgcgaacaaaataacagatttggcgctcgcatacccataacggaagttgttggagaacgcctcctcataaatgttcatcgtaatcacctgtgtactgcgccctggccccccgccagtcagtccgtatacgacctcatacaccttgaaggcaccattcagcgtcaggaagaaacagatcgtaatcgcatgagtaatcatcggcatcgtcacacttcgcaatgtctgaaatgcgttcgccccgtcaataatagcagcctccttcaagctttgtggtacaccttgaagcgcagccagatagatgatcatcatatagccgacaccattccagagcgacacaataatgatagagaagaaagatactttcggatcgcccagccacgattggcccaaaaaggcgatagtcgtcttttcggcgatctgtggcagcacggaagaaaaaacgaatgtccacataaatgcgctaataatggtactgatcatattgggcatgaaaaatatcgtccggaaaaatcctttggtacgtgtacgcgactcaatcaacactgccagagccagtgccagtacattttgcagcacaatcatgaccaatacgtatttaagggtaaaccaaagggaattgagaaaatcggggtcttccttcaacgattccacaaagttccccaagccgataaagctataattgggattcaatccgttccagtctgtaaagctgtagtacatgccgctgatcgttggaatgagcaggaagatagcataaaagatcagcgccggggccgtaaacgccagtagcatgacgtattttttatagattttaaaaggcatggagtctctccctcctggtgtaattctataggttaccgttacttgttcactttgttatacgatttccatgccttatccagtgccttaatgacgtcatcctgcgagagctgaccagcataataggattgtagcgatttccctgcctcgtccttaaccgcttgcgggatagatggatcttggtacgacttgcctgcttttacgtattcggtagcgtcattaacccaaggatagcttttaaacgtatgcactttggagatcggattaaatttcaatgcttcatagaacgcgctagaatccttgtcatccagcacatagttaacaaaatcgagcgcaacctccttgttcttgcttgtggaggatacagccagcgaagtcgaagtggacaaattgatcaatgtcgcattgggatcgtcattgatcggcagcgctgctaccccaaaatccatcttcggatcagattttaaaatcgtttccgcaaaccacggtccctgaatccacatcgccgctttacccgaagcaaacgcagccgatccatcatccccgccgatttcaagcgccttgtcagtaccgttgctattcaccagatcaataatatcgaacatgctcttcatttcggaaaaggagccttggtcctgattcatccgttcgataaaatctttattctgtgtgttcatcatcgcacctgctgtcagaggcacgaacagctgtggaatccaggattccttgtaagacaacaggaacggttttacattattcgctttcagcttctccaccacagccttcatttcggtcaacgttcccggcggctgcaaatccaaatccttaaatatctttttattgtacaagtagccccacgagatcgtttctaaaggaaccgctacgacctttccgtctttggttgtcaccgaaggcttcacactatccatcaatttgttaacaaaaggctgaccggacaaatcctccaaatagcccgctttataaaacggaggaatttcattcaccgcgtgcaatgcaaatacgtccggcgcatcgttggatgcaagtcttgtcttcaaaatttgtgcggcgttgtcagcaggcggcatctccagttgcaccgtaacgtcgatatttttatctttcttctctttcgccacgaaagcattaatgtatttatcgtagtgctccttcaaacggggctgagcaataaacattttgagattcaccgttttgccgtctccaccggaaccgttgctgtcactgcctgaagaattcgctccacacccggccaataacgtgccaaccagcatcgtgctcaatacacatttccacattttcatgaaaaatgacctcccctattttgaaaataaccgttgcccatcggcaaatcagttgttattcaaagcagctatgccgccggtcttcaacctctattcagctctgtgcgaacttcataaaggccaaattcctttgtactgctcattttgtatacgctttcattatagaatgagaggtcacttctgccattggacacccttagcttattggattggacttttttaaacttccttcctcatttcaccgggtgccatgccaaaatgctttttaaatacccgatagaaataagacacatcctcatatcctgccatctccgcgactgctttgattgaaatctgtttattgaccagccattcccgcgccttttccattcttcgctctacgatgtagtccgttacattttgaccatactcctgcttaaataccttgctcatatactctttgctcacaaaaaagttttttgccaactgctccagtgtaatcggcccagcaaagtgactgtcgatatatcgccgtacttcttctaaattcagtttgtttttgtatttccgctgccgaatgagctgatccagttcctgaacatagcacgacgatacgaattccagcgcatgttctacagaggatacggcatcctgcgacagtggaaatcctgcctttgccgtagaagtatccagcccgttatccgctgtgagctcttttagtagggaaagaagctcctgcaccagcctgcccagcatatgtggactcggtgctccataactctccagctcctgcataacctgcctacaagttatgttcaccccgtcacggttcaactcattaaaataaagacgcagcagttgcttataccgggtcagcttgtgaaaaaactcataatccagctccgtcgcttcttgctgctgttcagcagccttgacctccagatcgtttttgcatttgagcaacactgcattcagctctgcaggattgactggctttaacaaataatcgacggccttgtaacggatggcatgtttggcatacgcaaagtcatcatatccgctcacgacaatgatttttacatcaggacaatggttatttagcgcttgcagcagctccactccgtccgcacccggcatgtgcatatcagtaatcacaatatggggagctaactccccgaccagcctgaacgcctcgtctccgtcttcagcctcacccactaccaacattccaagtttttcccatgtgccaaatgtccttagaatatcgcggttccatggctcatcgtccacaattaatactctaatcatcttttccctcctctgctgaggtaaatggaatgcggatagtgacacttgtaccgactccctgctcactatctatcgtcactccgtagcgcactccaaaattcatccgtatgcgtgaagacacattgctcaatccgatatgactaccctgcgcccagatcggttcctccgacgcgttttccagctttgcccgtactttttccagcttgtccggggccatgccgtttccattatcgcaaaccgtaatacacacatcttctttcataatctccacccgaatccccattctccatgcccccgcctttcgatcaagaccgtgctgaaacgcgttttccaacaatggctgaagcgatagcttaggcaatcgaatatccatcgcctgttcttccgtctccacctgaaacaccaatctttgtggaaatcgccgttgctggatgcgcatatagtgtcccatatggtcgagctctgcgcgtaaagaggccaaatcctgaggttcccgtaccacgtaacggaacatctcactcagcgaccgaatgacttcataggtgtcctccggcttttgcgaaaacaccatacttccgatcatttgcagcgtattttgcagaaaatgtggatgaatctgcgcttggagcgctttcaattcagccgtctttttttgcaaatttatactgtattccgcctgaatatgctcgcgaattcggcctgccatcccatgcagacttctttccagcagcccaatctcatccgggcgtgtacttggctgtccaatcggtcctttgatcatatccagctcctgtacggaacgcgccaaatgaacaatcggacgtgcagtccgccatgcgatgaaaacggcaatgcagatggaaaccaggattgaaatcacgccgacgataataccatacagcatcgttgaaaaagcgctgtggttaatggaggaagtgggtacgattttgaccagcttcagcccaactacatccagatcattatagaatacataatgttcagcagtttgaatcatacctgggcccggcttaacgtcacgaagagctgtcagcacacctgcaggcggaggcgcctgccgagcctgtgctggatacataactctgccatccccatctgtaataagcacctgatgctcatcccctcgtcccagcaggcccagcgtctgatcgaattgcgaccacaatacatccaaagaaatagcccccgtctgcttctggtcttcaaaacgccgaatactgcgcgtcaaaataaagcgttctgggtcagcagagcttggacgaatcgaataatccttatttgcttgccacatctcggcatactgtgggggaataccgctcactgtcgtaatttcattttgcatactattgaaggtaaacaaggtttgcgattgcttcaaataaagctggatgccgatcacatgacttccggccgaataatacacattcgccatcgtattcagcatttttcgctgggcattaaattggcttgaaagattgtcaggctcgcgctcattcaaataatcgctcagatcagggctgatctgaatgctgtaaatcagatgattcagacgatctagctggtcgctgatatagatccccgtccatttcatattggacatgttcgtctctactacttcagcttccatggaagctctacttttttccgcagccagcaccgtgacagcaatgaccggcagcacagatagaacaatcatcgtcaagatcagcttgagctgaatgctgcgtcgatacggggccgtcagcgcccggaaccagtggactgctcgggttgtcatagcgatgcactcctctattcagccatatgcgaaaacgccccgcaattcgcaggggcgcttcatgtaccggatactcccggagaatacctatatgatattattcgtgagtcggtttcggctcattattcatcatttacgcttcctcgataattataacaccccaaggctctaatgtaagcgtttgtccttgggtaaccgcatgctccccaatcagctccttgccgtctccatgaggatataccaccgagcctgcttgttcggaatagttaaaatagtaccggattgtccgtcccagctcattcgtgccggatttgacaatgatcggataagacgcttcctgatccagtccccatactcctgcctttttggctacagagctgaatagttcacggatgaccgccggactgacgacacagccgatataggtcgctgttccctgaccatagcggttttgcgtaatcgcggcatattttccccaatgcggatgatcgtaataggccaatacttcagcagtcgtcggggtaatcagctccatccacgtatctacctgattgtcctctggtgccacctcaaaaggattattcttaagcgtcaccttcttcggctgcacgaacaagctgtaatgaatgccgcaggcttcgctaatcacgcccggctgccgggacgttcttacctgcacatgctcgtcggtaaatccgcttcggaatgtgtatactacatgaccacctttctccacatatcggttcagcttctccagtagtgcatctggggcagaatagagaactgggacgatcaaaagatcatagtcttcaaacgattctgtacctggatgaacgatatctgtcgcgatattcagtttatacaactcgtcatacaaacgacgtacgatgtcattgtaatttaacgggctactcatattaaatttaaaccagtcaatcgacgtcaatgcttcgttgctgaccagaatcgccgttttatttttctttttcaggttgaccagatgcggagacaatcttgcaaaatccttccctatggtctgtgcttcttcatacacaggattcggctcaaaatcatggctcagcagacccttccagtaggtttcgaaggaattatggatggaatgccaatgccagtatgccaccatattggccccggaagccagatggctgaacgcttgcagacgcaattgccccggatagggaacccagtgggtaaaagcctgcgcttccgtttccagcactagatagttgttatttttcgtcgaacgtgccacatcgccaccgaaggaaatttcaatgccagtcaggtcatcctgtgatggatggtaaatatccaccccagtcacatcaaaggcttgcgatgccgcaaagtgatccacgtctggctgaacaccaaaggaatgacctctccacgcaaaatcaaagttttgcgtaacaaattggtcctcccgcttatattccttcaccagcgcaacctgccatgccagaaagtccgtcaccagcttgcgctggaattgggaaaaggctgcgcccaaacttccattaatcgttccgaccaccgaaggaaagtcctcccagctattgatacgattactccagtaatccagaccgaatttgcggttaagctcctccagcgattcgaaccgctcccgcagatactttacaaattgcaattgcacattgggcccgcttgtgttgtaatgcttcgtctcgttatccgtctgaaagccaataaccgccggatgctgactcacccgcccaatcagcttgcgtatgattcgctcggcatggaacaggtacaccgggttcgtaatgtccataatctggcgagctccatatttgcccggaccttgaggcgttgtcgccaatacatcaggatgctctttcaccagccatgtgggtacggcataggtgggcgtccccacaatgacttcaatgcccgctttatgcatggcgtccagcacccgatccacagaggtaaaatcaaacacaccgttttgcggttcatgcgtactccaagtggattcggcaatccgcaccacattgatgcccgcatccttcatcatttgaatatcttggtccaaacggtcatatggcatatattcatcataataagcaacaccgtatagtagctttttcatcaagtcgtcctccaattaggttcgttaggattttgcaaaattcgattccagtcgcttcgaagtgcaagatatagacgaaccaagccgccctttagattggcacggtcaatgatcacgccgaagatcggagcgctaagtgcatcccatatacgggctagtacgaataaagtactgataatagaaacagatatgccaacatgatccgtataaacatcagagcaagcgctttcttttatatataaaagcttatactatagcatttgtaaacgctcttttattatagttaaatgttagatacaatgagattgtctaagcggtgtaaaatttgccctaatcgaaggtgatctgatgatattaaatcctgatgttgatccagctctatttcatgattgccaatggctgcccattattgactggaatgtgaaattttttggcgcccatattcaccgggtccaagcggattggtgcatgccggaggagtctcatatcggttttgaaattgcactcattttagaaggtcgtcaggaaacgattatggaaaataacgtttattcggttggggaaggtgatattttaattattccgccgggtttcaaacatgtgagtcaatgtgtttccccaaacggcatgtactattttagctctcattttaatgtcgatgatccattgttccgtcaggaaatgattaagagcaatcagctcttttttccagcgggtactgaaacgaataccaagctgcaaaaggtcgtccatagctggattggcatggtgcaggaaagcggagaatatacgacagcagaccgttttcgtatgcaaattgccttatttgagctattcgggatattctcgcaaatgatatctaccggtttggagcccagaattgcgccttcatccgttcaatatgccaaggccatcatggaagccattcaatcaaggtttaagccttatcgggaagatgaatctggcgagcaagcgttccgtcttgaagatgtggcggcttccctcgggatcagtcccggctatgcccaagaagtgttccgcaaggtatacggctattctccacgtcattatctatcggagaccaagctgcatgaggctaaggtgctgatccagcagcccaatctgccactcaacaaggtagcttccctgctcggatactccagtctggctcatttcagcagacagttcaagcgctggacaggcaccagcccacttaaataccgccagacgttaaaaccgattactgatgaacaaaggattaagatataaggacggatagcaaaagctccaccgtgttattcaaccaaaaaaagagcgtgacaccgaatatcgcggttgtcacgctcttttgtctctattttctataagctgtaccgttgccttaatgatctaaaatcttgaccaagcactcattattcagatcacagcctaatatcccctatatgctggtgcaccacatacatcatccccatcaggaatacggccaaagctaagtaactgatgccaaatttccagcgtgatgatgcgggcacttcgtaatatttatcattttcaaacggaatgtaatcaatcccacacagcaatctgagctggtacgcatccggcgtcggtatatgttccacaccgttcagccatacatgctggacaagacactgctgcggcagcttaagtgtctgctccacatccaaactttccatatacaccgtcacatattgctgcccctccaaatccgagtaggtattaaaggataatctgcgtgtatgctccggtccgggcagtggatatccttgctcatacagatgctgtacattcaccagcggcttttgcaaaaaagattggatcttgacctctcctttattgcgtttaacatattttttgtacaaatcgtaggcaaagaacgcccatatgaagaaaaataaaaaggattttaaatatactacgactacaattccacccaataagcccaccagccacagccaacgcgtcactgccgtggaaattcgtcctccgtcgagcggatgaatcggcagcaggttgatcaggttcagaaaaaaaccgacatacgagagcgcatacaacaggggactgtctgttgcataggctcctgcgtataccgccatagccccaaccgtccccagtaacgggccgcccatggctacataagcctctgtctgcgcatccaaaggttgccgtttcattgtgatcagcgcaccgagaaaaggaataaataacggtgctgacacgggaagccccttgcgcttggcagcccatacatgtcccagctcatgcacaaacaacagcaacacgaatccaaccgcaaatccccacgggtaaatgatcgcatatgtgctaatcgttatcgccatagatatcagcgcaccgccaaatttactgaattttaaaagggcaagtaacgacttgcctttcagaagaagcaatgctgctgcactaccaaggtaccatttggatgagccggatttggaatcggtctttttctcttcattttgcaaaggtatccgtctcctttctttaacacttccattgtatcctgctatgtgcagcttgtaaaaacttctctaacccacagataagcacgcaagtgtccatccgcctgtctgttctgttatcatgtaagaaaacggaataacccaggaaaggattacgaatcatgagttttgaacttacccggcgagccatcagacaactatgcagtcaagccgcttatgacgacggggatgcctattaccgggccaaaagagtggcctttacacaaatagatcatgatgaaggtgtgtacgaagctacggtcaaaggaagcagcttttatgctgttgcggcgatgatccgatccaatggaagtatccgagcagaatgcacctgtagcacatttcagaacactggacgatattgtaaacatatcgcagctgttctccttaacgcccatgatatacgccgtggaaaaagtctgtctgtgcgctcctatgcctccaggcttcatcccggtactgccccagatacagcaggaagcatggattcagacgggatgtacacatctacagatgctccatatgatcacaccgctagaacggcacgatcctctgacctcacacgaggcgatctccagctgaccgacagtatgttaaaactatttgaccgcaagcgaccgcttcgcagcacaccaaccctgctggatactcgcgcggtcttggattttcagttcgtcatccggccttttgcctacggctaccaaaaatatatgtttggtgtggaaatgaaggctggtcccaaacgattatatatcgtgcagaaaattcgtccgtttctggatagtattgaccgtggggatagctacatgttcacaaaaagcttctcgtacgagcctgagttgtaccgcttccgtcctgaacatgacgctattctccagcaattatcccaggtgtgccaccatgagcgtatgattcgggaaacctcaggcacgtattcatcttccagtagtcatatgagcggcgagcgaatgctcctcatcccgcctgcggcttgggaaaagctgctccccttgctgacagcagcacagggcgtctactttgaaattcacggaaacatgagcgagggtattccccagtccgacctgatgcttccgctgcaatttgaatttgatgaggccgaaatcgaaggctaccagctaagcattcaaggattagatgacttgaccatcatggaagactatggtgtcgtcattgccgatggcaagcttgtcaaacagaaatccgatcccttacggcgtttgtccgagctaaaacggatggtagaagtacaccacaggcgaaaagttcagattgcgccagagcagatggaatcttttatggacaaggttgtacccgggttaatgaagctcggacgtgtccatatgactcggtccgtctcagatcgggtcacacagcagccattgaaggcaaagctatatctggaccgggtaagagacaagctgctggcagggctggagttccaatatggggatatcatcatcaacccgctggaaacagatgcacgaacgcctggtatcgaccgaattctgatacgtgatggggaacaggagcagcggattttggagctgatggagcatagctcctttgccagaacagatagcggatattttatggaagatgaagatgcagagtatgattttttgtatcatactgttccgcaactggaaaagctgctggacgtctatgccacaggtgcagtcaaagcaaaaataaacaatactctgcctaccccaaggatacgcgcggagtgggatgaacgtacagattggcttgaatttaaatttgatatggagggcataccggaaccggaaattcgcaaactgctcaaatcgttagaggaaaaacagaaatatcaccgtcttccaaatggtgccttgctgccgctcgaaacagaggagtacaaggaattgattcggttcatgaatgaaacaggtatccgcaaaagcgatctggatgcagcgcaaattcgtgttcccgtcacgcaaggactgtacttaattgatcctcacgatcatgggaaaaacctgactttgggtaaaacctttcgccagctgttggaaaatatacgtaaccctgaccatctcgactttccagttccagacatgcttgccccaatcttgagagattatcaggtttacggctttcaatggcttaagacattggcgcattaccgttttgggggcattttggcagatgatatggggctgggtaaaacgctgcaaagtatcgcctttctcgtctcagtattgccggagatccgcagccagcagcttccagccatgatcgtgtcccctgcatcactggtgtacaactggcggaatgagctggagaaatttgctccacacgtccgcgtcactatcgcagatggcagcccggaagaacgcggccgaatcatacgggatgccgccagttatgacgtcgtcattacgtcctatccgctgctacggcgcgatgcagatgtgtacagcaagccatcgtttcatacgctcattctggacgaggcgcaggctttcaagaaccatgccacccagacggcacaggctgttaaggatgtaaaagctcgttatcgttttgccctgacaggaacacccgtagaaaatacgttggaagagctgtggtccatctttgacgttgtatttcccgcgctatttcccggcgggaaaagagcgtttcacaacatgcctcgaaatgtgatcgccaagcgggttcgtccgtttttgctgcgccgtcttaagagcgaggtcctcaaggagctgccggagaaaatcgaatccgtgcaggtatcccggcttctgccagatcaaaaaaagctgtacaccgcctatctggccaagcttcagcatgaaacgttgaagcatctcaacgaggaaggatttcagaaaaatcggatcaaaattctcgccggtctgactcgacttcgtcagctctgttgtcatccgggcttgttcatcgaaggatatacgggaagctctgccaaatttgaacagctgttggagatcattacggaatgtctcagctccgggaaacggatgctcattttttcacagttcaccacaatgcttcaaatgatcggacgcgagcttactcgagaaggggtgtcctacttttacctggatgggcagactcctgctctggaacgagtcgagttgtgcagtcgcttcaacgaaggagaacgcgagctgttcctgatttccctaaaagcaggaggcactggcctgaacctcactggtgcagatacagtcattttgtatgacctgtggtggaatcccgctgtagaggagcaggctaccaaccgagcacaccgaatgggccagaaaaaagtcgtgcaggttattcgtctcgtcgcccaaggtacggtagaggacaaaatgtatgagctgcaacaaaaaaagaaaaacatgatcgaccaggtcattcagccggggcaagaaaccctttcggcactgaccgagctggagattcgtgaactgctcatgatctagccaactctccacgcttatttttacgttagtatgacaattccacatgcaaaaaaggtccaattgacggtagaaattttcccgcattggacctttttcgttctaatatgattgtttggatcaaacagattaatcctgttttaatactctaggttcaatgggaaccaggttagactcaatctgggtacgctgaggctcataccattcaggcagcatcagcttatgtcccaactcattcaattcctcatccacggtaaatccgggtggatcggttgcgatctcgaataaaataccgccccgctcgcggaagtatacggcattaaagtattggcgatctacaataccactggtcccaaaaccatgctgatgaacccattcgttccacgcctgatgctccgtatcatcctgcgcgcgccaggcaatatggtgaaccgtactggcgccgccattcccccacgggacatctttgaccggaatgtcgatcaggttgcccaaatcacctgtcgtctgatagcggatgtagcctgcatttgcgtcttctccgatgagagtcatccccaggacgttctccaacaccccttgcgtatgcttggaatccgcactgtacagtaccgccccgccaaagcccttgatagctttatccgtaggcacacccccggctgtccacgtgttcaacgggccatcttcccgctccaccaactccagatgcaaaccctcgttgtctcggaactggatgaatgactcgccaaaacgagtggccttcgtgaaagatactttcaagctgtgcagacggttttcccagtattccaaagcaccggacgacacgacatacgtcgtaatcccgacctgtccgcctccaatcttacccttgcgtgtacccggagctggaaaaaaagtaatgatcgtgcccgggctgccctcttcattaccaaagtacaaatggtatacttctggagcatcaaagttgatcgtctttttaatcaatcgcagaccaagtacgcctgcgtaaaaatcaacgttgccctgcgggtcgcctgcaaaggacgtgatatggtgaattccagcggttttcaatgacatctttatcactccttcattaacatgttgatttatttacacaaatgatttacaaatttcaaaatccattgtagctgacaaattgtccaaccggcttgcggtatccccgtgcccgctgacccgattcgtcctctttacccaaggtaatcatcatcactggtacaaattgctctggaatatttagtacttcctgcaccttcgccggatcaaaaccgatcatcgggcatgtatcccagcctttgtccttggcaatcaacatcaattgcatagccgacaggctggcattacggatcgcttcttctctctggaagacaggtccccgctcgcgataaaactgagttaccgactctactgtgctatcatattcctgcttgctcagaacgcccaaattcaggaatccttcgttgaggtcggctaccttggtataagcctctgtatcccccagcactataatggtcgccgaatccgttaatattttatactgcttacttgcctcatcatgcagtctttgtttggtatcagcatcctgcactacgatataacgcgcatgctgtaaattaaaggccgatggagcaaacttcaccagctgaaatatttcttctagttcttttgcatctatagtaacatcaggaataaatttagaagctgatcttctctcttgaataatattcaccagttcgctcatgttaagttccgctccttgatattattttcaaataaattatctttaaattaagaatatatctattcgtgatttctgtcaagtaaaactataataatgttaataagtatgttgggatacaacctaagggcttataccagccctttacagatccgttgcccgtattctcatcgtaatcgcttcgcgttgcgctttggttaagctcttgaagaccagctcatacgaatggtcgatcatgctgtacaaatcctccagtgggaaggtagcatcaacctcaatcgtattccaatgctttttatttaaatgatagcctggcttaatcgctttgttttgttcacgcagatttaccgcaatgatcggatcacatttcaaggataggtagctaatgccgcctttttcagataatagagcaaacattttgcccccaactttcagtaccagtatttcagcaccaaatggataatccttaacagcctctttttggctcagaccatacgctacaatttgttcatacaccagccttcactcctttgcttgagtcatcatctatgaaacgatttgtgccctattatatcacgctctccacttacaatagtcccgtaagatttcacacggtgacgaagctgccatccaagaatgaggccaatttatattcgctgtttgctggcaatccgaaggcacaaacgcttatgcaatgatcgcccttcgtggttgttgcagacgacggacagcgtctgggcgtatatgacctgcgtttctatcgggagggtcaatcctttcaatatgttttactgtaaagtcaattatatgaagaagcggcagcttcgaaggtgagatataatcttagactgccgctgcttttcctttattaaacttcaaaaatctaaagagttcctgtgcttaagcaagcttgctcaagcccttgaagtaatgcttctagctcctgcctagtttcagcgcttgtaatttcaccttcctggtttagcttcaaggtgatatgcggaataatgacctttccattctccacaatctctgcattgatcatttgcaatgtgagcagcagcgaggcatgcgccagatggccgcccataggagacggcgacgcgctgatgaccgctgtaggtttatttacaaattcacctgaagatacgagccaatccaaggcatttttcaaagcacccggcaccccattcccatattccggtgtacagatcagcactccatccacttgtttcaattgttcccgtagctctcttacggaagctgacccctcctctacatccaagtcagggttaaaatgcggaagatcccccaatccatcatagactgtgaacatcatattttcagaagccagtcccatagcagccttcataagcgctgtattggaggacttttggcgaaggctacccgatatagctaataccttaattttctgttccatccgatcatctcatttcttttatcttgatctaatcttgcatattcagtgtactatagctaacaagagaattaaaaagtggatgaacgccagcgattcttcctatgaacaaacgggcaataaaaaaatgcctgcggcttcgcaggcattggtaatgaatcaatagtcactatactagggtggaacctgtagtgctgaatcaagtatccttctcttgcttgcgttttatcccaatcagatccaggaagaaaacaaacaacggaatacctacaatcaagccccaaattccaatcagatgctcagagaaaataagtacgacaaaggtaaagaatatcggtaaattcgttttggatgacatcagcttcggatttaagaaataggcctcaatcgcatgaatcaccacgatcagaataaccagataaaccacatattgaatgccgccgacactgaaagcgatcaggccgagcggtgccagtgagataaacacacctgccaccggaaccaatcccagtacgaaaatgatgagcgcaagaccgagcagattagggaagcccataatccagagcgcaatcgtggtcaatatacaattaataagtgaaatcagcagttgagcctccaataccttcccgaacgtacccagaaacatacggccaaaatgacccacttccttgaaaaaccaacccagcttgctatctacaaacgtagctgtaaaacgtgtaatataggatttttccatcaggaagaacaagctcaaaataattgacaccagaagctgtgttcctaattgactgaccttcatcactgcactcaggccaggctcaaatagccgctgagcattcagcgtgtccataaattcgataatcgtttcgttccattgattgcgatcaggatacatatacgcttgctgaatcatgagatacacctgcttgacctgtacaacgattagcggcaccattcggtaaacgccccacaccataatcagaattagcaaaccatacaccaggagtagcacgatcattgacggcacattgacgaaccgcttgaccagcttattcactccgttatatatactgccaatcaagatcgtaagcagcagtgttaacaacataatattcatcatgcttcttaacataaacaacagcaaaacgattatcgcaaggacggctatccgcctgacgcccgcatgattcatccagtttcttaccattcgtctttattccctctctcccacttgactgtcaactttgcaatcttcctgagcatcaactttctctttttaacaatttactgttagcgatcaatagagaacctaccatgactaggatagcaatagaccaccagaatgtatttttagcatcatcatgatctacaataatgagcctgatgacagccgtgatcccaatatagataaaataacgtaatggaaaatgaaaattggttttaaagtacttaactattaatgctatgaattcaaagtacaagaaaaacacaagcaactcttccgtgaattcatagtaatttttgtcggtctctgcgtacaaaaaaacataagaaaaaatggaccatgtttcttttagcagtaagaagcttaaaatcagcccgaccagaaacagcgagatattcaagatcatttgcagaaaactcggtaacttctcaatatacttcattagtacattcaatacagatcccctcactggttgtacagtatctttatttatattatcggtggtatacgtgaaaaatgctacattacttttgaggtcaccttaatgaaagtttatattcgcccctgcaatataaccaatggagataaagataagcgtccatatcagagaacctgcgcttgccaccagcatatattttcggacaggcatcgcactaatgcccgacaaatagcttgtcgcatgtctgactcctgggataaaataaccgaacaaaatggtccacaacccaaagcgtgcaaaccaccccttaactcttgcaaatcgcttcggtgtcaatccaacccacttgccgtgcttatccaccaagggctgacccagctttttgcctagcgtgtagctgatcatcatccctgtcattgcaccaatgaagctgactaatatagacaccgaataattcagtaccataatagaagataaatagccgacaaacaccataataatttcatctggaaccggtaggccgataatcccaagagcaagaagagcaaaaatagcgatatatccgtattgtgtaatcatgctgatgacccattccataggggagccacctcctgaccgattattttttgaaggacggaaagggaatacggctaaccatcaggaacgacagcactaccattaatgcaagcaacaaccccggcttcaaatgctcactccataaaaacataaaggacaaaatcacacccgccgccgtaatcggcatacctacaaagcctttgctaaaagccattaggttgaatcttgccaatcttaccgcaccgcatatgacaaacaaaacagccacaagcggtcctatccaatgggtatctcccagcttgtataacaagatcaagaaagcaggggcaaccccaaatgagacaacatccgccagcgaatcgagctgtttgccaaaatcactggaacaatgcaacagccttgccagcaaaccgtctaatacatcccataaagcagccaccaccacgagaataaaagcggtcatgtattgctcatgaatcgtgaaatacagggataagacccctgcccccaggtttgcaatcgtgcatagtgagggcaaccaattccatttcatactcttaactcctttgccatagcttagcctccgaatataacaacaaaacggacgccgtccttggtattctccaccttatagcggaattcgtgcaaatccaaaattcgtttgacgatcgatagccccagtcctgtcccacctgtctgacggcttcgggacagctcggcccggtaaaagcgatcccatatctgctccagttgatcgtcaggaatggtctcacctttattttcaatggaaaaaaaactgatttccccagcaccttcgatacgaatcgtgatcgagcttccttcctcagcatgtcgtatggcattgacaacaaagttgataatcacctgttccagccatcctacatcggcatggatcggcatctcattggcggggataatgaccacttccagctttttctccttcaacaaatgaaataacttgtccacgacctcctccaccagctcactcaagatgaaggtcgtcttgcgaagcttgagagtacccgattccaatttggcgaggtccagcatatctttgaccaagcgctccattttgtccgcttcctctacaatgactttcatataatgatcctgcttcccagcgctaactccatcttgtaatccttctgcgaagcctttaataatactcagcggggttttcagttcatgagaagcgttggcaaaaaagtcttgttgcacagcctccatcctctgcttctgttccatgtcctccaccaattgctgattggcgtcctgaagctcgcgcaaagctgtgtccaggttctgggacagggtatacatgctgtaggacaggctgcccagttcatcattctgccggattggtgtatgggctgtaaaatcgagcttagccatccgcttggcggtattattcaaagcaatgagcggacgggtcaccatccgggaatagaacagggacaaaatcagaatgagtgcaaatcccccgatccctaggtacagataaaaccagcgcagagcttcattcgtctcactaatttcctgcaacgatgtcactgtgaacaggaggtcgatctcgcctgtgtcctgacgaacaggatggactatgactgcattgcgtacccctgtccaaggttccgtccactcttcttccaacacttcgaaattcttaagtttctccagatgcgcctgtgataaagggaaccattcctccagtgcactaaacagtaagccttgtcgctgactccatgttttcagatccggcagtacaatctctgtcaccgtaccggaaaaccttacacggccatctgtgcttgcctcttccgaagtcgatcctatatttttgaaaccaaacttctgtatgccggttggataaattaaattggcggtagagatgccgtccgttcccaatccctcaccttcaaccgttaccgtatcaccgggctgaatccgagcagctctcagttcatctccgtactcgctcataaacagagacagcgatattttaacgattttaccatccgcttttcttagattgatatgaaacgcatcatccagctttactttgccgtccagcgttacaatcgccagctggtttttattctgaagcataaagcgagctgcctcacgggaaaccctgcccgacccccaagcctcctggacataactttgaccgaagctttgcaagcggctttccacacgaccaatcttctgttcctgataaaaattttcaaaaaacagcaattgacttaaaatcaccataccgtaaaaacacaggaaaaacacaaccgtcataatgaacaacttaaaggtaactccccgtttgttcattcttcctcctcaaacctatagccagtaccaaaaaccgtgcggatatggcgtgattcacggcctagcttacttctcagctttttgatatgcgtatcgacaactcgtgtatctccttcaaagtcaatgccccacacccggttcagtatcgcatcccgtgaaataactatgcctttattatgtataagcagccgcagcagctcatactccttgggcgtcagctcgacttccgcctgatccacctcaagccgatgagccatcgtgttgagaatggcactaccgaaccgcaaaatatgcgactccggctgtacatgtccctccacccgtttcatcagcgcgttggcgcgagcgatcagcaccttagggctgaaaggtttggtcacgtaatcatcggctcccagttcaaagcctaatattttatcatcatcaccggatttggctgtcaacaaaatgatcggcacacctgagcggctacgcacctggcggcacacctcccaaccatccagttccggcatcataatatcgagtataatcaggtccggctgcaccgaatcaaaccagatcagtgcatcttttccattgcctgcttcatagacttcccaattattctgtttaaaatagtcagcaatcacttcacgaatacgtatttcatcctccacgagaagaactcttttcttcaatcgacttccctctttcggtcattctaggacaccagcatatcaaagacatgtgtactttatgtgttcttgacacttcttatcagcagaagttctcatccgcaaattcaaccttggattagggcaaatttgtcttggctcagaccatctcatctcctatgatcctaccctataataagaagagatacaaaaagcttgaacaggagggtaatacatgagtaatcaaaccattcagtggttttccacttccaaagctaaaacttggcaatcccaagctcatcatttgaccgatactcaagagagtgccaatctaatctttacgggagaaacacatcagcttgtcgaaggatttggtggctgttttaatgaattaggttatgtggccctgaaccatttggaaaaagacgaacgagatcgggtgcttcattctctctttcatccagcgggcgagcacaaatttgcgatttgccgacttcctattggagcgagtgactacgcgctggagtggtacagccacaatgaaacagacggtgacgtggagatgaagcacttttccattgagcgtgatcagcaatatctcattccttttattcgggaagcgttacaactcaatccggacttgaagttgttcgcttcaccctggagcccgccgacatggatgaaatcaccgaaagcctacaattacggcacgctgcgctgggaaaaggatattttgaaagcgtatgcattatactttgtcaaatttgttcaggcttatcgcgaggcaggtattacaattcatcagattcatgtgcaaaatgaagtcattgccgatcagaagttcccttcctgtgtatggaccggagagcagctgtgtgaatttattcgcgattatttgggtcctgcttttgaggaacacggactggatacggaaatttggctgggcaccattaacgcacccgatccgtgggaggaattaatgaaaaagacttcgaccggattcgatgagtatgcccataccgtgttgagtgaccccgaggcctacaaatatattaaaggcgtaggctaccagtgggcaggcaaaaatgccattcagcgcaccgttgccagttatcctgagcttcgttacatgcaaacagaaaatgaatgcgggaacggagaaaactcatgggactacgccaaatatgtatataatctgtaccagcactacttcaccaatggcgtaaatgcttatatttactggaatatggttttggaaccgaaaggcaagagtacatggggctgggagcaaaattcgatgatcaccgttgatcccgcggatcgaaaacctgtcttgaatccggaatattacgtcatgaagcacttttctcattttgtattaccgggtgcccgacgcataggacttcgtggctcatggactggaaatgcagttgcttttcaaaatacagacgggcaaagggtggtagtcatcgccaatccgttcaaggaatcgcgtgtgctgaatctgtctctcggagaaacaacacaccgcttggagatggagccggagtcctttaatactattgtgatcccttcttaacaccgcagatttctggactcttccagtcttgcacacatcattaggtacccctgtccagtctataagtgcccaagcatatgcatagtttccaaaatggatgtatatccttttgcgtatagtagctatagatagtatacttggaataactacggacaggaggtcgatgaatatcactactgtaaaagaccggatagatttgaagctgattaattgtgataaggaattgactctcgcggtcatcggtggaaaatggaagctgattattttgtggcatctcggtatggaaggcaccaagcggtttggtgaattgaagaagctaatcccccacattacgcaaaaaatgctgaccaaccaattgcgtgagctggaagaagataaactcattctgcgtaaagtctatcctgtcgtccctccgcatgtggaatattcactgacagagcatggcgaaagcctgattccggtactgagagcaatgtacgattggggatcaaactatcgcgagaacgtgatctggaaagaagaagaagagattcaggacgtcacacccgtgtgatcagcaaaacaagcattttgcgaaatgctgagctatatttttagtagagacgaccctggggagatctggggttgtttttttatgatataaagacgttccccaagataacaaaagaaatggatgcaagtatccgtttccattggcattaaagctcgtttttcgctacatatccccattttacacttgtatccgtgatttacattacatcctctgtgacgtaggattcttccatccctatttacagtgaatccaagaaggaggccgttctagcatgagcatgacgcttgcccagcccacaacgtcccaagcgacccaattacgcattggttccatggaaatgattcaatacgactatcgtcaatttcctgactcaaaaccttatcaacaccattgctgtggcttgcttactatgtcgtgtaacctcaaggtgaccatcctcccccctcggattagtcgttcttatctcatcgagcatgacctggtctactattcattctagatatcgtccacaactccattgtcaatccactttccagttcacgtaaaaaagcctgagactgtttatcacaggccaggcttttacactttcagcatagagttgattacacttgcaatttacctgcacgaatatcgtctgtcattcctgcgtaaggtgcttgggaaattagttgttcgttgttcacacccgcattttcgatgaatgtaatatctgcaaattcaggaaccacatacttcggatacgtttcatacttttcacgcgattcttccatcagcggaataaaatcgttttgatagcgcacagtgatttccggatgctcatgaacccatttagggaagaaaataatgccgtgcatacgtttttcctcaggcataaagttcagagaaacgtcagtgcctgtcggttcggtccacgatactttatacacattttccaccaacttcaccagattgaccttctgatcacgtacccagcggccgcctaccataccactatgaatgcgataatcgatcgtatcttcatttttaatatatatttcgtactcccaaccattctcataagtgtagatcatgtggctgccgataaacttgtccatcttgcatccttctttcctaaattataagtttttatgaattgaataggagaccaaagataataaacattcaattcaaaacatgtaatattaaacatgtttttaaatacatataaattgtagcactatggtatactagtgtcaaataacgtttgacaaggagagctacgttgaaacgcacattaaaatacgccattttgggcctggttcataaagaggaaatgagcggctacgatattacgagtcaattcaagaaggaaatcggacaattttggagcgccaaacacagtcagatttatcctgagttaaaaaggctgaccgaagaggagcttattgaatatcgcacctccattacaggagccaagctggaaaagaagctgtactgcattacccccaaagggacccaagaactgaccgaatggcttctaagtcccaaagagttaccagaaacggaaaaggatgagtttatgctcatgctgtatttctcagcagccatccccaaggaagagaacaagcgattgttcgaggatcagataaccaaacgtaaagagaagctgaagtatctgtacgaaagtaagaaatccctccaacggctggacgagaaccttcaagcccccggttctaatcagttcgggcattatctggtgctaagtcgtgccattaatcgggaagaaagctatattacgtggctggaagatacactatccctgtttgaatagcctaaaaaaccttcaacgccacgtagattcgtggtactgaaggtttttctaaaatacatacaaactagtctgccgtcgtaattgaagagccgtaatcttcaatatggatatctgtgctaaaacgtacgggaatggtactaaaagtggtatcccaatcctctttgaccttacgccaaactttaggatgctgaatcctcaaggcttctccgaagcctccgacatcagcctgcagcttttgcattttggctacagtttgttcagctaatgaattcactttctcctgaaagatactttcttcttgtccgagcacagcgttgctgcgcaaattttctttcttgttaaaaacctcggaaacgcgcccctctgaggtcatttttacttggaaggaaatgtcgtccccctgaacgatggccttgatcctgcttttcactgctttgatctcataggctatatttttaccggtttgaggatcgttacctttcaacacgcctccaaccaattggcccttgatccacataagaccctcgacctctgattcattcagaaaaccaccgtatgtttgcgtctttcctttgatgatccccgcacctgcgaccttgatttcattctccgtcgaaatgacattgggtaatataaaacttcccttactcttcatgggcccgaccactttaaccaaagccacgggttttatcaaccgtgcgttccgtttacgattttggaaaatatcctttaagatataggcaggaatttgaccaggagttttttcctgaagcgcattgctcgccttgtctgtactaatcagtagctggacgctgagccgaatgtcattatcccccaagaaaaagtccagcagctcgtacaacgggatcttgcgaagcagactggagctgataataatcgttttcaaatgttgcccaatgggcggtcggttggttcgcaatgaaatttctcttaacatctcaaaaacggaatcccctgtttctgtaatattaaaaaattttttagcttgcggtgaggagctattggaaccgccgctttcctctgggatgataaattgaaaggttcccgtaattaactcttttttcggataatctcctcctttttgattaatttgctcttcttgtgaagattctgtcgctatatccatagcaatgcctgtctccagatttagatcctccacgggagagctgctccagcaacctgaaagtgtactgcatattagaagaaccgctattccgagtattcctgaacggaacttcatcatgaccccacacccctccagcgagaaataagcaggagtggcaatggaagtagagcaaataaaacgaatgctgcattcccgatgatcgttccaaaagaaaataactcattcaaatttttgggtatttgggacaggacgtagatgatcgggagcaaaataaacaacaccttggaataagagctattcaaaatttgagaaactccgagcgaggcgcaataaaaagctatgctgaatgtagcaaaaatttgcatgatccaaatggtcaacaataaggattcgaaccgttccaataacagatactccacttcaaaactgcgggccaaatctaaaaaaggccaggttctgctcataaccccttccaccgaaaaggcaccaatgcataaggtcagcgtagctatataaaaaacggtcgagatcccgatcgccagtccgattgccttggttgctctctttggtttttccatccgacaaagaataaacagcaagcattctgtccccgttaaggttagggttgtagtcttgagagctttaagcactggcatcacaccctcggacaaaacaggacgcaaattattcaattcgaaaatattcaaacttagcaagcatattaacaaaaagatagacgccgtaatcgggaatataaattggcatattttccccaacgtgcctatcccccccaagcaaagatatagagagatccacataaagggtgctgaaatagcccacgctggagttccttcaagcaaaaagaacgacgttacttcctccacagatcggatttcatatgcagctatacaaataaaatagatgacgaacaacatgcccaccaccttgccgatggctttgccggttatccgctgaacatactggtaaaaggtgctttctggaaaccgtgaacttagtttgactataatccatccgaacaggaaagtggcagcccctgctaaaatgacagacatccatacatccggtgtttttgcagtttcaacggctactctgggaagagtaagcagcccggctgccagcataaagcaaagcacaattgccgtcgtctgtagcgttgtaattttatccatttttttcccacgggccatcttgctccctcctgtgttgttgaactcatccttgtcgcttagggtctttatgcttcaatagaatgggtctgtttttcataaattgtagcggtgctcgcaagaagtaatctttccagtccttcaatgaacgggggaccgttaaactaagatatggcacgccgaagctgtgtaatttagccatatgaatgctcagcagcaggaaaaacatgatcactccatacaaaccaaagatagacgccgtgaacatggccccaaaacgaagaatacgcatagagatccctgcactgtatacaggggaggcaaaggaagaaatcgctgtgactgctaccacaataacgagaatcggacttacaatcccggcgtcaacagcggcctgtccaatgatcagaccgccgacgatgcccatcgctggaccgatgggtttgggcagccgtagtcccgcctcgcgtaaaatttcgatggaaatctccataatcagggcctcaatcagcgtcgaaaacggaaccccctgtctcgcactgataatggaaatgaccagcttggttggaatcagtccgggatgaaacgagataaaggagatatagagcgccggggcgaacagagatatcgtagttgccataaaacgaagaaatcgaataagcgaccccggtatccatcgttcatagtaatcttcgggagactgaagcatcatcccgtacgttacaggcataaggagcgcaaaaggtgtaccatccagcagaatcgccacacgtccctccagcaatgcagccatgacccgatccggtctctccgtattttggatttgcagaaagggactaagaaaattatcctcaataagctgctccacatagcccgactccaatacctcatccatatcaatagtttgaacccgccgtttcacctcgtccacaagctccggatcggcaatgtctctgaaatacaccaccatcagctgcttttccactcttttgcccactttgaaggacgacatggccagttctgtactttctccatgtctgcgcagcattgccgtattgtcgctgagggtctcggtaaaaccaactcgcggtcctcgcagcaccgattccgatatggggtcttccacccctcgtgtactccctttgggtgtgcccagcacaaaagcacccggtataccctgaatcatgagtatgactgaaccgaatagcaccttttgcaaggagaactgcacctctaacgtgtactgagtctccgataccagcatgacctgacgaataaacatatcccgaagctcttcccctctcgggagatcctccccgccttgtccggagctgccccaatccatcagcggctttagtatgttctgatccatgccaaccttgtctgttaatccatccacaaaaaaaagtgtgcctacagcgttcaatttttccagaaaaatggatcgttcgttcacgtccgacatatccgtgacggcttgtctgatttttgctacattggcttcataatcttcggtaaaggttcccttttccttctcagcctcacttacagacggattatgatctgcatgctgcgaacggtcttcttcttctaaaagctttaatcgttccatacgtctgctctctcgaccatccatcgctctgatttgtcgtaccgtcagaaaaataatcaaaggtacgatggataaaaagaaggcttccatccacacgttccatttaggcatatgagttccgatgacctgccacacactctttcctccttcacttccagatgatttgtatatagatttacctggattagaaaaaagatgcatggacaatggaataaatttctttactcacaaaaggaataaaaaggcgaatttgatagatgaactgtagtgccaaaagtggaattccatgataatatctattcattctatgactaatgtcacaaatttgttgaattcgtgggccattattcgaatctaaaaaggagttgtaggtatgaagaatcattttgggaagaaagccgctgtgttgagtttgttagcggtcattttgttagggggaacggcgatcagtcctaagcaggctcaagcatcgaccgaaccttatcttggggaaattacgatgtatccttacacgttcgctcccaatggatggctaaagtgtgaaggtcagctcttatctatttcgcaaaatacagcactgttcagtctattgggtaataattttggggggaatggaacaaccacatttgcattgcctgatttgcgtggagcctctccaatgccgaatgtagattactacattgcaaccgtaggaggattcccgtcccgtccataatgaaatgttcaatggtgtgctacttaatgaagaagaggtgatggcgtgctcgaaggcaataacttcacacgcaacaattttaaaccttatcgcttgctggttccattgctgccattcatcggcggtgcgttcctgctcatagggacgaatgaggttcacgctgccagttgggaaaatgtggtacttaacaagccagccacatctagtggctatagccagccctatgatccctccagagctgtggatgggtcaatcgaaccgacaagccgctggtatcaagccagcaatggtgagaaatggattcaggtagatctgagagactggtatatcgtagatcgatacgttgttacaggtatgggtgtccattatgggtggcatgatcagcgtgatccatacagtttccgattgcaaacaagcagcaacggaagtaattgggtgactgtggataccgtccagaataatgggagctctaatgttgaaaagagcattactcctgtaactacacgatacttgcgagtatatattgatcaaggaaatgcgagaaacaatcaatgggcttccatcatggaattcgcagcttatggcgatcgattgcccgttccacaggctccgggtcattttacaggaaccaaaaatggaaatacagtggagttaagctgggatgctgttccttatgcaacttcatacaaagtcatacgagatagtgtaacgctttattcaggtaacttaactcaattcatagatacttcagcattgccgccaggtgaagcaatttacacggttcaggccatgaatgctaagggggagagcaatccctcagaggttaaagtgaacatactttccgatgccgagagagttgcacaggcaaaagctgctcttgcattaggcttcgcacctggagatacagctgattccgtaacccaaaagctgacgctgccactcgctgggttgaatgatacgacggtgagctggagttcggatactcctgacatcattacgaacgagggggctgtcacacgcccgcagtatgatctgggtgaccgaaaagtaaaactgacagcaacgattgcgaagggaagcacctcagatacccaaacttttgaggttaccgtagcgaagatcactgctcaagattcattaaatcaagcagcagacatcctctcgcttggcgatttgtctgcgctaacagaaaatatttctcttcctttatccggttatgccggagcgcagatcgaatggtcctcgtccaaacctcttgtcattgcagcagatggaacactcaccagaccctcctataacagtggagatacggatgttaccctaacggctaccctgcaacttgcaggcttaacgaaaacaaaggattttactgcacacgtactccgtctgccgatgagcgacactgaagccgtagacgcagcatacagagcacttgaactgccgataacgacagtaacgggagacgtatatttgccaaaagatgctctgaatggtgttcaggtgtcatggtcatcgaatcaaccccagttcttggatcatactgggcatgtaaccttcccaagctatgtacagggcgatcagaccatcacgctcgaagcagttgtatcacgaggcgcggttgagctacgaaaaacatttagcctgctcgtgcccgcactgcctgtaagcgctgatgaagccgtaaatttggcagcaaatacactgaatctggattatccgcaagggattaaggattccatcgctctgcctcgtacaggagcatttgacacccagatcgactggtcttcggatcaaccagatatcctcagcaacagcggtcaggtgaatcggcctaaatatacagatggtgatgtgaatgtacaattaatggccattatttctaaaggtgcagcttctgtacaaagaacattcacgatcaccgtgctaaaggcattaccgaatacaccttacgtacgactaaacggtagtaatccaattgttctggaaaccggcgatagcttcactgatccaggagccagtgtactggacagcgtatacggcaatatcctgatccctgagctttcaggtagcgggaatgtcgatacaaatgtacctggcgtatacgtattgaactatgcttatagcgacaatgggggctggacggcagaaccggcagaacgccgtataaacgtgctgcctcgtgctgttacagccgcagcaggcactgaggatatagcctcagtgatcgttacaggcgcgttgccgagcgcacggcttgagctgtacaatgcccagcaggagcttatagcggaagggattgcttcgggagagggaagatatacatttacgcctgttcctgaaggagccagctactatgtgctgcagaacgtaaatggcatgaagagtgctccgtcagggctagtgtatccgcaagggttaaccgcgcagcgcgttgcggattccatcacaagcgtagcagctcctacaacaagtgatacactgctcaggttgcctgttgtacctgatggtttccgtgtgaccatcagcagcagtagccagtcagacatcgtgcgtacagacggaactattattcaagcagatactccttccgttgtaactatcatgctggatgttatgagggtaagcgatggttctcatgctttgacgcaagccatagaagtcaccgtccctgccaaggtaattgcgaacacaggcaaatctaacaaagataagaatgaggatctatctgctttcgtaccacagatcggattttccgaacaagggaaagagttttccctctttgttccttcgccggcattcctggatgagcagatacagcaagcacttcgcgaaggcaaaacatacgcagacattcgtttggagcaggaaaagcaactgagtcgtgttatcctttctcattctttactgaataaatgggataaggttggtgcatcggtaatatcccgatatggaacactgatgatatccagtgacaccttagccagcatggcctcaggccagcaggacgttacattgtcattccagcaggcagatgtacaacgtgcacagcagatccgtgattgggccgagcaacaatccagcctgacgctgatgggtccgattacagacatcaaagccaatgtgactgggacctcgtcgatcattctaccgctggataacgaatccttaggtgagttacacaatacagagccccagttctccattgttgttattcatgagaatggtgagcgtgagattctaaaagggactgctgtaatggattcaaaagggatgttgtcgggtgtgagtctgaatacgaccgggttaggtacctttgccgtcgccacagttgccaagactcaaaccaataatgccagtgtgcaaaatgacccaagcaattcgtcagatccacaagtgctagctcaggtatggccggatgtacaaggccattgggcagcgaaatccctgcaatctcttgcagacaaaggctggatacaaggctataaagacggcaacatacgtcctgatcgcgctgtaagccgtgcagaatttgtagccatactgaccagagcattgggaactgctggagatgagagcccttctacctcatttacagatatgcagggacactgggctggatcagccgtggattttgcccaccgccagggatggattcaagggctaaccgctcaaactttcggacctgatgagagccttacccgtgaacaggcgatggtgatcctgtcacacgcgatgcagaatcagacatccatcttcagcactgccgcactgcaatcctacaaggatgagcagcagattgcagcgtgggcctccgcagcattccagaatgcagtatcctccggttggatcagcggttatccagatggaacactcaagccaaaagcggctatcagcagaggtgagatggctgaactgctggtacgtattcttaaataagacgttttaagcttcatagaccagatgagtataagcaaatacaacacggctccaagcttttcgggggccgtgtttttttatgtatattttatgtataagcctttaacaatcatttttgcttgtttattcacccttttcgcttcagtaaatatattatgaatatctgcgaagcggggcgataaaccacctgtcacctctacagtagtaagaacgatgaggaggagatatttgagcatgaaacataaaaaaccgttcaggttcagtggtgcttcaaaaaaagacgaagactgtaaaccaacaagagtaaatagaagtatcgaagatcttctcagactgattaatgaattgaccgcgatcatccccatcgtattcgcaaacccctctgcggctaatgtatcttccttgcaacaggttttaagacgtttgttgtctctggcgaaaagcttgagacttagaggcggggttaaggcagacttactggcagcgctggagcttgctattgttgcgttagaagctacacccttctctccgatcggcgtaggtactgcactgcaacaattgctggatgccctattgtccatcgttttacaagaatccctcgatcctgctcttaaagacagcttaatcagcgcgatcagaatcgctggaaagacggttagcaacgtattaggtgaaacatacttgtcaggggagcccggtgcacaaggacctcctggacctgcgggacccggcggtgtgcctggaccagtaggtggaccaggcccacaagggcctcccgggcctcccggacctatcggcgccgctggacctatcggtgcggctggaccagtcggccctgccgggcctgtggggcctgccggaccagttggagcagctggacctattggccctgccgggcctatcggggccgctggaccggaaggccctgccggacctgtcggcgctacgggtgctgcgggacctgccgggggggtaacaggtgccacgggcgctacgggcgcggatggattgatcgggcctgctggagccacaggaccgaccggggctgatgggataccaggcgcggttggcgctaccggagccacgggcacagctggtgttactggagcgaccggttcgggaaccatcattccgtttgcttcgggcggacctgctatcctgacaaccgttcttggcggggtggtaggaaccaccagtttgatcggctttggaagttcagcaacagggattagcctcgtaggcgataccattgacctcacaggtacacttgtaggacctctgatcaactttgctttttccgtaccacgggatggcgtaattacatctattgctggttacttcagtacaacagctgcgttaactctcgtgggttcaactgcgacgattactgcccagttgtttagttccacaacacctaataataccttcacagcaattcccggagctatcgttacattggcccctccactggatggcattattgctttgggaacgatctctagcggtattactaccgggttggctataccggtaaccgcacagactcgtctgctccttgtcttctctgcaacagctacgggactttccctcgtaaacactatcgtaggttatgcaagtgcaggcgttaccattacctgatccgagacgaaaaaaggacccaacaggattgttcctgtcgagcccttttttatttgtattccatcagacggactaaaccgtttcgagtgatacttttacttcttctccctcttcacaaacggcgaatgttttaacttgtccgtgatcaggctcctgaacgatgcctgtcttcagatcaattttccagtcatataaagggtcatagatataatgaccagatactatcgcctctgtaagaggacctcttttgggatgaggattgatattttcaacggcataaagctcattctccgaagtgcggaaaacagcaatttcagcacctttgatatggatggtacgccctattctaatcggaaaatcgttactgtgaccgacgacaagccattcggcatttttgatcatttgcttgatcgctcccttcctcaggcattttagatacaattacacaatagacggagtgacaacctcaaatagatttttgcgtgtatcctcatcattgatgatctttttccacgggtcttccacctgttgtagtgcaaattcgatgcgttctactaaagcttgtcgatgatctgtatcctgaacgacagccttctgaatctcttccagaccgatccgttccacccactccgaagtacgttccaggtattgccctgtttcccggtagaattgcatcacggctcctacaatatcaatcagttcagcgtcggtttttactttacagagtgaatcagccaaccgcgctttaataccgccattaccaccgataaagatctcccagcccccatcgttgcctacgatcccgatatctttggtacaagattccgcacagttgcgtggacatccattaactgctaatttgaattttgctgggaaatccagtcgttcgaattttcgttccaacacttctcccattcccatcgagtcctgtgtgccaaaccggcaaaattgcgatccaacacaggttttaaccgtacgaagtgacttcgcgtaggcatatcccgacggcatatcgagttcttcccatactttaggcagatcctctttacgaacaccgatcaaatccagccgctgtcctcctgttactttaacgaccttaacgttgtatttaagagaaacatctgctatcttcttcaaatcttctggggtcgttacaccgccgtacattctaggaacaactgtaaacgttccatccttttgaatgtttgcgtgcaatcgctcatttacaaaacgggaatctccctcattttcataggtatccgggttaatcattcccaaatagtaattcagcgccggacggcatttggagcatccttcatcattatgccaacccagtacattcataacttcacgcgttgttgtcagccctttggttttgatcgcttccacaatctcgtcccgactcaaggttgtgcaaccacatattccttgcttggctgacgtcttgaagctgtctccaagaacatattgtaaaatttgctcaacgacaggcttacatcctccacaggaacgtgttgctccggtgcatgccttaatttcatcgatggtggtcagtccattatcattaattgcatccacaatcgcctttttagtcacaccgttacagccgcagacaatttcatcatccgccatcgtttcagcggataatgttttcgccccgtgattactacatccagtacccatgatctgtccataaatctcatctgtcatcaatgtttgctgacgcacatatttttgaagactagcagattcgcttacatcgccaaacagtacagttccaacaattttattttcacgaagcagcacttttttgtatgtgcgcttccactcatcctttgcaacaatcaccgtatgttcaggctgggttatgaattcgccagctgagaaaacatccacccctgaaattttgagcttggtagaaactaccgatcccatataaccttcagtttccgcgcctgccaaatgtttggcaatgacacttccctgctcaaacagcggagctaccaaaccgtaacaggttccacggtgttcaacacattcccctacggcgtatacatccggtacggaggttctcatcaaatcatcgactacgataccacggttcgtttccataccactttgcacagccacctgaatattaggcttgatcccgacggccataacgaccaaatccgcttctagctcgcttccgtctgaaaaccgcagcccttgtacccgatcttgaccatacacctccgcagtttgcatttgcatagcaaacttgattccctggcgttctagttctgctttcagcatcgcagaggcttcccgatccagctggcgttccatcaaatcctccattaaatgaacgaccgtaacatccattcccaggttgaccaagcctttagctgcttccagccctaacagacctccaccaatgaccgctgcctttttaaaggtcttcgctgcctcaagcattgccgagcaatcggcgatatctcggaaaccgatgacgcccggtaattctttacccggaataggcagaataaatgattgtgagccagtagctaccaaagctacatcgtaatcaatttccagtccgtcttcggtgtgaatcttcttgttctcaccgtcgatgcttttcaccatttttcctgtatacaaagtaatcccttgatccgcataccattgcaaatcgttcagtatgatatcatcaatcgttttactgccttctagtacataagagagcatgatcctgttatagttcggatgcggctcatttcccaagaccgtaatttcatacttatccgttaatttcaaaatttgttcgaccgtattgataccagccatcccgttccctataaccacaagtttctgtttactgtttatcatataccggttcctccattcattcgacgatactccctatccgacgacatctcctacgttcctatgaatattgcttatgcttctattctaatacagcagatagagctatatgtgactagaatcacaatgtagttcaaattaagaatatttagggatttccctattccgtttcaagggataaaggtaaggagctgaaattgagttaaaaaaaaggaccagctagctggtcgcaggctgtcgagaaaccccctgtttttttgcagggggtttaaaactgtcttagtggtctaaaaactagggtcctcagatcgttttaaatcgatttttgttttaaaagatgcgtctccccatataaaaatagaagtgtcgaaaagtcctctagactttctcgacactctgggaccagctagctggtcgctttgttaaatttatgaatgatgactttgactcaaatgggtgaaatattcagcaatttcccgcgtagcccgggatggacgccagccgcgattttctccatctgtgtactatgaaccataagaaatttatttttcttagtcaacagtgggttctcccggctaccttctcccacttcaagtggcatattcgttcctgccggaaggatcacaatcgtcaagtatccttcactgtcaactttacagggagcataatgaagtgtcgttgaatatatctcgacaaccgtgtttttaggctgaaaaaacacctgaacatttgcactgtcataggaattgtcttcaatgtcctgtactctaccgacaagatgaatacagtctgtagcggcaatcaccacctcgctgccctgatgatattccaacccggtcagacccgtattctgacctacgcaaaaaccagcctgaattggaagttgaccgtacacctgatcttgaatctggtgagttacaccgaagtcttcgagttctgtgaccgaaggtacataatgatttccctgatcaggtacgctggtcgtatcttttgcatacttgatgagctccgtggtattaaaatgagacagcagcctcccatacgggcggaatgcttcgctcattacctcataaatgaccaaaggtgcattgacttgatttagtctttcgatagtcttcataacttgacctccagcaatgaatctcccgtatgcactcggttgttccccagcaccttaacttcagagtattcggctgtattcgttacaataaccggagtagttatgtcatagcccatagctttaattgctccaatatcaaactcgaccagcagttgacctttagtaacccgatccccttctgagataagtgttttaaaatgctgtcctttcaacttgacggtgtccataccaatgtgaaccaggatctccgttcctccatccgatacaatgccaatcgcatggcctgtacggaaggcattagctatagttccattgaatggagagaccagtttgccatcctcaggcacaatagcaacgcctttacccatagctcccgtagagaacacttcatcagatatctcagataacggtttgacagcacccgtcagcgggctggaaatattctcgttcgttggcgcaggagctggggttgcagcttctttcttctcttcatggactgcaatcatttctgtttccatggaatcattaaatccaaagaaatacgtggtaatggctgtgaatatataagctacgataatggcaattacgaatccggcaaatcctgtgccgaagaatatcggcagggatgccaagcccggtatacctggagcaatcgccacggaacccgccgcacctgtgattgccccggcgatagcgcccccgataatagcccatacgaacggttttttgtagcggatactaatcccgtagatgatcggttccgtgatgccaaacaaacctgttatcgctgcaggccctgcaatcgctctcacttttggatttctggttttaaggaatacacccagtgccgcacctgcttgtgcaaagttagaaggcgcaaataatggtttcaaagtatcatgaccgtataccgcaatgttattgtacatgataggaataaacgcccagtggagccccataacaactaacatctgccacccggcacctacaatgactcccgctacaatcggactcaaattgtataagaaagtgtaacccttagccagccccaagctcgcatatattccaattggcccaaccgcaatcagagtcaagggaacaatgaccatcagacagataagtggcgttataaaatttttcacgctatcatgaattactctattcaggaatttctccagaatggatagcaaccaaaccgcgataatcactggaataaccgaagaagtataactcataagaacaacaggaatattgaagaacgaaatatccgttttatcgttatacaaagtaataatattcggatacaccagagcccctgctaccgcaagcgcaacaaaggtattggctccaaatttcttcgaagaggtcacagcaatagcgatcggcaggaaataaaagatactgtctgcggcagcgaaccagatcgaatagacaccacctgttttggtgagccatcctaacgagacgagcattaataaaagccctttcaaaatccccgaagctgccagtgcccccaaaaatggtgtaaaaataccggaaataatgtccaccgttttgttgaaccagttgccttcaggagcagcggatgcattcgatttgtcgtcatctccaaggctactgatctttaaaatgtctttatatacgtcccctaccgtatttccaatgaccacttgatattgtccaccgttttcaacaactgtaataaccccgggaatattttgtgtttggttcttgtcggcctgatccctgctatttaatttaaatcttaaccgagtggcacaatgcaccaagctagagacatttccttctccgccaacggacgctaaaatgtcttttgccagtttttcatcggacatactgctcgctcctttaatcctcatttggcatatttctatgaaggtaaacgtttacattaatggtggtaatccaaagactctacgcgtacttccagggagtacgaaaagaatatagagtctctgaattacacggggtcaatcgttaccgacttcttcctaccattctcttaattgtatgtctgcgtcctttaatggacagcgcaagttggtatacgttctcaggaagaggtgttcctgcataaccaccatctccaatggcatgaatatccgcgcccgtctgtttcatcatgagtgcgatccaggcaatcgtttgaacatctgccccttcaactgagctgttcaggaaagaaagagcaagcgttccgggtttatatgaatggacaaattctacacattgtctgacgtgctccactgtaataccatgtctggagccaggtgcaggcaacgtaataacgtcagcaccagaatcgatcaagtccttaataatttcattggaaggtctctcgctcagtggatcacccaatactttttcaatggttccgtcttcccattttccggcgcagatcaggattttgtctcccagtgtttcttttgccagcttggtagcctcaatgatccgttcaaaggttgtacctgcggaaggatttcctcccaatacgataaagtcagctccaatctctgaggcacgcaggaagttctctctggaagcgattcttccttctttggcctccacatactgttctcccgcaacctgagcatccgggcttggacactcaaaataaataccgagcggaacaccggcccattccttgatttgctttaggctatacggcttatcagccagcttgccatgcttcatttcacgcaatccgatattggattcttccttgatcatatcaaagccattcagcataaccatatctgcgccgtaagctgcttggatctccgcattggtaacgccatcgaccaggccggaattcagcatcacatgatgctgtcccataatgacgcgcccttcagaagccagaatggattcttttagatctgctgcactaaatttcaaaatatccgttttcgtgctcgcgattaatctttttgccaatgtaatctcctccaagtcatttatgttttaagtggtcgtttgtcagcacaaatgctgttcctcgatgtcggatatcatcttgatgcggtcgccatggcgtcctccttcaaactcagcctccagccatgatttcactatcatttttgccaattcgcttccgacgacacgtgcaccgaatgcaagaacatttgtattgttgtgctgcttggacaaatgtgcagaataaggctcgctgcatactacagcccgaattcccttgactttgttggccgagatggatattcccacgcctgtgccgcaaatcagaatgcctgcgtcagcctgctttccgaccacagcctctgcaacgagctttccatacttcggatagtcggttctttctgaagtttgcggtccatagtccatgacctcatgacccagttcattaagataagttgaaatcatcgttttaagctctacagccacatggtcgctaccgatggcaattttcatggctttattcctccccgaattagatattttttaatctgttaatgatggttttgtaagattcttctttaccaaacaaagtggatgttcccagtacgaatccttcaaccccgtagtgtgacaattcgttgatcttctcttcggagatagccccatcaaccacgattgtataattcaatcccttttcgcgtttaaaagcttgcagcgctttaatcttgtcgttcacgaagggtaaatatttttgccctgcaaaacccggatttacggtcatgaccaacacatagtcaaccatgccaagtaaaggttccaccgcagcaatggccgtccccggattaagagcgattcccgctttaacccctcttccaacaattcggtcaatggtgcgcgtcgggtgcatatcggcctcggggtgaaaataaatgatgtctgcacccttatcggcaaataaatcaatataggcggaagggttgtctatcatcagatgtacatccattgttttttgggtttgtttacggataaactccaaatcctgaagccccattccgaaattagggacaaatctaccatccataatatcaatatgataaatatccacattggcttcttccagcgcgtttacttcatgttccaaggagctgaaattagcgcacatcatggaaggacataataacatactcattcataatcacccttcttctaaaatagagtaaacgattactcaaacgacataatctgtttaacattttccaaaaagcaagcgttaattcttctgctctttggtattgaataaaccaactaggaaaacgtttacccattaaaaaaataacaacagttcatggttcgaactccatcacttgttggttcctcacacatcatatggattctgatactctttgagtaaacgattacatttaacattattaaagttatcattttctgatattgttgtcaaaccattttttgttggatattaaacgggaagtatacagcatgatagagtacaactcgaccatcttactctggagaggtaaacagtacctatacttacctctcccttggctaatgcaagatgatatctgaccgcgaaactaggtggtactgcgttgtatcaaccgtactgggatggaataatgctgctcttgttccatcttgtctccactcagcatacgaagcagcatactggaggctttatctgcaagtgtttctttatcctgttcaattgtagtcaatggtggattacagtattgggaaattgtatcattatcaaaacccactatcttgacttctccggggacctgtactccgaatttctgtaacgccagtaatccgcccaaagccaaccagtcattagtggcaaaaatgccgtcaaaccgcaatcctttttccaagacatgtttaatagcagcctgtgcgttttccaaagtaggcccatcattgcgaactgcaaccaagcgaccctcggatggatgcagtccatgcttttgcagagcatctttatacccgtgcagacgctcattaacagaggatagattgttttgcttggtcaacagcaaaatttccttgcagcctttgttaatcagctcctctgtcgccagaaatccaccctcataatgatcggactcaataaaagctacattcgtattaatcttcggtcgacggtcaatacatacaatcggaatgggacgtttaagcaattcagcagaaagctcctcctgccccgaaatacagatcagaccatctaccatcttcccatccagagttttcaaatattctcgttccttctccgcatctttagcagtattacatataatggtggaatatccttgtttaaaaaagaagctttccactttttggacaatgactgaaaaaaattcattattaatatccggcaccaaaacgccaatcgtctgtgatttactcatccgcaggcttttggcgatgctgttagtctcatattggtacttttggattacttcaataaccttctgccgtgtctcctcagagaagcgaccattctcgttaatcacacgggaaaccgtagctacagaaactccgctcaacctggcaatatcctttatggacacttgattttttttcatattatttccctcaaataattatattgagtaaacgttttcctgattggagtttaacataatcctaatatgggtgtcaactgacgcactagtatagaaagagttttccgccaaaatacgaagagaccgcaagtcaatataccatttaatgagtaattgcaacctttataaggaatactttaggaacaacttgtatcttaaggaaacatgaattgaatcgtatggaggtgatcatcatgtggtataaaataatttcttatattccaagctggattacactctttcaagcaggcctcgcgttgattattcctttaggaatttattatataaacacatcgatttattcgtttgtcggcagtaagggggcaaaatccaaacattcttctgatcgtccgctttccgacgaacataacgaaggccacgctgatcaacagcatgaaccaagctccaaaattacagggaattatgattccgacttcaagtcgattcgagaggctataggcgaaaatagtgatgtgcattttcgtgagtttgtagtaaagaaatatcatgctcggtccgtgttaatcttcatagaaggtatgcaggatgaaaagcttatgagcaagcaggtattggaggtcttgatgttcgagggccagcaggacccacagcgcccacaggaacagcaggaaagtataagtaactcctttataaaagataacttgatgccacttacgcaaattagtgaagttgctgatatggaggacctgcaggagtctatacttttaggccatactgccttattaattgatggaatgaagggagcactgctggtgggctcgcccaatggcgccattcgctccgtcaatgaaccaacctctgaagcattacttcggggtccccgcattggttttacggaggtattaagtgaaaatacttcgatgcttcgacgccaaggcttaaacaaaagtctggaaatgaagaaatttcaagtgggaagccgaatcaaaaaagatctggttgtcgcgtatataaaggatattgtgaatccagatctcctcgaagaagtaacccgcagaatttcaaagatagacatggattttttggctgaatccggttatgtggaacaacttattgaagacaattatttaagtccgttccagcaggctcacaacacagagcgtcccgaccgtgtcattaatgctttgttggaaggaagaatagctattttgctggatgggactccctttgcacttattgttccggtgaccttcagtatgctgcttcaatcacctgaagactattatgagcgctggattccaggaacacttttacggctgttgcgttttagcggggcttttatagcgcttatggggcctgctttgtacatctcttttatatcgtttcatcccggtttgattccgaccaagctggtcattagcatcatcgaaacccgtcaaggcgtccccttcccatccgtcattgaggttatgattttagaaatctctatcgaaatcctacgggaagccggcattcgcttgcccaaacccattggtcctgcgatgggcattgtgggaggcttggtcatcggcgacgctgctgtaaatgcaggcatcgttagccccttcctggtaattgtggttgcggttactgccatttcttcgttttcaataccgacatacagtgcgggtattaccttgcgtcttttgcgtttcgtcggcatgctctttgcagccatcctgggcatgttaggaaccatattgttctttctgttaatttgtatccatctgacgaaattaaaaagctttggcgtaccgtatgtaacgcccttttcccctatgcgcctaagcgattggaaggatatgtatattcgagctcctatatctatgatgaaaagaagacctcttatgatgaaaactcagcaaaccaaacgtaggccatgatgccaagacgaaggaggagctatggtgtttagacgctctgatgataagatcacaaccaagcaggcggctgtgttcctgaccaataccgtattgggcgcggggattttgacactgccgagaggtgtaactgaaaaggtacagactcctgatgcatggctttctgtccttctcggtggatgtattgtcatattggtcgtctggctcatggtgaaattaagtcaacagtttcctgaaaacaccgtgtatcaatattccagaagaatcgtgggcacaattccgggtggatttttaagtgtgttattgattatatattttttaatcatcgccggctttgagattcgggttttagctgaagtgaccatgttttttctgctggaaggcactccgatctgggcgattgttattccattcatctgggtaggaagctatttggtttttggcggcattaatcccatcgctcggctataccagattgtacttccaattagtcttttttttctgctgctctgttttgtctttagcttaaggatttttgagattgatcatcttcgtcctgtactgagtgaggggattttacctgtcatcaagggtctgaaatcgactattcttgttttctctggatgtgaagtcgtcatgacactggtcgcttttttacaataccctgagaaagcattaaaggccatggtagtggggatcagtatccccttaattttgtactttttgaccgtagttatggtgatcggcgggttatcgatggactccactgtgacaagtacttggcctaccatcaatttgatgcgcagttttgaaatccccggttttctctttgagcggcttgagtttcctctgctagtgatctggatgatgcaaatgttttgtaatttctgcagtttcttcttcaatgcttccctaggggtctcacaggtgttcggtcttaaatatcgttatgcgatttttggcttaatcccaattatttttatctctacaatgactcctgttcgtatgatggaagtgtttagtctaggcgatgcgatcggatacatgggaatcgttatatttgttctggttccggtacttctctccatcgtgttcataatcaggaagaagggaatgaagcaaaatgtgtagacgccctatgctatccttgctgcttgctttcattctacttataactcaaatcggttgctggagcagcaaagaagtagaagagctcagcatatatacaggactggctctggataagggggagcttactcctttagagcagaatctggaaaagaaaggcagtcgttacttcaagaaaaataaaattaccgccagtttacaaatcgtccccaaaaaatcatccggaagcacagagcagcaaggcggtggcggacaaggaccaaattatgtaaatatagcagccaccggggattctctgcttgaaatctttcgacaactctctctccgtttggatcgcccggttattggtcaccatctaaaggtcatggtggttgccaccgatttggcgaaagaacagacgatgcagcaattaatggattttgtgctacgtgataatgatattcgcccgagttgtttggtcttcttaagcaaggatcgagcagctagcactttagttaccaaatatgaagacgaggtcccatccattcatattttgtatatgcttcgtaaccatttcagaaccagcaaggtaatgaggggagtcaatttgtctgaattggatgggttgatgcactccaaaaaaagctatatattacagaacatcactgaatcagatggagaattagaattttcaggtgccgggattattaaaggagataccggtcactggataggtactttgggacaacaagacgtggagagtattggatggattaccggtgatgttaaaggtggggctgtcaaaacgtatgacaagcggaatgaagccataacttacgaaatcaaatcggtaaaaagcaaaataacaaccaaggtgaccgagggcaacgatatctcgttccacgtaaaaattgaatctaaaggacgtctaatcgaaaactgggatgataaagcggacccgactgagacacgaaacatgaaagaggcagagaaagaatttgaagaacaagtgactcgcaggattaagtctgttatgcacaaattacagtcagaatataaagtcgatgttgccggcttcggtgatcatttgcatatcgagaaacctcaggtgtggaaaaaagtaaaggatgattgggattacaaattcagcaaaatacccgtaaccttcgatataaaattatccattacggatttaggctcatctgcggaatgaaaaagtcgaattggtcttatataaaggccaattcgacttaagattcgcggttatctcttaacctttcaacgctgcaacggtcgttcctgaatttccagaagcggctacatgcttaattcaaattgattttaaatacatcccctgcattgccgcccaaaacgatcaagccgcctttgggcagtacaatcgaattgttattgctagcagttgaaaattgtacaaccgctccgttttcatcatagacagcgaaccctccgcttgttggaaaatcaacggtcatcgttttattggctgagtttttatctattttataccatgtggcttggccattagatggtatggtgtacactgactttcctcccaagataggtttaacagcatcttcactgatataggattgtccatctatggttaaatactccgaaccatccttggtataaaaattcagatcaaatgcatctcttccactcataacaggaatctcaacggcatttactgctttattctcatccacaattttagtaccacttgcgtatccatcatgatcaaaggatatttttttcgttataaatgagggggccagatagaatatggaagatatcttttcatccaaagcataataatttttcccgtttctgttttcccatgcctttttaactatgggatttacaggattggcatctagcttttgatattcataagtcaccataaccatttgacctaatcccgaaatgtttaaatataggttagccttaatatacgttttcccgtttttttgtttgtcaaagcttatggctacactgccatcattgcttttgaattgtccattgcctgtatacacatatttttgcgccgggacgaatccatccaagaaagcaggtaagtcaaactcaccgtttttaatctctacattgatggttgtacccacagaaccgtataatcccgaataagaaagtaaatcagatggcatttccacttttacaggaggctcaaatgttttctccggtatgatgtctttaatgatgcccttatcttttaaaacttccaataaaatgttagaagcaaaaatactatctaagatggaagaccctccagatgaaagcacagccatagaaatatgatgctctggtatggtgatcaaagtagagtgatacaaaacagtatccccacccttggatagcgcagttattccgtaatcactaaacggtgccaactgaaccgcatcccaaccaagtccataattaaagctgtttgtctcttcaggtacccatattccatttcgatattcatgacttttcatggacttcgccgattgtgcagatagaatatcgggtctgttccccgttaatacttctgaaaacatagccacctcttctgcggtggagtataagccccctgtcccgatgacattggcattttcaaccggtaaagccccctcaaccgcaggaaaataagttttggacagcttttgtctatcaaattgatcgagaggtgttttggtagatttcaaacctaaaggggtactaatatgctttgccaggaaatcggtgtaacttagaccgctcacccgctcaaccaatatttcaagcaattgaaatccatcattggtatatacggaatattcgccagggtttgattttaaagtttctgattgcaaccttagcaagagctcatcatgattttctgttcattgtcattaaataacatactatttttatagtgagcaccgtaaagacctgacgaatgatttaacagcatacggggtgtaatttgtttgtatctttcatcagacattttaaagtccttaatgtatgttgttagcggctgatcaatatctaccttatgggcatcgaccagcatcatcgttgcagcagatacatacattttgcttgtagagcctataccgaacatcgtatctttggtgatcggctcgttggttgctttattctttacacccacgctatccgataatacaatgtttccttggtccataatggcatactgcacaccgctagcaccgtatttggataccagctccgaggctagactgcgagccttttccttgatgggttcagcagtgccttgagcaaaagtattcgtcatcggcagtacaaaaagcatagcagaaacgaacacagctattattttcttcattccatatttcctcctcttatagcttcaccaggctttattactgacctgatcatacaatgaacgaggattctatataaaaaaacacccttaaacgtaaaaaacaatccctaaacaacataatgtctaaggaatgtctttataaaatggcaataaaaccatattattgaatactttatttttcgtttcaatggtcatattcccaccatatttgtcacatattctagatatattggttaagccaatgccatgaacatcctgatttgatttttgactatgcaaatgagccacttcattttccacatgattaaggatgtgaatgaaaagcgcagactcattggaatgtattttaataagaatgtacctgtcatcggcaatcttgacctttttggatgcttctatggcattatccagcatgttccctagaactacacataaatcataacgttcaatatttactttctgtgaatataagttaagttgggtatctatctttatgccattggcttgcccaatattaagactattcgtgacaagggcatctataaccagattaccggtattaaccctttgatatgctccttcgattttatttaaggtaaccttaatatgttcactcgcctctgccaattcatttctcttgatacattcttcaatatacaaaaactgttggtgtgtatcatgaatgattctttttatatttttgaagctgtgaaccgttttttcgtagttggcatcttggtagtccatctgatgttgtaattgagcattttcatgcattaattgaaatttttcaatgacattatcaaaaatatatatgataaaaacatttaaggaaataaagccaataatagaaccaaaataatacatattcttttcactataaacagataaaacattgacctggtataaacttatgatgggaacgattagaaataaaatatagtaacgatgctgcaaagggaaggttctgcgtttggcaaatagccgtataatctgaatgacagcaaacatgataatgcagctgagtaacataaccttagagaatatcaagtgatcttgtccactcaaatggctgaagttgctaattttaacggagcctacagcatataaaatataaagagatataaaattaacgatggttatcaatacagcataaagaatagaaaaaatgatctttgtctttatttccactgtatacgattgcgctaaactaaatatgacaagtaatgctaaaatcgaagataccgcaggagtcaaataaacacttaaatataaggaatccagcaacccaaaaacaatgaagtacacgaatctgttcggctttcgattggacttatcaaaaaccgagttaaagtaaaaattcacttgaaagcacataacaaggacaacgcaaagattaagaagcagggaattatattccatcatattaatgcatcttcatgatcataaatttggtatatagatctttaacttcttttattttagaacgcccaataggtaacttcacatcatttgacatcaaaacatcaccgccagcaaattttttcacatgaattaagtttataataatcgaacgatgaatttgtagaaaattatattcttttaatgctgaagcatagtccgaaagaatccctttgctatcataggtttgagtagaggttacaaaatgcagtttgttttttatggttaagcttttgaccacttcaatactaatgatatcatcatattttaaaagcacttcctcataagctgacttgatgataacgaattttttatcgagagattgaaaatattgacacagctttatcattttttcctcaaagatatggggagcaatcggttttattaaatactgaaatgtgactacgtcaaaactttccaccatatattcagggtagctcgttaaaaaaacaatctgttcatccaggtgatttaaactccttattttttgggcggtttgaattccgttcatgccattcatttcaacatccaatattaagatatggaatggaggctcatggttttgataatgagataccagctgttctccggagtcgaataattcaactttaaattctatactggtctttatcgacaaagtaatcagcatatttttaacaagttctctctgcttgtgctcatcatcgcagatagccactctatacataaataacatacacctcgttcccattgcattgatcatggaattgtattctaaacagtatataaccttttaatattctataaacagcttttggataaaacgcaaattcaaatccctcaaatgccagtatacaagctgctcagcagttgcatccaaggtaaaaaagaaaccctcgtcttaaaagacggggtttcttaactattttatgatcgttattttaaaaaatctgctctcttgtcttcaccgtgggaacgtctggcaaagtcgataaattggaatttgtctagccgatgccttgactcggtatactggaacaacgtggtgtcctccagataaacatagttacgcactacgaccacatgagtgtagttctgaaggtccatcagcctatgatcttcttcatctgcattttctacagaaaccacttttttggcataactaatttgaagatggagctctccctccaaatattcgtagatggacccacgactaatttcctcggtaagcacaggtacaatgtctgatcgaaagtaatctttatccagtatgacgcattcaccttcaatctcacgcgcacgaataactttccagaccaaatacttgtctttgtcaatctcaagatgattggctatgtcatctggaactggaattagctgattttcatgtacaatggttcgtgatgtacgcccaattcgttcagacatttccttgaaactgaccagtcctcctataggaaaatccatccgtccaatatccagaacaaaagatcctttagcttttattttatggatatacccattttgtgcaagcaagtgaagtgctttacgtacggtttcacgagaagtgttatactctcgggccagttcattttcagatggcattttcgtgcctggagccaattcgcctgtctggattcgtcccgaataatcctgataaatttgcaaaaatatattctttgtcaattttcatcaccacgttcattgtagcattctttcacttccctgttcactataatagactgtgcgaattgaatctgaattaattcctatgacctgatgaagaattcaaatgaattctcattaaggtatactgcaaatcgtctgcctcacctggcagttcttcaaccgattcaatcatactttgaccatccggcacaatgactggtgtaatgacgggatatccggatctctgaatcagatcacggtcaaattccatcagtagttgtccttgctccacggtttgattggtctccacatgcatggtgaatccctcacccttcagtgacaccgtattgatccccacatgtaccagaatctgtacacctgtcgaatgctccaaaatcaaggcatgcttgcttttcatcatgatatgaataacttttcccctgaatggggcaagaatcttgccatccttcggttccactgcaataccttgccccatctgccgttcggcaaaagccgggtcaggaacttgttccagcggtacaacacgtcctcgtacgggagtcctcacttcaagcacatctattgcggtattttgcggaagcgagtctttttgtacggaatcattggctggtgcagcctgacggcgcttatttagcagtttcccatacataaaagttaaagcaaacggcacaattaacacgatcgccatcccgatgaagaatacaccccagttgtttgggaaaatagacaagaagcctggaatcccgcccacaccaatggaagaagccatcacatgatttacggtgagcagtatacctgcaataccggaaccgatcattgcgaatacaaacggatatttatatcggatattcaccccgaatatggcaggctcggttacacccagaaatgcagacactgaagaggtaagagccaatccttttcccttttgctccttcaataccagcatcattgccagtgctccggcaccctgagcgatattggacagcgccagcatcggccaaaggaatgttccaccctgcgtaccaattaattgcacgtccaccgccaagaaagtatggtgcattcccgtaatcacgagcaaggaatacaagcctccataaatcaggcctcccagcgcaggagccaaatcgaaaacgtatacaagaccagacgtaatagcattaccaatcataaaagtaaccggaccgatcactgtaaaagccagaaatcccgttattaataatgtaatcggtgctacaagtaacagtttaaatgaatccgctatcttcttatttaggaatttctcaatgtgcgcgagcacgtaagcggatactaaaacgggtaaaacctgtccttgataaccaatcttgttcacttcccacccaaacaaattccaaaccgggacggttcctttggtaacagcatctgcataaccgtatgcacttagcagatccggatgaaccagaatcaaacccagtacgatcccgagtaaaggactgccgccaaaccggacaacagccgaccatccaattaaggcaggtagaaatgtaaaggcggtgctggcaatggtgttaatgatagcagcaaagtcggtccattgaggatagacctgaaccagagccataccttcgaagaagattcccttgccagtcaaaatattatttattccaagcaataagcctgcagtcacgattgcgggcaagatggggataaaaatatctgccagcgtcttgatggcacgctgaattggattttgttttttgcttgccgcatttttgacatcgtctttagaagcccgactacctcctgtaatggagatcatttcgtcatataccttatccaccagacctgggccaatcacgacttgatattgtccttgtgaagaaaattggcctttgaccagatcattttgttcaagtgcatctttatcaaccagcttatcatcataaagggcaaatcgcagacgagttacgcaatgcgtagaggcctctatgttgtctttgccaccaacggcttttataatgtcttctacctgtgatctttcaatcgccatttagcccactcccttaacgtttgctcattttaaagtagcaaccccggttatcaaaataacgtgcccggggtgctactagatgtctccatactattcactaagtctacgaacaatccacatatatgaagcatatggggttaaagagatcacttgttttagctctggggcgtgctgggtattaccaattaagagctcagccgcatccaacgcttgatttattaaccgtgaataaaatgaatccggtatacggaattgcgcatcctgtccgctaaaattagagatgacgatcaaagtctcctcttcattgctgcgttgataggcgtagacctgaggatgagcttcgtccaagcgttgataattcccatcggtaatgacttgcaccgtcttacgcagatgaattagcttacgataatggtgatagatagagttcgggtcctctaactgagcctgaacattaatctgtggatatcgttcatctactttaatccaaggagtgcctgtagtgaagcccgcattgcgagtgccatcccactgcatcggtgttctcgaattatcacgagaccgctctcgaatgatattcaatgcttcttctgcacttttgccttgctcctgtaaaatacgatacatattcagagattcaacatcccgaaactcttcaatgtctgcccactgcgggttggccatcccaatttcttcaccttgaaatatataaggtgtaccttgaagaccatgtagcgtggttgccagcagcttggcgctttccgcatggtattggccatcatccaaaaagcgagagattgcccttggctgatcatgattattaaaaaacaatgcactccagccgccaccctgttgcatgcccgtttgccaatccgagaatagctttttcagcatttcaaaatcatatggcatgagttcccacttctgtccatttgggtaatccacctttaaatgatgaaaattaaaggtcatggacaattcttttctctctggattggaataacgaatgcagtgctctagggaggtagaggacatctcacccacagtgacgctattctgtttggcaaatactttctcatgtaactcatgaatgtattcatgcacatgtgggccgtccgtataatatttacgtccgtcgccaggaaccgtgctcccatcatcattcgagaattgttgatctttggagatcaaattaatgacatcgagccggaaaccactgactcccttctcagcccaaaattccagcagattgacaacttcctgacggactttgggattttcccagtttagatccgcctgagtcttatcaaatagtgtcaggaaatattggcctgttgcctcgtcatattgccaagcaggtccaccaaatttggaaacccaattgtttggtggtccaccatcgggtgctggatcacgccagatatagtagtccctatactcactatccttagaaagccgtgcctcctgaaaccaggcatgttctgtggaagaatggttaaccacgatgtcgatcattaagtacatcccacgtgcacggatcccctcgctcaattcttcaaaatcctgcattgttccataatcaggattaatctggcaataatcagccacatcatacccgttatcacgttgtggtgagacatatacaggctgcaaccagacaatatcaacacccagtttttttaaataatccagcttttgcgtcagtcctcttatatcaccggttcctttgcccgtcgtatcgttaaaacttttgggataaacctgatagactactgatttacgccaccaatctttatcttgaggaattaaagtcttgttcattgcttccattcatgctcattcctttcttgcgaaatgaagtagcgtaaaaataatataacgctttcaacatcttgtatatacaagattaagtcatgtatatacaagttgtcaacagctttatctattaaggtaatacccgttttgcagctaaatgatcaggagactcatccatcctgttcgattgtatgttatgactcgtagaataagctcaattcacacgaaaaaaaggctcctgcctatagtcaggaacccttcttttctatgatgaataaggtgctcatttacatccatatcgatagtgcactataaaggagcaataaggacattatgatattgaaggaacgctcatgcttattcaagaaacgttgaaacacagcgccaaaaatcgcccagcatactacagctacaaaaccaatacaggtcaggagtaatgaaatcgtaataagctctatatacgatacatcataaggcattacaaacgttgaaatgaccgtaataccatacaaaatgatttttaaattgataaattgcagcagcagtcctgatttgaaggaatatccctcattgtgatcattatcgtccgtagaggatttgctccttgcaattttcaccgccagatagagcatgtacagactgccgaggacattcatccagatcttaactcgtggcaaaaaatgatacaaagcaagattaaaatagcaggctaacagcataatagcgaaacagcctgctgttactcccagcaagaatgggaatgcttttttcaaacccaaccgtctggcactgtctaaagacataatattgttgggacctggcgtaaagctggtaacaagtacataagaaaggaacggaataaatggcatgcaacaatcaactccagtatgttataattgaatgaaatgtacgttgaagcgcacatttgtactttatgattgtacaatatgttctttataaagcacaataggagcgaagaattatggagaatattaatctgattttaagtaaaaatttgaaatatctaagaaatgaaagaaaattaagtctagataaattagctgatctgacggggatcagtaaaacgatgctcggtcagattgagcggggagaatctaatccctcgattacaaccgtatggaaaattgcgaacggcttgaaaatctctttcactgctctgattaatgaaccacctgcagatgcagtagtcgttcctaaaagcaaagtacaagtgcttgaagaaaataatcactatcggttgtatccgtttttcccctatgaaggaagtagaaattttgaggtttacaccgtagagattgaagtaggcggagaactgagttcagcgccgcaccgtgaaggtactgaagagtttattacggtatttgagggtgagatggtggtaaaaatcagcgaagaaatgtacacggttaaagctggagattcgatccgctttaaagcagaccgcccacacatttactataatctaggagaaacactggttcggatgaatatgattatttattactctgtatagtcctccaagagatcctaagtgttcaagtctttaaattaaatgatcctattaaaataaggagtccttttaataggatcatcggtacaaaaattaaatgatttacttgtatgctgttctaggagatttcaatttgtttaattattcgcgctggatttccagctacaaccacattatctggaacatccttggttactactgctcctgatgccacgacgacattattacctatcgtaacaccgggattaataactgctcgaccgccgatccatacattgttgccaatcttaacaggctttccatactctgggccagcgattcgttcaaacggatctatggggtgagttgctgtgtaaatatggactcctggagccaggaaacaattatctccaatgcgcacttcgcaaacatccaaaatggtacagtcaaagttggcgtagaaattttccccaacatggatattgtatccgtagtcacagcgtatgttgggttccatacctatattttcaccagttgatccgaaaagctccttaagtaacttttcacggtactcacgatccgtctctgccgtctgattaaaaagacgtacacatcttctcgcatactctctttcttgcgttaattgaggatcagcagctacatacagttccccatccatcatcttttgtttttccgttttcatagtcatgcgacaatcccctttatattttaatctgatttcttttctttccccccaataggttgggctgcaccggatatccaaccagcaacaataacgccaacaagcactacgatcaaggcatacagaagtccaacatgttcacctaaaaaccctaatcctggggggcctactaaaaaggcaatgtaaccgatcgtggctacggctccaacccggatagctgcaccacgagggtcatctccggcagcagataagcccacaggaaaaccaagtgaggctccaagcccccataatacgacgcccaatccggctatgaggtaatgctgtccccagatcactagaatgataccgatagcagccaggacagcacttcctttcaatacagggacacggccgtatttatccagtatgaatcctccggtaaaacgtccaatggtcatcgctgccacaaatagtccatacatataggaacctgttaaagaatccacgccataaccatccaccatcgttagcggtagccaatcattcgcagacccttctgcaaacgccatacctaacacgatgataccgatcaataaaattcgtctttctttccatacagcaagctgcgccttgagattagatccaaccttttgagtaggaacttctttctctatacctgtatcgtgaggcagaaaacgataaaaatagaaagttatcactgcaatcatggcagccatcgctccaaaatggaccacaacaggtatgtgtagtgccgctgctccagaaccgatgactgcacctacaagtgtccccatactaaatgaaccgtgaaaagccggcaaaagcgttttttgcaattgattttctaccgcagaaccttcgacattcagagctacttctgctgtcccataaccacctccaaagatgactaaaccagcaaacacgatgctcgtgagcgaaaatgcagttcccaaccctacaatgacaaaaccgcttacaatcaaaatcgcacttcccagaatgaccacccgtccacctacacgagaaatcatattgcctgcactgagtagtcccactaaagaacctgcagctaatccaaaaataataattcccatttcggcagtcgagacatgcaaaatatcccgtataatgggcgttcgagacacccaggaagcaaaagctacacctggtaaagcgaataataaaaacaaaatattacgaattacccgaggattcatggatggttctactggcatttacttatctccttatcaccactttttattaatcttttaataagttatattataattagtcattttattcgtatccaaactatttgtcaaaagagaattatagtcatagatcgttattgaccgtcagttgtaaacatataaaaaaggcctgagcaggtaaagcatgagcactcatcacctattcagaccttttaattaaactatacgagctttatactgaatcaaccttgaattatcatttgcgttcttgttctattttcagtctggtttctcccagcaaccctccatctgctgacgcttgaagcaacaactcaccagccacataaccggactgtacaacaacgagacaccttcctctgtgtgttcgtctctcattccccttgaaggattcatcgctggtgagatcaccattgtctattccaaggatacgaccatcaccctgtagtttaaaggctacatcaaaattctggttaggtacaatgatcccgttttggtctatgacggttacttctacatgagatatctcatgcccatcagcaggtaggattacccgatcagcctccaactttagagcataaggaagtccggcagtggttaattcatgctcacaaaccttattgtttccattacgacccacagcccggatttcgcccggtgtatagggaagctcccatacgatcaaatgattaggataatccactaacttcctctcaccgtatgattcatcattcacgatcaattccacgctctcacaattggtgaaggtaaccaaccgtattaattttccagcgtattcaggaaatgtccagtgatcttccatggccggagatctccagtgcatcgtccatgtcggattaaattccgatttcatatgttcgttaaatacggctatgtgcacaacaggctgattagaccataaactttgttggagataagatactggtttgcggaatccgcaagtatcaatcaggcccgaggaccaccctttggagggatagctcgtttctcccaaatagtcaattccactccaaacaaattgaccgatcacataatcatgattagcgacatcaaaccagggattcataggcaaataacctttaactcggttatccttaccccgatagtatgggaatgtttctgttccaaggattagcgtatccggcatggccgccctatagtgctcataccactgctcctgatagtttaaccctagaacatccactcgttgtgccagctgtttggtatgctccactttggcctcaattgaaccctcacgcaagctgatcggtgtattatgcggctcaagcgcacatgtaactggtcgagttgggtctttttcatggcagaaacctacgagctgctccaacattttgagcatggatggctgaccttggttttccacttcattcccaacgctccacatgaaaacactgggatggttcctgtctctgagcaacattgcttccagatctttttcccaccactcctcatataaatgctcatagaaaagagatttccatttgtcaaaagcctcatcaaccaccaagaaccccatctgatcacataaatctaataattcgggcgccatcgggttatgagcaaaacggatcgagttacagcccatttccttcagcttttgaagccttcttttcatagctgtatcatggtaagcagcccccagacagcctaaatcatggtgaatgcacactccctttagctttaagctgtgcccattcagaaataaacctttttgggtgtccagcttcacttctcttatgccaaaaggggtacaataacgatccacctctgtattgtcacaataaattgtcgtttgggcttcgtagagcactgggttgtccggtgaccatagttctggttctaaaactcgcgttttttgctctatttcccccgtttcacagctcgaaagagtgactcggttttcaacttttcctttgatctgtccctgtgggtccagcatttcagtcataatcgtacactctacggcatgcgcgtgatgattagtgacctggattctggcagtcaccttggcttcatctggcgaaatttcaggtgtggtaatgtaagtcccccattcggttatatgaatataatccgtacaaatcagccagacattacgataaataccggcccccgaataccatctgtcaggtgaaagaatcgtattgtccactttgacggcaatcacattctcctcatcccaccgaatatatggagtcaaatcatattgaaagctaacatatccatagggccgcttgcccacaaaatgtccattgatccaaacctcactgttactgtgaatgccatcaaattgtatgtatacgcgctgttttggagaggagggcttcacattaaagtgccttctgtaccatccgacagaccatctcggtaaataagcttgattgccaccatacagcatatgtggatcaaaggacttctcaatgctccaatcatgagggacctgaaggagtcgccaatgctcatcgttgtagtccattttctcagcacctgcgtaattaccctctataaacttccagtccgttttgaacggcataatcactctgcttcccatcatcttgcctccatttcataaagtggatgaacggatataacagcagtgctggatgaccatcacaaaagacgtgttctcattacaatatttgaaacaccgggcgatcttcaataaagtgtaccgggagcattggaaattgagcggaaagtacatctgcgagatacttcatcccaggtgcttcactttcagcatgtcccagcatgataagtgctttactttgaccttgatagacggcatctttaacatattctggtgtttcccattctgggccttcaccggcaatgactaaatctacattttcatttagaaataatggaatggctagatcaccacctcccctgtatcctactgagattcccactcgttcacatggcatggaaacctcaccagccacccgtacataacgaatatgtaatttggctttaatatattcagcgatctcctgaacttccataaccggaatagtcaaaatggcggccgtcggctgctgcttcacaatgtagttgtgccagtcaagcgcctgaagtagcccaaccatcactccatccggttgataacgatgtatggcgtcatgaaaccgataaatgcctatacctgcatcggcaatgaggcgagatttttgcaaaaaaacaggatcatgtagtaaacattcatgcatcctctgatgactataaaagatgccttcatgcgtaatgataaaatttgcacctagagaaatagcttgttctatcacatactgcgaagcggagaaagcggttacaattccgtgtacctcaatatctataaatcctggttccagcagatctacggtggtgttgggtatgcttattcccttggtcagatgattcacaacctgccccatagtcatggtcatacacgttccctcctcatggataaggtatatcaattgtaccattttatttcaatcataagtgctattctttctaacaaaacagccagttccaaaggagccagctgttttacgaatggttctattatttatacagaacccctaaaatggagtcgattcgttcttttgccccttgccaggatgtcatgacggggaactcatattgctctcttgctctcagattccatggatgaggaatgcaaagcacctttttccccgcctctagcgcaggcactaaattatgaggaccatcatcaatcaggagatcatagttaatcaggttttttcgtttacatgggaaaaagttctcaatcggaatgaatggcatatgtctttgaagccagttccatttctctacgacggtcttgggttctgccgctgtcacaataatgacatcaaaagcattgcaaagcttttccatttcttctacaacatactcgtcaaatagttcaagttcctcaaacaaacccggtcgtccataaaatacatcaagcgtgctctttggatgacgtagatgatcggtgttccaatctaacatttcttcataccgaagcggatgagtgggaaattcactattgttatggtatatggctcgtttgacgagatgacagatggtatcgtccatatcgactgcaatgattggttttctcatcagcttgcccctattcactctggtaaaatttttcataagaatatcatactataaattaatatcgtggtgaagcttaggtattgcttccgatagatctcacctttgttcaagataatcagtcaagtagaacgttaggtttatctacataaactaggcataataaagcaaaactagttaggttatttttatcttaaaaaaactaaattacaaataaatatcgaaggaatacatcttaatagaagcaataagtacaataaaatcatagaaaaatcacacataaataagtaatctatgtgtctgcatttcaaaagcaaaaaaatagctaaaaaaatcaattgcataacaaaaacacaaatgatagaataacaaaaaaataactattaccaaaaacgaaagcgttttatattgtgtttagcttactgctgtatacatacttacatacctacttcatctctatatagcaggaagttgaataatatatttagggaggaataaaaatgaaggtattgttaagaaaagcattattgtctggactcgtcggtgtgcttatcatgattggtttggggggattcttctccaaggcacaagctgcttcaggattttatgtaagcggtaccaaattgtatgattctacaggcaagccgtttgttatgagaggcgtcaatcatgctcacagttggtacaaaaacgatctttatacagctatcccggcaattgcccagacaggtgctaataccgtccgaattgtcctttctaacggaaaccagtacaccaaggatgacattaattccgtgaaaaatatgatctctctcgtcacgagttacaaaatgattgctgtgcttgaagttcatgacactacgggcaaagacgactacgcgtctttggatgcagctgtgaactactggattagcataaaagatgctctgatcggcaaggaagatcgggttatcgtaaacattgcgaacgaatggtatggttcttggaatggaagtggttgggctgatggatacaagcaagcgattcccaagttgagaaacgcaggtatcaaaaatacgctcatcgtcgattgtgccggatggggacaatatcctcagtctatcaatgactttggtaaatctgtatttgcagctgattctttgaaaaatacggtattctccatccatatgtatgagttcgcgggtaaagatgctcaaactgttcgaacccatattgataacgttctgaatcaaggactttctctgattattggtgaatttggcggttaccatcaaggagcagatgttgacgagacagaaatcatgagatacggacaatccaaagggataggctggttagcctggtcctggtatggtaatggttccaacctttcctatcttgatcttgttacaggacctaatggcaacctgacggattggggaaaaactgtagttaacggaagcaacgggatcaaacaaacatcaaaaaaagccggtatctactaaaaacacattaagaaaataaaaaagactcatgtattcactggctccttactttatgtgaaatgaatctggaaaaggatcaccatataaccttctgggttatatggtaattttgatttcatatacaggtacaaggttaaccgaaccgatatctacgatacgttcctttgtcgtctctttccagcccgccatagtcgtattgctgttgagaaccttaccctttcgaatgggggaaacatatacgtacaacccttgcttgatgagccgatgttcaaatgctttcaaacctatttcccaagtcgtatggttgcagaaattatcattgatcagttcgccatccataaaagcatagccgatatctccagtataatcgatacgcagcagagcttccttgattccatgaaacgcatctgtttcaaaatcaatagtaaatttatcgttatttacccttttcaaattgaaatggatttctttcttaggagcctttaaacgatacgttttgaataattcactttctgttatttcaagcagctctccaccggaaatagatgtgaatgaggcgtcaaaatccgggaatacactcagagttaccatttcttggcccgttgattccagccttagaacgccctcagatacaagtagattggcatttgtcaaaatgactctatttcggtcttgcatgtttaccttccaaaatgtaagactttgctcatcagtcatcgtatagatggcaactttttggccacttttagataccagatggatgagactatcctcctcttcagcaaccttaatgatcgtgttcccatcgaattgctctgtcgaacctttgtcgattgtggcactgatcatgccttttgactccattgcatacgttcctttcatgccctctggtacaaagaaaaaataatatacttctccatcttcttctatccttgttatcagctgtgcggtagcatatttaagcattattccatctaaattgaagttaaatggcaatatggcgaagctatcacgtcctaacgtcagttcaccttgactaggaattacaatcgtttcctcgggcagctcaatgctcacattaaaatcgcacaggtcgtcattttcgacatggtcttggaaattatttagaaataggtaccccgatccggcactggatcgcactgcatatcgtaacgtttccacattataagggtccatctgggacgtatcccctggcagaatagtctttgttagagagaattgcttttggaacgttgaaaaaaagtaatgttgcagctttgttctttggtatgactcccttacttgaccgaattcgccgatcatggcgttgaaatcataggatattttgggtgtagctagatcatttatatatgggttaacctgacctcgaggattggaacccccatgatacatgtagtatccgatcaggttacagccttctgcaaccttcatgacagtcatcgctggaacactacggtagggaaaggcgaaccgatatttataaaactgaaccatgccgccacccatttcacagcaagcgtacggatagtcttcaggggcatattgaggctcaaaattgtagctctttggaatcttgttattatgcttgtctcggaaaatgtattccggtgtcgcaggatgctcgtccatcccttccaatcgtccctcttcgtagtagatccatggccaataggcatacccgccccataatggcagcatatcagggacaggagttgttgctcctccccatcctgtgcacgtatagatcggagtatcaatccccgcttccagagctatttctttaagttttaacatatgcgagttaccgtcacttccgctgtttaaccacatatcattaattcctacagtcaacgcccactgggcagatgaatgatgatgttcgttttcgatttgggtgccgataatcggccccccttccttatatagcagccctttaacctgggcaccgatctcgttatataatcttctcgtatagaacagatacccctcatcattagaacgaatctcaaatggtcgaccaaataaccaatccggcataccgccgtttcgaatttccccgtgattgaagggtccgatccgaataatggagtatacctgatgtttgccgcacaactcgatgaaacgacgaagattcttgttcccactccaattaaaaacaccttcaaattcttcatgtaggttccaaaaaatataagtggcaatgatgtttacgccgcccatttttattttaataatttcgtcttcccaatagcgttcatcataacgggcataatggaattcaccacaaataccgaaaaagggctctccgtccttctccataaaatagttggtgaatccgatttcctctccttttggattggtgccgccaagtttgatatgtcccttaacaattcgcttttgatcgtctttgactgtaactcgatagtttctcatggagttcactcccctcactcgttaatctgaattcaggataaattgattccacttgcgctgccaagcgatatcattccagaatggatgatggggagcacagttagagcagagggtcattccccagaacccaagtgccattccttttcgcaacacatattcagctataaatttaccgattgggccttcttcaaattgggcatacagcggcgtatagcctacataaccttctcctatgacaattggaatgccggaatgacgagtccattcatgaatctcttccaatcgggagtcggccttctgcaacatggcaattttatggtctccataccgatcgtacaaaaataaatcccattgatcgggatctacccagtcgtgcaaataaataagcctcatgccgactggattgccttccatccgccaattctgctccggaggcagggtccactctgcaaatggaggagcgtcttctcttaatagggattgcacgaatggattggggaacggcgccaactcatcatcaagcgctgccgcttccataagctcattgagtacccctttaatataaagatgaaaatgggcaacctgcatattgctcgcgacgtaagttttagggtaggcttcatttaacgtatagctggccgtcatcatgatatcaggatgacattggcggagatatccaactgcttcttctacgtagggctgcatggcttcaataagcgctggtacattcgtttcggctatgccttcagacgttccgacggcgtttaactgcccaaattccacttcgttatgcagctctgtatagataatctggttcctatagccttctgctgtgacgaaacggatcaactgatccattgattttgcaatggccatgaatctctccttaggaggaattgcagctaattcatctctaagcccagcatgagccagaaagctgggactctgctgatattcccaagaggataacataatgtaacagttatgaacctttgcttgtttaaacagttcaagtaaatgagcatgcccgtccagcactgcgccgccacgacagttataccaacgcgtacgctggcctacttccccaaggttagcaaactccaagggaccgggacgtttgccatccgcagtaaacaacatgtatggcatagcacatattcggatcgtattgtaccctctttcgaccgcttctttaaaacgggcttcaagatcgctgtagggctcaccttcctgtgtcattgtataccaggagaagtcccacatggtgatcgtcaatttgcgcggtaactttctgacgagattattcatttgatttcccctcccagtcccagtccatatggttcaatgctccttggtggttagcttccagcttgagcacggatttaaaatgcaagatagcttcgtcctgtcgccctaatccaagcaaaccaagtgccttcatataagtacaatgaacctgattacgaatattcaggtcatcttcaaagatgagaaagtcgggtaacgagaccgcgaaataatccatttttacgggttcaaataagtgcctttcggcgtaatcaatgagcttgttgaaccgacgcatgccttccttcgcatagccaagtttctgccaggccaatccttggtaaaatatcatatccggctgctgatcgttataatacatggcgttaatgggttcccccagtccttgagaggccgtggaaaaggcctgccttgcctcatctgttaatttcaatagctcatacgcacagcccaaataatagtaaatatcgttatcttgggaaccctctagcttaccttcgccaagattctctggatacactaaagcctcccgcagcccttttacagcctgttcaatccgtccagacctcaggtcggacttggcaagctctaccttggcaagcctatactgtccagttaccttcccctctccgccttcccatggatgaaatattctccctgtcagcaaggacaaagctaccttatgttgcttcatcgtattgtgaacggttacatattccaaaaacagatcatcgcgaagctttatgattcccggataactctccattaggttcaatctgtcgttgggcctgatgttcagcttcttatacagctggtcaagctcataaagaacacgcgcgtctgaagtattgcacgcaaaggcctgctctaacgaatggcgagccttctctaattggccctgtttgttaaaatatccaagagcaagattacggtgaacaacggggtaagtatcgtcaatggaacgagacgtttcccagctggaaatggcatccagatatcgtttcttatcatagagtaaattacctaagtaataatgcgcctttccgtcccccggtctcgttcgaattgcaaattgtaacacatccaactcaaacagactgttaggaaagcagtagtcgggtactgcatctgcggcctgagcgagagcattgttcacctgctcatgcttgccgattttagcatagcagaaggcctgaacgtaatacagcatagggtatgttttcgcctgctctggagcttcttccagcacacatgctgcatcctcataaagtcccgccgccgcgtagtccgatgctaccgctatataattatgcacatctccacgcatccattttcccagctcttcgaggaccgttttagcaacatctcgtaacccgagagcctctaaagataatgcttgctcactgtaagctccaaaatcggcgatatcgagcttcatcgtttccttggagaaggctattgccgcttcgtagctgccaagcttacgaagaatagccgacttcaggttgcgtgctttgtagttgcgagcatttcggattgtcgagcgctccacgagttccaatgcttcttcatagttcccttgttctgtcgcaatctgtgccagtgagaaatacccgctgtcttgccatgccgcactccataccgatttataaaatgcagcgaacgcttcatccaaccgctcttggtgttttagcgacaagccaagctggtagtaggcctcaccgtcatagggattagagttacgccaggttacccgcgagatggctttacgaaagcactcttcactctctgaatacaaccctctacgaagaagtaacgtaccatatgccacatttatgcggctgtcatttttatctcttttcaggccctcaagatagtacgcctcgggttcaaaggtagcatgacggtattgctccaaatgttgtcctgctaaatacaattcttcgttcgttcttaattcctccggttctggcaggggggcggcggcagccggcatctgttcaacgtccttttttttcggctggtagctaatcagctcccttccggtcgcgtctttgacggttaagcatagttcataatccccatcctcagccaaaataactgtcttctgtataaaggccttattaggtgtcagatctaaggtttctttaatataaactttccgctgactgcgtaattccacaacagcctcacgaaatgacgaagttacatagactccaatctgtgctgtcccttcgctgcgatttaattccagattaacggctgcgtcaattgaagcgtttttgaccataccaatatgtttgtaaggcataaaatactgcgagaacgatttttcttcatacggctgaagccaagtgaaatctggttggttatcggtatatacccccgtcatcaactcgatgtagggaccatcttcgtctgttagattccggtcccatgcttggccgaactcgccatttccccatgtccattgcttttttccaggagagatgtgatggttggccacatgcaaaagcccggcttgtttcatatggtcgtaaccacctatgaaattgtaatccgatttataggccatatatgaagtggggacaggaatatttttgtatcgggagatatctacaccttcagaataatccattttataataggtgcctgtagcgatcgggaaacgggatacatctcgctttccgtggtcgaacacggctgatacgtctggaggaaaaacggattgtgtgtgatcatgtaccgctacggctggattggcccaccatagaaacgtttgaggctcgtcagtccggttgtatagctgggcctcaactttaaggtatgctttatccggttgtagtgtaaaaccagctgttactttcgtgccgaacatacgatcaatttcgctcacccataccgttgcgcttccgtcgtcatgttcttccaacttgtattcaacgggtccataagtgttgggacggtgatgctgcggccagttgaactcaatccctccagatatccacggccccaataagcccacaagcgctggtttgatgaccctgttataatatacaaaatcgtaaccgttggtcttgtcgaccgcacgataaatgcggcctcccagctctggcatgatctcaatgcgcaaatatttattttccagaaaaaccatttggtaattttcaagtttcttctcatcctcaattttatcaattactggatgcgggtacactcgaccggagcttccctggtagacacgtttctccagaaacattggatttttgtcgggtttgccaattccatacgtggggatctgcacagtttgctcccacacgcgtgccttagcatcgaaaatgctcaattccatcactccctcatagtcgcccttatattcagagcttacaagtaagcgacattacagacaattgacaatccactgtttatgatggattatatacgtatttcatcattagagccgcttacggctgggagatggatagattatgaataagaaagctgatggatttgagggtgaaaagttatatgtccttccaccctatatgctggataaattaaatatgaatccgcttacaagaaatctatatattacggatataggctgcttcagccatgcccgccatcattttcgtgaaagaatgcacggatgtgactctcatatattcatctactgtgccagtggaaagggttggatacgaacaaaggatggcctaacgattgacatgacggagcgaagctttgcgtacattcccagggacatgccgcatgcttatggggctgacgatggagatccttggacgatttactggtttcatcttaaaggggaccaaatcgatgattttatggcattatttgagccttttaaaacgtatatttcgatggccgccagtgatgaagtcaaactactggagctatttcatcagtgttacgaccttttactgaataaaccatactccattatacatttagttcaagtatcgcaaactgtccgttatctgctgagttttgttgtatccgttgcatttcgcaaggaagacagtacgtaccagagtcatgtggataaagcaacacgctatatgagtgaacaattggaatccaccgtttcgcttgaggagcttagtcggcatgttcaggtatccaagcagcatctgaacttgatattcaagcaatccactggctactctcctgtcgattactatttaagaatgaagatacagagggccagtcagcttttggatttgacgaatgcttctattaaagaaattagcatacaactcggttttagggacccttactacttctccagactattcaaaaaaataatgggctgctctcctttggaataccgaaataatttgaagggttgatctatgttcatcaagagcgttcaaatttgcttctatcgggctaccgcaaggtcacagatcatttacgaatcgggggtgcaaggtctatacttaaggttaaaaaaggaagttttgtatgctcctcacgttgaatcgtagactaaatacagctatgccgctaattacaccaatcagcattttaattggcgtcctgatcggtacaccgttgtcacaatatactgaactctctccctggctgtttgcattcatgaccttcgcgggcagcatcagtatggggtttaaggattttgtccatgtgataaagcatcctggtccgctgatcgcctgtctgtttattcttcacctggccatgccgcttcttgccatgatgctggggcatctggccttcaatgatgatccttatacgatcactggacttattcttggtgcggctatccctacgggcatttccagcttcgtgtgggtcaacatctataaaggcaatacggcgctgacattggcgatcattttaattgatacgattttggccccatttgccgttccgggcatcatgtccctgctgatcggagcggatgtgcagctcgatacctgggcgatgatgcagagcctgttctggatgattgtcgttccttcgctaatcggcatggtgttgaacgagtggactaaagggaagatcaagcaggtatggggacctcggctgggaccgttctccaagctggctatggctcttgtcgtaatgattaacggatctgtcatcgcgccttatctggtcgattttaatctcaagcttgtcggagtatgcctatccatagtcgtccttgcttccactggatatgcaatcggctatctgatatcaggactgatgcggtggaataatgcagaccgtacggcgcttgtctttaacggcggcatgcgcaatattagcgcaggagccgtgcttgccatcacctatttcccggccccggtagcactgcctgttgtactcgggatgattttccagcaatccacggcatctctggtcggatttctgctgagtcgtcgcgaccgcggcaatgccaaggaaaaacgcaatacggcctctgtttcttaagcaaaggagtagcggtggttccagaggataaaactcctccttatgaggaggagtttcggaagggcgtttctatacgtacatggttggaagcctgatgaaaacatgcatgcgcaatcatgtaaatgttcactttccaatcataacatctctatccaagtctaaaacagcttttgcgtaagattttgaaattgtgacttcactccatctttctgaagttctgattgaagaacctgattaaaggtttgaagtgcacgctggaatttattttcaccaaattccgtaatccgagtatacacacctcgccgatcatcctcgcatgtatgtctttgtaaagccccgcagtttttggcttccattctcactacgagtctcgatgtcgcactttgacttaatcccaccaattcttgaagttgctgcagtcgcaattttttttcctcggaatgggatataaaacccaaaacataaaactccttcaaggataaatcataattttgtagtagagcttgttctaacttatcatttaaagtggaatggatgtgagacaaagacaaccatacatccaaaagttcgttttcatgttgcaagtttagaccacaccattctatattgaagtatctccacttagtttaacctattgtatcaagcttaaatggaatggtcaaaacccctacaatattttaaatattacaatccgtcaccaccgaactagtatgcaaatgtagcataatgattctcgtttcagagcgtctactttattgacagtagttcaccttaactatcgtccacggatattacatggttatatctgttgttggttgaatgacaggttcattcgaaattggtatttaccacaaaaccagcatcttctaaataaggtaggctaaatccgcttaaccctaggaacatattattcaagtggttaggtaaaaattattttacataattttccacattggcaaagtaaagattacttcaagtggatctttaccttcgaaaaaatcttcatacaattttctgacttccatcgaatctaattcttctccttgcatgttgatttacctatccaactcttctaaaatacttacttcctttgatgacaacacctttgacttaataagcgtgtctttcatattaggaagtaaccctcttggccagcaatcctcatacacacctctgtatgaatcatataggaaagtgatctgacttattcccgcatatttccgaacgtgtggatgcactaataataaaaattgagcgatgatttcagaacgctggcttatatagtaggcctcttttacttccttcattaagtaagatttggcttctacagaattagcaagataattgatgtacattcttgagagaacatttattaagtgttctttctctaaattctcctccaacttcttaattatttctttttcactaatccccgcttgaataaatcctattaaacaagctgacatccctttcacattaacagcttgttcagctatacataatatatatttaccaaaaatttcattgaggtagttttcactaaatgtgtaaatgtctaaacattcaatgatcgtttctattagtaaagcttgatcatacttatcttctatacgcgggagaaggtctatcatatgttcaacaaattcttttccataatactctagcaagctaggattatattttatattttctaatagagcaaaaaacgtttgatattcttttgtatcattattttgtgttagatatttgaacagctcattaatatatttaactttctcgtccatcagactttctccccttttatcgttgttagtgttacttaatttaactttttgcacgactttatatcaagttaatggaaataaaaaaataattctacaatagtagacatcagaacaggtcatttataggaacggcgaaatcaaaagctacatcacatcgcacaaacaagacttgattggcatattctcggatttgttcgagccaatgacggaagtaaacaagcgacttcggatagggttctatcccgagcgtgttctttcgagttttcggagcaaagaccaacttgtaggagatatgcaggaagtgttctcctgtattgattctgattcgatattgaaatcctcgttcccccaccgtcatattgacccggtagtagtgacagattcgtttatagaactcattgaagaagtcccagtacacgtctgtaaagtcaatgacaatacggtcgatggataccgttactcctttcatatgtcgtaccctcccgaatttttcatgaatttcgggcttaattagagggcaggtggctagccttatgttaactggtcgtcaccagagattttttcttcacaataacaatcgcaataacatgccattctgttgctaaaaaacaaaaaatgtttttaatacagccgctcctactactaattgtcgtgctatccatcctagaagatgcgatatatcacatcttccctatcgccgtggcgtattttacagttgcgattgatttcaaaaaactgtgagaaagcgaacataacaaaatacaggtcaatcatggtggtatctgaccataattaacctgtttgatgtaacggaatagtgatatttaggttataaaattaaagcatttgatgtgcgtacaacagaaatggagaaatctttatacgggtattacatgggttagatgtgttattggttgaatgatgtgttatttcggcactagtagccaatctgcttaaccacttacttcacatttttctaacatccatttctttgcttcttctgacttcaacaaaataggtttctccaacgtacctatactaatacttttaatatgagcctcttctatacctttgatatttttcaatgacactccgtttaatacggcttcttcaaatgttgctacacttacatccacattttctaattttgcattactaaaatcagtgaggtagaaaagtacattattcaacttacaatctactaaagttgcatttttaaatactgcttcccaacagtcgcttttactaaatctagatttttttatgatacaattagaaaaatctgtatatctaatgtcagatttataaaaatcacaattctctaaataagcatttttaaatgttgacgaagctaataatgacgaatgaaaatcgatatttcccaattgtagatcatcaaaagtgcaatctatcaaatatgcttgttcaaccaatttatcagataaatccactcctcttaaatccacctcatctaactttaacatttcaccttctttaccaattgtctcaacccactttttatgcaaatcaaacatactaagaatatttctttcttccatttcctcactccttaaggataccacaatattctatttgctattcccgcttcatcaattgctttcttcagttgtttaatatgctcaggcaccattttttttgtgtcaataattacgtcattccctttagcaaattcttcttgtattttttgcataccattttgaatagaaaaagcaccctttttgggatttgttataggtactccgttcctaccacttggatatgattcaaaacttttcacttcccactttaagcctgtagtggtatcaataaactcttctcccttttctgcttgttgaaggagagatgcaatatgcctatcaggattcgactcaaagagattcttgccgagagaaatatgtcacaacgggaactggctcggctaatgaatgttcgacccaatacaattaaccgactttgccaagacaacgtgactactgcttttttcgatacattggagcatatctgccgaacattagatattaaccttcatgagttacttgtcatggaagatgagtagtaccgaacactcgcgtagccttctatacggctcgtagagccacactattgtgtctacatcaattctcgaccaactcacagaaacacctgtaaggcgattccgtacggtctcagagccatttaacgagcctcctgaagcggcaaggcggaatggcggcggaactctatctttgattctgagtaaagtattcctcccgtaaaaaccgctttggagcgaataccgccgcgctccgcccggtgacctgttttttgttatattcgccttcttgcggatttttgaaaacaaacacaactttatgattagataccccgatggatatagtgtcaaagaaaatgcaactaaagatagtccgaccactaatattgtcaggacttatctgcaaattgtccgcaataatttgactacttgccgcgatggttatagcgtaagaactctggtgacgaccagttgatataaagagtaggtcatggtaaggctagccgtccactcagacttaattcgaggggaaagcagttatggacttgaaactaacgaactgggaagaactacagtctagcttgtttagaaatagcgttgctgaacaatcggatgacgaagaagcgacacatctctatgaagtcaataccatgtttacgccgaagttccgcaggaaatccgccgctgtttcttattggaccgcaatgcagtcaacgtcctgcttgaacttgtatcatggggtatgttggacagaggacgaaaacgtgggattacggaatggttcgccattaatcattttacagacccactttcaactattgtttgatttctccaatactttattaataagatttattaactgatctttttctacttgaagaagttgatcctttgtatcgttaacatcgaaactttttatttctgaaacgatttcatctgggattaggtaattttgcgttatgagtatctcccctaaagtggtatacacaatcattttctcactgagagtattctcgcaatctcgtccaaactgacccaacacactatttgtaattgctgataaccaaattacaacttccacatgtatctttttccgttaacatagtaattgtacccttcgcttctctattatccccaagtttcttatcaatatcattcaagatcttatattcagtatccatatctctgagaataatatcacctttcccctcatccaaagaggccttagtagcaggaaatgaagggttttctgggtctaaaaaaaaattttcagttccgggaatttttttgttcggatcactaattttactatgtgcaaagaattccgactgatcaagcccctcaatttccgctttaacatatgcaaaattccctttatctttatctttatatttatatttatatttatatttatatttatatttattagataaccttgatctagcttctacaactttgtcaatgagatactgttcagtttcaagatcaataggtctggcaggaatccagtcatgataaattatttctccagttttatgatcaattggtcttacctcatcagctacattacccgtcccctaagttgtaatcttaaacatagacataaagaaggtggcaactatttaccagttaccacccattttataatccaggcttggctcaccgccttgtattcggtctgtgccaatacctaccgaagctattattcagttcaaaaaactatcaatagcccacttttaattttctattaattttatttatatatgtcctatactcatccttctcatcttcgtataaccaaatgtctgatttattaattagatcattgtctatgattaaactaattattttaattaaagattctttatttgcttctaagattttatgatcaacagatgataacttttccgttaattctactgtatcaatctctgcaaaaaaagggttattatcctttaaaatcctttgaataatttcaaaaacgaccatttccacaaaaatattttgtcttatacatcgtataagatcaaaattttctaagttttcaagcgttttatcaagaatatctagataccatttgactaaaggactattaggattatctattgcattttggactgcttcttcatatgcttctttagttataaacaaactaagttttttagttctatcaaacacattcaacaccgccttattgataattattttggaggtaatattcctccaaatggagcaaaaatatcttctattttattcatagaagcatttacctcattaattttactagtatacaattgtctcaattcactatctaaattaggatttttaagaattccttcatagctttttttaagcttttccaatcctctatatgagtctgaaacttcttgcatatggttaaatggcaatccatcttccctcaatactagtgaaccatcctctcttaagagcggtattccctttaattccttttcagctcctaataaatcatctggtgttacatgagtatagaccctgtcgtgtagatttaaagtagcttgttggctagtcgttatttttgatcttgccccgtctgataaatcatcagcacttgaaattattctagtcctactaccgcccgaaccaccattattcgtctcctcagaagaatgatcattatgcgatcctcctggtgaagcaccgtcatctttagaatgattctttcctttccttccaacggcaaataaaaatgctgcttctactaacagacgggcattttcttgtttggagctgtttatcgttttttcataagcagcatctggatccgttatgactttaacaattttatctgctacgtcttgttttccttcgatgttatcgatcaccatttggagaatatctatattagggaaattccgaagcctctctgccatgtcctctacactctcataggcaaagtttttgatttcattaaacacaatccgctcagtctcatccaggtctttcataaaagagctttccctatacggcccatactctttcctatattcgtcaattgaattcagaaaatcaattagatatttcttttgttccgtcgtgtatcctttcatatcatcccgatacttggaactcatcaaagctctatcactatatcgaaaatgattgtctgtctgccgttgatgttccatcaatgcgactatatctgtggagagatcctgattattataataggcattcagcgcatcctcaaactgttgatccacatttcgttgataccagcgttcccgtatatcagaaggaatatcgctataggcttggacggaagcctgattgactccctttacatagttgatgaagtcatgtatggattgtacttctccataccctctggcactcgtccataccttaccaagaaaatccattgtcgcatgccgttcacgagccctctgttcctccgcgtgtgcatgtaaggtttgagcagcaaccttggccgtcttccccaacaccactccccaaccatgggaaggtacgctggcaatcatggacaatccggctgccgcatatttaactatggatgacggtccagaggaagccacttcggaacgaatcgaagctattttttgacttgctgctttcggtatggcacccaatacaggaatagacgcagccacatcacatactttctgggctagtcccaatacgccatcgagtagactagccttcggtgaatttggagtgtttacggctgccttaacggctcccccatctttcgatgtaacgcttgaattggagcttccccctgtactgctgtttgctgcacttttcgccgcttgcgcctctgcataagctttcacagacattagtgggggttcccaaatcggtgctaaatcagctacaaaaaccggccttttaaccgtgccttccaactgtactttagcggaccgtatatccgtttctccatccaacaccaagctactgctgcccgctttgaaataaatagcctcggcagcttgaatattcagctccccgtctgcatgcaaggagagcgttttacctgccgacaatgacaattcatgttcactgacgacctgaatacccgaaccattcattgaaatgtgaacctgttccgatttagccgtcaccttcaattcactggcactcagcttgatgtccttgccatgaggagtcccccaatacttggtggctggatcagtgagcttgggggacgagcttcgcccttgtcgtatggaacttgccgcatatccatccgcctcctgctctgtagggaaacggacagatactgtatctcctcgttccggcatgacgtaccacccgctatgtccttcggcggtataactgctggcatatggaaaccaccacgccttatcccgatcttgtttttcatccactgtaagatggactcggatgcggcctgatttagcttctaatacacgtccttcgaatgaagctcctgtgaggtgggggcacaaaatctctgtttgctgaattccctgttcgcgaaccagttcgtattcgtgtaacagcaaccctttccgcaattcagaagtgacttctgccactatccattgctcaccattccaattcgtgaggtctccgggccgggcaagcgtttcactctccatcatgtagctgaattccgctgtccttttcggatcaaaactacgtcgagtacggtaaaccggatgcttcatctcaacgtactgcccctcaggcataccaaaccagaatttaggtccattcaatgaaatctctgggatcaacaccgttccaaaccgggaagccatccgtttgagaaaggcccaatccgtctctcgatattgtaaagtaaatccatgcaagatagtactatctgttatgttatcaataacatcggcttgattgtacttttgaacgatttgtttgatcaaatttccgtagggcattaaggtatcctgataagaccgcgttgcaggtgtgatatccaactgaatcgtatgagaaacggcttcaagctccacataatagatgccacgcaccatccgtgtttctgcatggatcaataaaccatggaacaaaatgcgttcaggctgaccattctctgttttggtacggataatgaccggttcgttatcctgatcctgttctatgtaatgatctctctgctcttcatctaaccatccactgatctttaaccgggcatggtcatttaattttcgttcaatacgcagttcgcttatcgtttgaagaggatatggacctgtacattccaactccgtatacgttaacatcgtttgtgtgtgattcaacttgtacctccttactccagcgtctggccatcgtctgtaatccgaatcattcccccgtataggcacgcattcgagcattgatccagcaaggctggttctccctccacaagcacatcacttttgccgccgatccagggtccggtgatgaccggaacacagttcgctttttttaccccgtagatatccaccatgtcactgcttttgactgctggattagctggacaggagcaacgaccgaaattgctgatattggttcctggcaagtaatctccaacgttcatttgcgctttatcttttacatatactccgtgactgaacggacgtttgagacgtgtcggttgcgtaccaaagctacagcttaagatcgccccagcaacaacatatccttgtttacttccccgtccagcttgaataggttccttatcggaatgagacttattttccattcttctatttcccctttcattcctttcttagttcgtcttcacttcactgcccagaacattcgtcattccgcccagcgatacggtgctgcctttgctcgtcatttgaatttcatcccctgccgtgattttcactttactgccggaatgaatggaaatatttcctcctgctgagaactgaatctgtttgtcgcttacaatatgaataccatctttctcatttaactgtatatacacagctccctccttactggtgattacaatttcatcgggagttaatttgatttccttaccgtgggccgtacgaaataatttgatgtcgggattagcaagcgcatgctgctctacactctgattcttttggcgcaaagatgtacttgccatgccttcttcttcccgatgggcagggaaatagagtagcacggtatctcccaactcaggcatcacgtaccatccgctatgtccttccgcagtataaggagaaacatacgtgaaccagtgggctttcgtagggtcttgaacggcatctatattcaaatgtaatttgatacgatctcgctctacctgaatgactttacctggtaaagacagaccaataagctgttcgttaaaaacttccttgtgcctcaaccccttgtgagaagttaaggtatacacgtgttgcagtacacccttttgcatgtgagtgtctaccttgtacacgtacaagcttttacctttaaaggtaacggtgctgcctaactccaaaacttgctccgcctcaaccagataatcaataaaatcatgctcgtttacatgtgctgtatcattgccgttaaaataacgataatccgcgactcgtttactgacggtgtaatgataattcgttaaatcaagtcctgactgggtctcctcaacaccaaaataacacttcggcacttcaaacaccgaggcaggcgtgagtgaagtatgataacgcgaagcgatccgcttgaggaactcccaatctgtttcacgatattggaccgctatgcgacctaaagctgctccccctgtagccgaatcaataatgtcaaaaccgggataatccctacctacagcccgcagcaattcctctaccttcatatttttatcctgaaaggacctgtcttttttgcgaatatccagtttatacgtgtgtgatatagcctcgacctccaagtaatacacatctcggacagctttgacttccatatgaagtatcgttccgttaaatatcggtgttggtgttcctgcctcatccaattgtgatacacaaaccggggaatcggcttcgatcaattgaacataactgtcctgtaattcttcaggtaaaatagctgtaaaagagagccgggtgtgctcattcaaccgcttggtcatacgcaattcctgaatactcaccaattcaaatggcgtaatttgcagccgatcatatgtaatgttagttaatgtcataagggtttattttcctttcgatcagactcgattttcaacgttagcagcatactgcgggcaacgggcttccaggtcaccatttcttcttccgtacagttaaacgcgcacattagcgcccgtccttccaatactgtgaaaaaggataaattatacatgcggctattccagacaggcgtcatgaattcgcagtatcctattcgcttctctcctacctccaacacttcatggccaaaccattcggtcaacttctgggtttgttttaccaccagagccatctcatccgtaaagtcctccaactcttctgtttgcaacgggctttcggtatgcttgaaggttaagttaatcgtgcctgcctcattagtgaaaataaaatctgggcgatgatgagaaggatattttaatagttgctcatcaattggcatatcccgaaagctctttggcattgttatactgatacgttcatccactaaataccgctgagcaaaaatcagactttctccatcaagttgcatgaatgtttgtaaaggctgcccaaacggttctttctcgtgtgcgtgactcaaagcttcatcctcagttaaggatggattattttcagcattttctgatcttaccgtatgtagcaaagaaacaattttcttatccaaatgttccacaaatatctcctcccatttcgttactgcatatcgacttcctgaaaggagataccactcgttcccctccgcaacagactttctgctaatgctaaatttactaatgtacaggtttcacgcaaaccttgaacttgcaataagggccttccctcggtgcgctctcgatctactaccaacttcatcaatgttcctccgggatgaaatgtacttagctcacctacacagttcactaaagggggctgaatcatccagtacaacttttgctgagaacgttccatatcccgaaacaaagccatacgactgaagaggctcggcgtatagacctgtaacaactcatgtacagaatcagataccatcatcctcgaacccatcagaatatcagggtaaaccgtgtaatcgtgacccttgaccttaaactgtgcagcataagaagagggccattccgtccaattattaatatttaccatctctgcattggcttcttcgtcccatacgggaacagcagaatacaacatccgatcatcatgttgacaaaggaaatactccactatgccacgtcccttccattgcgtctgtcccacatggtttcatccaaatgaagttagatcccgggcaactggatgcatccctaaactaaatcgggttccatccagcaccgcccctttgaaacaggccctttctatagctgcacctatgaagtcggctccctgcaatatagccccggtgaaatctgcattctgtaagtaagcgccctgaaatttggctcctgtaagatctgctcctgcaaaacttacgggttgaaaaccaggtctctcccatcgttcagattggtatattccaggtacagctactgcatctcgaaaagaagcttctcttaagttggctttttcaaaacgagcttcttgaatcaaacaatcgctaaaatcagcttctattaaacatgctttattccaacgggaaccaatcaaattccctttcgtaaaaacactatttataaaggaactttcattcaaatcggcatattgtagacgtattccctcataatttccttgagacccgtcgatcttgcggaaaacttcatgtatgtagtcatagggctttttttcctctagccagtctttaatcacattggaatctttgacacgcacatcccgtttaaaaacgacttcactttggtcccaatattccccgaccctcatctcaaacacatcttctaactgaatttcatgagcaaactggatttcatccagccacgcttctgtgatactaaaacgcgccagagcaatgatatattgatgaatatgtattgccgcgcgcaatttcatcctttcaatatcatctaatccgattcttccaccgtatttcttagcgtgcttacttaattccgtctcccactcgtgcaagtagtgaaatgcccaatctgcattataggtatctcgacaagtatggagatccataaaccatcttttatccatcgcctccactaaataggtcgcccttccgtttgctaattcggtacgaagcatggaataagatatatatcccaaggcctgtttattaccttcttgctgcatcaacttgactttctcaaatatctgttccagtgaattgcaaaatgccttagccaaggcatgcttatgattttggaaatagacttccaatgcgaataacattcgatgttttaggggttcatagatctcatttttaaaatgtcgaaaaacctcttcacgattcacgctctatctcctttctagtcgtcacatttacataggctgcacgtatcaagtagttggttatcttaaaccgaagtctaattttaatgatatgtgaaatcataattttcaagggtatatttaacagtaaatcatccttatgtatgtatcggacaaattagtgattttgtttacagaaagaaccataactgtgttcaatggaaaatgggtaggttcacaatcgaacccacccattcggagaaaataaatattatttaatgtataacaatgtataactattcataactccacacactcacaccgcaattaaaaaatttaaatcttgtaagccttcatagcttttcttaactctttgaatgaaggacgtttgccatacattaagacgcccgtacggtagatcttggcggccagccaaccgaacaacaaaatggaggcgaccagtataccaagtgacagccagatttccagcaggctcgcccgctccagaccaatccgcaacagcatgacagtcggcgagaaaaatgggatatacccggccacctttacgaaaatcgtatccggtgcggcgatattgaagataccgatataaaaggccgccagtgacagcacggtaatcggcatgatcgcctgtcccaactcctcggtacggctaacgatagagcccaccgcagcgaacaatactgcgtacagaaagtagccgaggatgtagaataccagaccatagcccaataccgcgatattcagttgcgacagatccagcccagctgagctaagaatgacattattatgcggcagcataaggttagcgcacacaacggctgcaaagacagcaatttgcagcaggccgaccaggaaaatgccgataatttttccgaacatctgggtcaacggtgagacgcttgtgatgagaatctccatgatacgtgagcttttttccgatgtcacctctgcagcaatcatattccccgtcatcatagaggaggtgaagaataaaatcatcagtacatagaccaaaccatagttaatcatagaggtctcttttttctctgtccccacggctccccctgcctcagacggaccgtctacttccctgctatccaccaatacaggtgtgctaatttcacgaatttgatcgctggtcaatgcattgccgcccataatggctttgaccttagcttcctgaagtcccgtctgcaacaatgtaattacagcaggagatggctctttttctacagagacgtactccactttaggaaacgcatctcccttggcggcaggctccgtgaactgcacgtaaccttgcagctccccgtttttcaaggcttgctgcatggccggcgtttgtacgctgtcataacgcacccagatggctgccgggttggattgctccttggtgaattgctccagctgattcgccacttctatccggctcccggcaatcagtcccaagcgatgatgctcggctgccgttgtgcccgaacctcctgccccatctcctttaaacaaagaaatcaaatacggcagattcataccgatcgtaatgagcaaggccagtaccagcgttgtaatgataaaagatttggttctcgccttctgacgaaacgtaaaaccgatcaccgtacccagtctattcatgggaatcccccacctctcttatgaaaatctcgttcagcgtaggttccttgatctcaaaatgctctacatccgtttgctccaacgccgtttgtaaaatcagcttcgccgcatccggctgctcaatatgcagcatccagccgcgatccataggctctgcacggcgcacgcccggcagctgctccagtccattcacttcacctgtagtaatgagacgaactttttcacgtgggtaacggcccttaatctcctgcacacttccctgcacaactgtatttgagcgatgcaagatcgtaatatggcggcacagttcctccacatgctccatgcggtgggtcgagaataaaatcgcagccccatcgtcccgcagctctttcaccgtatccttaagcaattcaacgttcactggatcaagcccactgaaggcctcatccaaaataagcagcgttgggcgatgcacaacagcggcaataaagcccattttctgctgattccccttggatagctcctcaatccgcttgtcgtagtattccggcactccaaagcgttccagccagtagcgtaggcttttgtccgcctccttggccgacatgccgcgcagcctgcccaaatagttaatttgctcgctcaccttcaccttggggtatagtccacgctcctcaggcaaatagcccatcgtccgctgaagctccttgctgtagggcttgccctcatattgaatgcttcctccatcagggtaaatcaggccgagcaccatgcgcatcgttgtcgttttgcctgctccattgcctcccagtaatccgtaaatctccccgccgttcacattcagcgaaattccgttcaccgccgtgtggttcccatattgctttacgacctctttcaatttcagcatgctcatgattactccgctccttttttctgcgtgtatatctccgcatcttctgataattgtccagcagaccaatgtattaaaatatcatccagctccaaacgccgcacacggatagggcgaatgcccgcttgttccaatatggcgctggtctctccggctgccaacgttacaattcgctgcaatccgccttcgctctccgtctctaccactcccggaagctccgatgcctcctctggcgtgccttcaaaccacatttctttgctattttcgagcaaatggtctttttccagcttgccgagcaacttgccatcatgcatcaggacaatataatccgccaaacgcttgatctcgtctataatatgagtagcaataatgaccgtcgttttgccgttctccatacaatcccgcagttcgtccagcatgattttccaggcaaaagggtctaaacccgatgaaggctcatccagcagcaacaaacgagggtgaggtgccaaggctgcagccagttcaaacttgcggcgctctcccttagacatgcgcgataatttcgtatgctgaggaacctgaaatcgctccatcagacgctgaaaacgtgtttcatcccagccgggataccacaaggctcgaaaagccgctgcggcttctgccgtgagttgatcttcctcacggcttggctgctctgacatatacccaacccattgtcgtgtatctgccggcatgccgtctggatacgcttgaccgaaccaacggatttcaccggaatccgggtggataagctgagtcagcagatgaatcaatgtacttttgcccgatccgttatgtccagccaaagcgactacatatcccggttcaatggttagattaatcggtccaatttcccggttacctcgggttttatagacttggctcatctcaataatgggtgtttttatctgtatccccataggaacttccacatgatgatttacttcgttcttcacgggcatcactccttcacttggacttcataccttctcttcaccatttctgcgaaaagcactaacaattcctgttctgtcatctgcacagcaatgcctgtgtcaatcgcggtttccaacgcctcggtcactgctttaaggcggtaacctgagcgcttatcgtcctcaaccagagctacgaaggtgcccgtcccctgccgggtacgaagcaagccctcgttctccaaatcctgatagacccgccggacggtgatgacgctgcagcggagcgtccctgcaaactcccgaatggagggaagcagcgttcccgctgcaatctgtccggttacgatgagtgaacgaagttgcttttcaatttgtgcatacagcggttccgcgctattctcatcaatttgcactggtatattcacctgcttctcccccctttttatctatctttgtacacatacccctaagttaagtcccgtttcataagcctacgctgtgtcaccttataggacacccacatacccagaactcctgccagcagcgctccccacatcaccggagacaacagctgccattccttgctataaaatgccgttaacgataccagattggctccacatactcgaactataatcgtaactatcccacaaatgagcatgatgacaatggatagccaaaagtaggattttcctcttttaagaaattccaaatgaatataaatggcttgaatcagcatgccgtagcctatccaggtaagtgcaaacgatacaaagaaacctgtactggcatatacccgaaacgtagctgacaacgtaaacaatagagtgaaaaatattacactgttcacaacaaacgccaaaagcgcctgttgaattcgactcataatcaccgcattcatcggtataggcaaggtgcggaaaaaggctagcatatgcgtataggaatcttcctgaagatatttaaaagcacggcggttataaatgaatccgagaaacggaatcaacaccagcatgataaaatcggctactggactcaagtttccaagttcaccccattgcacacttacagcaaaactcatagttaatcccaaatacgcaataaacagcaatgtccacagcatgacatatggattgttgcgaaaatcgtgccggttaatcttccatgcctgcttgatgattgtcattttcatatcctgatcccttctgcactgcctgtaatgacgacctcgttttctcttcatacgaagttattattacagtaatcagtgttattactgtatatatctttatacacagtatataaaccatgaattacaactgtcaacacctgaatgtaaattgtgcgtacaatcacaaaagctcgtcagaacctatgctactctgtaaatgataaacgttctcaatcaaggggatgaccaaatggataagatactgcactgggatgagccgatatttaaccttgttaaccgttaccccgaagtgaaggacattatggtagagctgggttttcacgatatcgccaagcctggcatgttacagaccgcaggccgttttatgacactgtccaaaggtattgcaatgaaaaaagtagctatggaaaccgtggaacgcacgtttttgcaacatggttttaccattcaaaaataaaggagctaacgatcatgagcgagttaattaacaaccgtgaacatacagcacaggaattaacggaacgccaacaaacgctaaaggaaattataaaagaattacatgccgggaaaagcgtggaggaagtcaaagcgcgtttcgcagaggctgttggcggagtaagcgtagcggaaatttcagctatggagcatgcattgatgaccgaggaggggattcccgtatcggaagtgcagcgtctttgttccgtgcatacatcgatattcaagggttccattgaggatattcaccgtccttcaggaccagaggaacaaccgggacatcctgttcataccttcaagctggaaaatcgggagatcgaacaattggtcaacttcaagttgtcattgcacgcggaccaatttcaaaaggacgacagccccaaaatcatctacaagttactggaagatttaagtctgctgcttgatctcgacaagcactatagccgcaaagaaaatctggtctttccttatctagaacgctatggaatttttggcccaaccaaagttatgtggggtgtggacgacagcattcgtgccgcgattaaggaggcaaagagtctgctcaccgaatataacggagatcgtgaacagattgggaaggcacttgcccatatcatgagcgaagtgaatgaaatgatattcaaggaagaaaatattttgctaccgatggcactcagtaagctgacagaggatgagtggctgaaaatagcccgggaaagcgaagaaatcgggttctgcttgaccgctcccgaacgtgaatggatacctgaacgggcagaggaaccggcagaagcccttgagcaaacggaaggcacatctggaacaccgcagggcttcgtgcgattcgagacggggattatatctgtacaacaattggaactactgttgaatcatctacccgttgacctgacttttattgatgaaaatgatgttgttcgctatttttcccatggtaaggaacgaatcttcgcgcgcacgaaagccgtcattggtcgtaccgtacagaattgccacccaccccaaagcgtgcatgtcgttgagaagctgctggaagattttaaggcaggtcgcaaggatgttgaagatttttggattccaatcaaggacaaatttgtctacatccgttattttgccatccgtgatgcagagggccgctatctgggaacgttggaatttacgcaaaatatcgcaccgattcgtgctttggaaggacaaaagcgtattctatccgaatagtatccaaccgtaagccaccatgttcagatttttgccacccatatttataatatgttgttctactataagtttggcccccagcctttcataaaaagtacatgctggattatctgctagcacccatacgattacagagtgaatatccatactattaaaatgttgaagcagacgtaaaaatagtctcttccccaagcctaaactatggtattcactcaaaacgtaaatagccgttatttctcccccatacggggggtattcacctgacttttctggacccccactcacaaatccgatgatttcccccttctcattttcagcaacatatacccgatgaccgtcttcactggatagattcgcattccacagttctgttctttgctcataggaaagctgttccagaacctgggcaggcattatatctttgtacgtcgtcttccagcaatctacgtgcaccttggcgatgccctcggcatctgatatcgttgcttccctgatgttcatgtaagttccactcctaatttccaatattatgcactctattatatcgacgatcccaatcttgatctataataaggatattcattgtttagtgaagttggataggataacccgttcactacactactcgtttactgggggattcgacttgaataaaattgtttcattttatgtgccgcttggcatttcgtcattaattgctgcactaacgcatgtcatcgtcaatgccgtgcttgctcgttcggaacatccttcgtttacattaagcagctatgcggtcgccgtcagcctgtgcctgctgttggaaactccgttaaccgctgtacggcagatgaccacgaaatttggttatgatcgcaagtccgttcattctatcggtattttatgtacgttcgtggctgtggctgtattgatcatcggctggtgcatcgggttgacgcctgtaggcaatctggtctttcaatatgtatttggtgtgtccccagtattgatcgaacccaccaagaacgtatttcaggttcttactttactatacatattggtagctgtccgtaacatatatcagggacttattattaacaagcaccgaacggcatggatgacattcagctcgtccatacgtattatcgtgatgctaattgcttcctggtttttgatccgtgccggctggacgaatgacggacgagtcggtgccgccatttttattgcaggtattctcatagagctggtcgttacttttttagaaggccgggttctcaaaagaaagctgcctcctgacaacggggagcaaaccatccatcacgcgaagcatctcctacctttttaccttcctttgctatattcggcgctggtgctggttatcctgaatccttccatccaagctgcgctgaacaatacaactgatccactgttggccgtggcatccttttctgtagcactgcaaatcctgaatctatttgtctggttttgcagctctttgcatcaaattgtgattcaattttatacgaccaagcgcagggaagtgctgatatttttaagctttttgtctatcctgtcgccaatgctactcctgttactctccttcggatttgctggtgatcctgtgttacggaatgtattgggattggaaggagaactgttgctagaaaccagaggactgcttcgcatactggctgtctatgttgcattttatccttgggtggaatattttataggacggtcgatattaatcggtaatactaaacctatctttattggtaggctgttttctgtgagctttgcgattctcgcgcttattctgtgtatctgcttttttccaggactggacggcaaagtggcgggaattgtaatggctgtttcctcgcctgttgagctggggatttatctgttgctttatcgtaaaatctctacaaccacgatgaatgtgtcatcctgaaaaaacttacctagagagccttatgctaacgacccgcacattgactccctatggcacaactctcttttacgaggtcaaaatataaggaccgttctttgtaatcgcaatcgtgtgctcgtattgagctccccaactgccgtctgctgtgctaatggtccagccatcgtccccccagagcaccgccccctcggttccgagggtaaataccggctcaatggttatcaccatcccttcgcgcagcggtaatcccgttttgggacgaccatagtgcagaacctctggcggctcatgcatttggcggccaatgccatgcccgatcagaggcttgacgttgccgaaccgccgccagcctgccgctttttccacagcatgcccgatatcccccaacgtcttccccgggcgggcaacctcgatcccgcgcatcagtgccttatgggtctgccgcaacagtcgtgctaccgggcggctaatgttacctaccgcataagtccatcctcggtcagccagccaaccgtccttgttaaccacaatgtcgatggtcacaatatccccatcatgaagcactcgctccgagggaaaaccgtgacataccacctcgttgaccgaagcgcaggtggcataagggaaacctttatagcccttttgttcaggcgtagctccgcgcttgcttaaaaactgctccacccaagcatcgatttcaagcgttgtgattcccggaaggatacgactttccaacgcacgatggcaatctgccaaaatacgtccggcctccctcatgtagccgatttcctccggtgttcgtattgctatctctattggaatccgcctcctttgagcatacaaattcactaaacctatcccattgtatgcaaggcggacacaaaaaaaccgtctcctctgtggatagacggtttataaaagtcgtatttctagtttttcgggtaatcgaaccctttaagatactgaagaatttatgcgaccgagttcgttttccaccaccatggtcaactcttcctcataccctcctgtaatccggtattttcgcacatattcctttacaaattttttgggatccttaggccggaaaattcgagtcatttcccgcagactttccttaacttcattgtgacctttcgttgccatgtaactccctcccaaaacgttgaaaataagtgctccgttgaagagaatgccgaaaagtattgatgtccttatgcagtgaagtagtatgtctaattgcagcttaggtcgggaacaccttatacaaggcatgtacctgacactattattaaccgattttcttttggctgaatcactaccccattataacatattcagatacagctttcagctttccagtaaatttacattgattttacctatcttttacgcatcatgtcatttggggtactcaatcagctgttgcacagggggtataccttatttatcggtttttggagtgtatgtgtttggggtaaaataaataaacataacaaggagggaaaaggatgagccgctttgctccgctgttcactgcacctgttgcccgtatgtctgccctgaacataggaacttgtgaagaggagggcgtcaatgtctccctacttgatcaggcagaccgagaaatccaagccaagtttcctaaaatgcacagcttcctgctactacgccacggcaaactgatctgggaacgctattataacgggcatgaagtaagctctctgaacgatttgcgatccgcgaccaaaagcttcacttccacgctcatcggcatagctatggctcgcggtgatatgcccgggccagagacggctgtgcataagctgttgcctgagtatttacctaggcggaaggaaacactgctagagcagattacgattcgccatctgttgaccatgacatccggcttgtattggcagacgggtaaaaagctcggagaagcttttatccaccgttttcatcgcagcaaaagctggccatcctttgctctacgcttacctgtacaggaggatcaactcggtgtattccaatatcgtagtgttgattcgcacctgttgtccgtgctgctgacccattgttgtgggattgacgcctatacgtacgctctccagcatctgttcgaacccttaggtttcgggagaagtggttgggcacaagatccagagggctacaccatgggacacatcgggctatatctgacatcgcgtgacatggctaaattcggcgattgctgccttcatcaaggcagctggaacggaaaagaattgattccggccgattggctgcatcaggcgacacagcgacaggttgaagggtatccagaattcggagattacggattccaatggtggacaggacgactccatggcatcaactacgcgtgtgcgcacggacatggaggacagcaaatttatcttgtgccagaagcgaacgcagtcgcagtatttacagcagatagcaaggtgagccgttggaaaaatccgcgaacactgctggagcgctacgttttgccagccgtatcctccctcaacttggaacgttcctgaaatgagctttaatgtgcttattgaatataggaggctaaacaacatggaagtctcagcaccaaaaattctaatattatacgccagttacggggaaggccatgtgcaggccgctcgggcgattatggacagtttgcgaagacttggacgctgcgaggtacaacttctcgatctgatggctgaatctcatccctggttgaacggtctgaccaaatttgtatatatgcaaagcttcaaaaccattcctcagctttacggctgggtctataatattacgcgcggtatgcaggcaaaatccgccttcggccatgtattgcattcattcggaatgcgtcaacttacgctcacactgaaaaaggagttgccggatctcgtgatacatacgttcccgcagctcgcgctcccggcgttacgccgcaaaatgggaatgaatttgcctattgtcaacgtggttacagatttcgatctgcatgggcgctggctacatcctgatattgaccgctactatgtagccactgaggatatccagcaagaagccgcccagcggggaatacccatcgatcgcattatcgctacggggattccgattcacgcttctttttataacatgtctgctaacgaaattcctgttcaggaacaggtaattccatcgcaacaggctgagactactacactactcataatggctggcgcctatggcgtgctatccggcatactggatatctgtcggcaattaagccagcttcctcagttgcggctactcatcgtctgcggacgtaaccagcaactgaaagcagaattggatgcgctgtatgcagacgacccggacatttacacctatggattcgtggactttgttccagcacttatgcgtgcgagcaatctggtgattacaaagcccggcggcattacactctcggaaagcattgcatccggtttgcctattcttgtgttcaagcccgtgcccggtcaggagctaaataatgctctgtatttgcagcaaaaaggagctgcccgtattgcgcgcactacggaggagctgattcagcattgtctcgacctgatttccatcccctctcttgccgaagagatgacgcaggcgattgagttgcttcgcaagcctcatcccgcagaccagattgccgaggatattttgcatcagcttgtggataaaagaccttccgtacggacaaattaacgaagaataagccagacggaggggataccaatggaacgcgaaggaaaggatttgctcccgctttcgggtgaaaaggtagaagtggatggtgtttatattgatgaggatggacatgaacagcatttgcacagaggtcagcattttccctctgatgttgttttgggtacttccgagtggaaaatgaccgaatacgcctttgataatcatcatgaaggacgtactgatgaacgacttatccccaaaaaggatgacaagaataaaatggggaaaatcacacatccgcgccgccatttaaaaactggcgaccgataattacggaagtatatccacagttactcccaatatgttgatagtttgtggacaatctgtgtgcaaagtgtgaggtatcgttatattatctacagtttgtgcacaaattgtgtataaatcatgttgtttttgtggataaatagtaatgtgcggtggataaagtgcgtacaacatgtgcaaaacctgtgtgtaaccatgtaaatggctgagcgaatctttttcgttcagcctttttcgtatttttatacacattctctaattcatttttttaccgagatcgggtatgttcgaacgagaatatcgctcccggaacgatgagttgcccaaaaaggactctatcccattaacggagactaatcgaaaattcgcaaatagcgcatagaggagtgtaaaatggaaacggggacgaacagagtcaaaagaggaattaccgaaatgtaaaaggcgtaatcatcatagaaattctcgcttcaggcgggcgaacatatgcaggaacgcagtatatagaagcatttagcaaaatcgttgaccaaaatttagaagtaggggtgatccgaatggcatctattaaaatcctttcacttaatgtcggcatgcccaaacagatccagtttaatcagaaggacgtttctacggggatattcaagtcggccacagatgaatatttgtatttatcttatctaaacttcgaaggggatgggcagggcgatctagttcatcacgggggtaaagagaaagctgtatgcgtatatccctacgagcactatccgttctgggaaaatgaattgcggagaccgctcgattacggcgcgttcggggaaaatttaacgataaagggtttgctagaatccgacgtttgcattggagacgtctttaagcttggcaaagctatcgttcaagttagccagccgagacagccttgctacaagttgtccatcaagtacggcgtaccggacatgcccttgaaggtacagcaaacaggctacacgggattctacttccgcgttctggaagagggagttgtctctaaagccgagggattatccctccttcatcgccatccgaaagcaattacggtttcatttgccaatcgaattatgcatcaagagaaggctcatatcgagggtattaaacaaattctcgaagtggaagaattgtccttaaactggagaaatacgtttctaaaacgtttggcgggaaccgaaacggattctcgggaaagactatcaggcaattcgtaaggtggaagtggttcaatgaatttgcaagctcgactggctgcagtcgaacatcgaatctgcgaagcttgtgggcgatgcgacagaagcgcagtccaaatgggaggcctttcaaccacggaacgtggcactttatcggtcatttgcaaaccaataaagtaaaaaaaggttatcgccaaattcgagtatatccattcgcttgaccgcttatcctttgtgtagagccaatttttttaccgagatcgggcatatccttcaatcctgccctcatagcttgtatagtacggagacttagcttgaatcttttataaaggaggatatgcctgacatgtcagtctataagtcttccacaggattggatgaaaatatagcagctgtcctgtgctatttgttcgcctttattggcgcgctggcctttgtcatgctggaaaagaaaagccgattcgtattatttcacgcactgcaatccatacttctttttgtagcccttatgatcggacatgtgctggtcggattcattccgctactcggtcctttcctcgcttccctgctaacgctggcaagccttgccttgtggattatcttgttaattcgtgcgggacaaggaaagtggctcaagcttccctggataggcgatctggctcttcatcaagcccggcagttatgaaaacagcaaaaaaccttgatcctaagcaaggaatcaaggtttttgctgttttaatgattactttttatcgcaaattcacttcttctgtcctatatgaatgtatcccaacttatctgggttgaccattaaataaaaactctgaatatgctccccgtccggtgtcagtctgagacataaggtttctctcacatttccgtcttccagaaatgccagctggacctcgccattgatgacggtgtggaacacatctctttctcgtaaaacggttaatacccgacgagaagtcaacagggcaagaacacctttgcgtacaaccatcggtctcatcaccgtatgcacattacctccgccatctgacacgaatacaggttgttcagccagtagttccagcatagcagtcacatcgtaggcaagaaaggcggttgtaaaacgttctagtagttttattcgggaagagttgttcacattgcgactggactgagcctcaagagcagattctcccgaagatagaatacgacgggagcgactgaacaactgacgacagttgctctcagtcttccctagcaattccgcaatatctttgtaatcatattgaaaagcttccctcagcacaaaaacagcccgctctatcggctttagctgctccagcaaaaccagaaaagcgtaagatatcatgtctttacgctctaaccaatccgcaggaagatctgcactttcacccaacggctccggcagccactgtcctacatatgtctctctttgcttgcgtgcagagttcaacagatttagacaccgattcatcgtcattttggctacataggctttgggattgtgtaaatcatccaggggcttattcttcagctcgacaaagcagtcttgaactacatcctcggcatctgtaaccgttccaagcatgcgataagcaatggaaaaagaatatttacgatatctttgatacagttcctccagatttaaatccaccgattgttgttcaattctatgttctttgccagacaaagcatagccccctgttcattaaagaatgcccggatacatccccgttgcaatcgcaatccggttccaactgttaatcacgttaaccgcggttatcaagtctacgtattcttcctctgtaaactgttctctgaccctattgtacaaatccgtaggtaccccttgttcagagatacgggtgaccgcttcagctaattcaagcataacacgttctttttccgtgaacaaaggaacctcccgccataaggctagctgcaaaatgtgatcagcataatcccccagcttgagcaaatccttcgcatgcatatccagacaataggaacatccattgatttgggatactctaattttcagtagttcatacaatactttgtctgtaaaacgaccggaaatatatttttccatctccatcattgccttgaacgtactaggactcactgcactgtaattaaatcttaaactcacgatacatcgcctccattattggtttacatatagaagacaaatgaacatgtgactttgtgacaaagtgtaatacatcaatttggaattgccctcaattggcatagcatgtattatagataaatgattttatgcaaagaaggtgagcactcacatgagcggaaaaggtattataaaagaatttaaagaattcgctgtacggggtaacgtgattgacctcgcggtcggtgttatcatcggtggagcgtttggcaagattgtcacttctgtggtaaacgatattatcatgcctccgattggtaaacttctgggcggcatgaattttccagatttgtatgtagctttacaaaatgccgatcctgtaaatgctgacggtacacgcatgactttggcacaggccaaagaaacagggattgcggtcctcgcctatgggcagttcattaacgtcctgctggacttcctgatcgtggccttctgtgtgttcatgctggtcaagggaattaacatgctgaaacgcaaagaggaagaaaaacctcctcaggaaaaaacgattaaggaatgtccacattgcctgtccgaaattcctgtagccgcaacccgttgcgcacattgcacttccaagctggaagggtacgtcgaagcacgctgactcaacccacacctatatgactacaacaaacggcttaagacggtataccgtcttaagccgttttggtatggtgtaggagatctgattagttgaaattggtgataatgccacggggtctgacgggcaagccctctgcgtacagatgggaaacatcaccgaagccgatgcaacggggaactgcccattcctgagagcgctcatcaaacaagatcgtggttacagagctaggcggcatccaaaaaccggaccagaccaaggccaatggcagctccaacagatgagcaagccaggtcagcccgaagccgccatgacaaaatacggccacctgatcttcggtgtgcttcagaatacggtacctgccctccacccgctcaaagccttgccgttgcaggaattcatcagaatgaagcttcagctgttcgaaggcttcgggactcttcgttccctgataataggaaatctcctgccaagagtcatgagtcggcaggggcaactcggaacggatcacttcaccaggcaaatcccaatgggaaagacggccgtatggagtttcctccagctttagggccagctcctgcgtccagtgttccacttcatgagtcatacccaaagactcggcagtgtagcgcatcgtatccaaagcccgccccaaaggagaggcataaattcgatccagcccgtgactggaaagccgtttggccagtgcctgggcttccaaatgcccctccggcgtgatggtgttgttggggtaatcggggtctgcgtgtcggataatatacaatctcatcattggttctccgttcctatgaatggcgacaggatcgctttatctcattccgtcgattagttctcctgatctttaacgtttattcagcaaattttccaaaatcgcgcgcaaatccctgtcttcctggtagacttcctcacccgtatccagctcaataacccggatatatgtataattggctctgacatcgactggtttaaaaatcaattcctccggattgtctgggcggacatcatagcccatatttttgaacatatccgtgatttgatcaatccccggcttgcccccactttccagcataattaacccgcgaagttccttgggttcctccggatgcatgactcgaaaatgtactatacattccatgtaaaatcgctcctttcaatcgtaaatctgtgtgatgttgcaaatcctcatgttcccagcataccccaaatgccactccacattccacacccgccttcatatcgtcaggaaggaaaacacgttatactgtaaagtagactttgatttctgcttactataggaggaaccacgatgactagcgagcttctggatatctacgatgatgaagacaaccccctcggcacagcttcccgacaagacgcacatgccaagggatactggcaccatacctttcactgctggctagcacgagacacttcgataggccgtcgcttactgtttcaacagcgtcaggatacgaaggacaccttccccggatgctacgatattacagcagccggtcacttgacggcaggcgaagatatgtctcaggcggctcgtgagctggaggaagaactgggcatttatgtgccctttgcctcattaacaccgctgatgaccgttcggtatgaaagcaaaggtaccgcacagggtacctctttttgggaccgggaggttagctcggtgtttggactgctatcgaaccagccattggaagcttatcacctccagcaagaagaggtagccggactgtacgaagcagatcttaaccaagcactggccctttttgaaggccatattccctttatcgaagcccaaggcattacgtcggggccgaatccagaaaaaactcgccgcctgattacatcggatcaattcgtacctcataaggcgggctatattacatctatatgccgggcactgatggaacttcctagccggtaatctttagctattctccagctgacatatatttgccgataatgccttcataccgccagccataccgggtcgacagctctctgcccatatcatgctccagctcatacagaataagatcctgagcaaaatgattaagcagcagacctgtcattaccggatgctcggtaataagcgcctgtgtcggacaattctctccccgcatacccagcatgcaccaacgccgatcaataacaaaagaaaacttgcgccctgctggttcctgtccgtctgtaccagacctaagcggtaaccacggtcccatcatgctttctccgttatcgcaggaccagagcagacgcacacctcgactctcggctttctccaactctgtccgcaacagttcggcttcctcgcgccacaaatccaacacaatctcatgctctgcccgttccaattcacgtgtcagactttccagtaccttccggtcgccttccgcattataaaaggtcggcttggttggttctgttcgtggcatttccttctccaccgcacgcagggactcttgcatttgtccttcgatcatccgggtcaattcacccggtggcagcatgctgtaacgaacaggctctccagcactggttctgaggtatccctgcccggccaaacgctgtaaagccgcgtacacgttggagcgcgatgcgcccagacgcttagccacttcatagccggaagccgcattttgcctcgaaagctcgaccataaccttggcttccatttccgtaaaacccagattccgcagatgatgcagcaaacgctccatatattctgttccccctatgctgcccggcgttatgtctgtgtcctgcagcagcctgttcggctgcgtcaaatctgttcagctccgcagcgcgggcaccacttggaccctttgggtagttctgcagtacagatttggcattttacattttcacgtacttgtgcagacggcattgctggcttctcggccccggagttgttggccttccaatatcgaatccgctcgtccagctcctcctgacgctcccgctcgcgttccagttcttcaaggcgacggtgttctttctccagctcttcctgacggcggcgctcccactcctcgtcgaatgccgctttttcttctggtgtaaaatcagccactgtgtaattgcggtctaatcccgctggttcgtgcgtttcatatggttcatcctgctcctgttcatgccgatccactacttcatgttctgcatactccgtgtaaacaggagcggactccttcgcttcctctggcttgcgcagatcaaaagaataggcgttcgttggcacctcttcacgcacagcagccacctgcttggaggcagcctgcccttcattcagcttgcgtccgcatttggggcaaaagttggcatccagtggcacaactgctccacaggtgcataaatgagcattttttaattctgcaattctactgcgtagctcgtcaatttcatcctgaagctcatcacatgcggtggatagctgtgtcatctcggtttctgccaccgacatgtcggatgcgcggtaaccttcgtaaaagatctgacccattcgcaagaaatgaacatccatttcctgctgaatcgttgtaatttgtgaattgatcttactaatctcgacagcatgctgcgccttttctgttgcgcgattagcgccttcctttatacgttgaatcagcttcatcgttatttcctccccatatccagccggatttcactgtaccgtccgtatatcccaaagtttttttctgttggcaaacctcgaactcctgtataatggaatgcggtcatatcgcctgtttgaaggctataggcattagcgtcaacgtattaacgttctgtcgctccggcaagatccgcatgaatttcagcattattttagtccatcgccttgttcttatcgtcagctaaagctgactagaactctatcataccaaaaactacccccatttgtgaaaatggaagattttaagaacgaaaggggtttcaggattatggacccaaatccttctttttacccccgacccatcggggttccttactcaacgtcgagccctcaggcacgtcgtgcttccatggataccagtatgacgctggtgcctgacaccgaccaagactcggcctattttcgtgctttagagaacgccggcattcacctgaaccgcccgcagatccaggccgttcgacacggcaaaggcccccttctgacccttgcaggggcgggctgcggcaaaaccacagtgctggctgcccgcgcaggctacctcatggcgatgcgggatgtccctgcatcgtccattctgctggtgaccttcaccagcaaggcagctgccgaaatgaaactgcgcatcgcgggattacccggtgtgcgccctgccgctgcacgtgcagttcaggcacgcacgtttcactcattcgctttggcgatgctgcgtcatcgcggcgtgcaagatgaagtgttcggtgaaacgcaggcccagcataccgtcatgaaaatgatgctgcgtcagcttgggctcagcgaggctttccagccggaaagcctgctgtctgccctctccgcctggaaagcggaaggccgcagcgcggacgagctgccggaaaccgtacgcgaggaatcggatgccaaacgtgccatgctcgcttatgaagcgtggaaacaggaacgcaataaaatggattttgacgatattctgctgcgtgcctccgcactgctgcgtgacccggatgtgcttcagccgcttcagcgacgtttttcacatatcatggtcgatgaatttcaggatacgaatgccttgcaatatgagatggtgcagcgattggctgctcgacatcgcaatctgatggtcgtcggagatgatgatcagacgatctatacctttaatggggcacgccaggaatccattctggaatttgacaaagtctataaggatgcaaaggtcattaccctggatattaattatcgcagcgatgcgcggattttggggctgggctctaacattgtcgccaaaaatgttcatcgacgctccaaacgtctttcggctgccgggcgtgaaggcttgccgccgcagtttgccaccccatccggacccgaggaggaagcggggcatattgttactcatctactcgggcaggtagaggaaggtcggctgcgctaccgggatatcgctatcttgcaccggacagccagcggaagccgctctatttttgaacaattaattatgcgggatgtcccatttattcagtacggagcaggggctgtattttatgatcagtccctgattcgtcccttaatggatcacctgcgcttgtcgctaaatccccggcgtatggaatccattccgagcaccctcgggccgctgtacgtatcccgtgaggcggggatggaatggattatgcgcgaggagaagcagcaggctaaaaaatacccgctgattcatctcagccgctgggatcgactacgtgattttcagcgtgagcaggtgaaagagcgtattcgtctgattcgcagtctcactacaatgaaacctgcctatgccattcaagaaatgcggcgcgtcttttatgacaaatatttggaaagcggagatacgggcgcgtggactcattataaggaaacgatgcaagaaagtctggaggagctcgaaacggcagccaagcggttcgacacggtggaggcgttcgtcagctttgcggacgagctttccgagcgtcaccgccaaatggaatcgctgcgcagagaagaagacagcgatgctgttcggctcatgacgattcaccgcgccaaggggctggaattcccttgtgtctattggatcggggccagcgaaggcattctgccgcacagctcggcgctgcacagcgagctgccggaggatcggcgggcaggcgccgccccgactacggctgtggataacgatgcagcgcttgaagaagagcgccgcctcgcttacgtggccgtcacccgggcgaaggagttgttgtacatcacctctcccgcctctaatcatggcaagcctgccgccgtgtcacgcttcctgctggaagcctatggggtcacccctgaggcttccaaaccggaagcacgccgcagcagcttcggccaaccgaagggtgcttccgggtatagcaaccgtgctggcgctggatcgccagcgtctagcacagcgacccgcgtgagcagcaggccgggaccaggaagcgctacggtacggccgacctcatcggtggcagggtctccggcggaaccacgcatcaacgtgcctgtgtggaaatgcaccgacggtgcctgcaaagcgtggatgcgtcgcgacacaacaagcggacgccgtacaagcgcggccagcacaggcacgccgccggtgtgcccgctctgcgcctccccgatgacagaggggacacgcagcatcccagccagataggcataaggcgcatagctggtatggagaattgttcttttgctggactggtgacactcgtgatttccagcctaactgttgcagattattaatgaatcaaaaaagttaagttgtagacagaccaataaaagaaaaggcggcagactaggatatgaaaataaaatcctcgtctgccgctatctgttttcacttgctatcgaacgatcgtatcccgttagttcaatgccttgcctgttgtgaagttatatattttaaacattaaacaagcgctctatcacccaataggtgttccgtcaggtagtttgatatctggttttaatagaaccacatcccccttttcgggaattcctccaaggaccaatacctctgacttaaagcctgctatccgtcgaggtggaaagttgactacacctatgatttgttcccctataatatcttcagccacatatctttttgtaatttgtgcactcgaagcttttattccgatatcttgtccaaaatcaatttcaagtttaatagcaggtacttttgcttctgcaaaaaactcagctttaattatggttccaactcgaatatctagtttcaaaaaatcatcaatcgttgccatctaaacattctcctcatcgattgttttcttcaatttcgcgataatgaatttcaaatttaatattttgcaaccgtagtatactttaaagattttgcccaaaaatacatccccataccgaataaagtcatgattccacctatgaattgaaatgcagagattatttctcccaagaataagtaagcgagaattatggcaagaacaggctctccaataataccaactgagaccgtagttgcacccattgatttcaacaacagattaaaaatatattgtccaaaaatagttgggattactgcaagtaacaagaaatacatccaatccgacgagccatattcgatcaaggcataatgattcaacaaattgtagaccagcatgacactgccaccaataaaaaaaacaataacactatatacatttgcatttattttgtgacttactttctgtcctgccaacatatatgttgaaaccaaaattgttcctactaaagataatccatctccgattaatgcctctctcgaaatcccaatgtctccccaagctataatgattgaaccgacaagagcggcgatcaaacaaagaatggttaatatatttgctcgttctctgaacataatgtatgaacccatcattacaaataaaggctgcaaggataagatgaccatggagctcgcaactgaggtatatactaaagattccatccagaataagaaatgcaacccgagaaaaagaccagctatgaaaacagtactccaatcttttttgttcatttctaaggaacggaacattttccaaggtacaaaaggaagcactatgagtactgacatatacaatctgtacatcccagccacagaggttggagtatctgaggattttatcatgatggatgagatagaaacagacagtatgctgattaaaagcaaaatatacggatgaaacggtaacgacgattgatttattttcacatgtacgcctccaagatgtcttatccaatcgcctgtgcacaggattgtaatgataagccgaagatctggtataataatatcatcacttttgttttatttgtgtaactatatctttaatttatatagaaatatcgtcatcagaaaggacctctctaaaatggaaaaacaattgcatgagaccattctatatcctgatatttcatttccatacatcatgtacacccatactattcatgcaagtaatcctcaaggtagaggattcaacgatttacattggcatgaggaactacaaatcactttggttaccaaaggaaagctagtgatacaagttaacgggattgatcatgaattagaaacgggtcaggccattttaattaataagggtgtccttcacgttactacacaccttacacataacggtcaatatgtcagttttaatttccctgagaagctgctggccttttatgcagatagtgcgatggaaaaaaattatgtacttccttatacaaactctctcttattgtcattcgtaatcaaaggagatgttgaatggcaaattcaaatactgcaaatgctttgggatatgaaacagaaatttgatatgaaaaaaaaatggggctgggaatacgaggtttccatcaaaacggcacaattatggttagtcttaatatctaatatttctctgtcttctgaggaagcacctaaatacatgaaactgcaacaggaaagacttcaattgatgctcagctttatccatcaaaactattcagacaatataacactgcaagaaattgctgaagtagcacatttaagtatttcggaatgcactcgtagttttaagagaaccattcatatgacaccttacgactacttaattaagtaccgtatcaagaaaagcagcgagttattaatttcaacagattctacaataactgaaatagcccacagagtggggttcaatcatgtaaatcacttcattcagtcttttaagaaacatcataaaaaaacacctaaagaattccggaaatttagaaatgaattcatcaattaaggaagaattcgttcagcaaatttcgcccagacaaattcagaagatatgaagtttgtttaccatcggagttaaaaatccataatttaaggatgattttttccgaaattcatagtatggttcctgcctcgcctctaatttatgatgaaattaaagcgaggtgatgaactaaaaaatttaaaaggaaatattgaaaacgcatacaaataaagatgcgattatggaagcagttgtttattatttaatttttttatttttgaaaacggtttcttaaatctgcgccgcaggacaattagggtggtaacatctaattcaaggagtgagtcatatgccagatccgtggaaaagaagattcttccgtattcttagttttgttctcttatcttttttgttggtatctctcgatttaattccaagcttagcaaaagcagaatcaactaacttggtcacccatgttgaagacaaaacgacgatgggtgcaagtgaagatttatccactaatggcaaatctccttctacagttgtcagctccaaagatgcaattattcaaggttacggcgtagaaaaacgggatactccctatacaggcgatacactttataaaggcgacggctatgtatccttcttttatgattatgacccaaattcgggcaagtctgacgggacggctacgtttaaagtgaatgtgccgacagcaggtctatataagctgagcctcggttactatattccggcggacaccggctccaaggataccagcttcgaggtcaatggtacaatggctgagagcataacgctggttccccctccgggaggtgcggttgtaaacgagaagttggtaagcaagatcatgttgaatgccggtacaaacgaggttactttttcaagaggctggggatattacgggatcgaatacgtgaaggttgaattcgccagtttgcctgctacaaacagcaaaattgaagccgaagacggagtcattactggtgaggtcagcaccgaaaccgccagcacgggctattctggtaccggttacgcagcctttaaaggcacagggtcgttaacccttgcctataacgcagcttcaagtggcttttacaatattgcaatcggttacagtaatccaaatagttacaaaaagacccatatggtggtcaacggtcagacaagcgaaatatcccttccgacaacagcaagctattccgaggtatccggcggtaaaatcatgttgaattcgggaaacaatacaatacagttcaatgtcgacttgggccagtatcatatcgactacatcaagctggcagcagtgctccccccgaaactgcatcagattgagaaaaagccggtaaacccgaatgcgactgcggaaaccaaggcactcatgagttatctcgtggatgtttacgggaacaaaattctttccggtcagcacactctggaggatgcccagtggattaaagaccaaactggaaagtatcctgcgatgttgtcaacggacatgatggattactccccctctcgcgtcgagcatggtgccacctcaactgaggtggacaaggcgatccaatgggccaaagaaggtggaattgtcacgtttgtatggcactggaatgcctctaagggactgcatgacattccaggcaaagaatggtatcgcggattttacaccgaggcgactacattcgacgttcaatatgcgcttaatcatcccgagtcggaagaatatcagctaatcctgcgggacattgatgccattgccgctcagttgaaacgcttccaagacgctcacgttccggtgctgtggagaccactgcacgaggcggaaggcaaatggttttggtggggcgcccaagggccagactccgccaagcagctgtaccgtatcatgtacgaccgtctaacacactaccatcacctgaacaatctgatctgggtatggaactccgagagccccgaatggtatccgggggacgatgtcgtcgatattgtaagtgtggatatctacaacccggcggctaattatcacccaagtatcggcaagtacgacagcttggtaaatctcgtgcaaggcaagaagctggttggtctgtccgaaaacggcccgattggcgatcccgaattgcttcaagcatattcagcgcattggctctttttcaccacatggacgggcgatttcgtccgcaacggacaatataactccctggatcatctcataaaagtgttcaacagcgattacgtgatcacgagggatgagcttcctcaagacctatttacttcctccaagaatgaagcggagtaaggcgctcttacggggctcaccgtaccacggaaggtagcagatacttcggacgatgggtatgtggctggattctgataacaacgtcgacaaattggtaattactttgaacgtgcctgtaattttaccgtcccacccagcaccatgaagtaacgcataagcctgcccctaacgaacagcggccacctcagaaaataaccgaggcggccgctattggtttgtaacttcaatgaatgcagtctatagcaaaccttaatgaaaaaggaccgtctcctctccaattggaaagtggaaacggacccgttctttatgcaaaacgaattaattggtggaccatagcttaatccggttttgaatatgtttggtaaaggattgttccatttcttgtactccggctttctccagctctgccatataggcatcccaaaccttatcgaagttctccggcttggtcatgacagcctccggaattcgtttccatgtaatatccttcatcttggctccgagaataacagccggatcgtcattggggagagacatcgtgtaggctgctccgtatgctctcggttggaattcttcttcttttgggaatagatctttccaatgatcaatcttataggcctttaggacttccttctccgacttgttataagttgctgtcagcatctccggataactacgagtaaagtagttgccggtggagtccttgatgccatcaccataatggaccgacaagttccaatatagaccgattccagattctttttggaaagctgcattgtcattgttcatccgttccagcacagccggaataatcgtccgtttgccgtctttaaccgtgtaatgctttccttcaatcccccaattattcaggatttgcccatcttccgatgccagaaagtcgaggaactggatagcgcgtaccgggtccttgcacttgctagagatcgagattccatatcccccatcaaagccaggaagccaaaagttggtgtccttatattccttgctcatggtgactggataatgaccgtatgtttggtcgaatttgccctccgcttttagcgcattttgcccgtcgccatagtcccattctggatcggcaaggccaagtacgcggcctgaagccaccttcgccttaaactgatcggtcttctgcacgaagctttccggatcaagcaatccaatggagttcatgtgattcaaccagcggaaatattccttttcttccggtcggcggaaatgataagtcgcttggtgtgttttttgatcaatgtagtattcgccgtcgtctggtcccccggtcgtttggaatcctgagtttgttacctggtacatatgccaatcgtcggcattaagggacaatccgatatttttattgccattttcgtccgtcggatgcttggtgatatagtccttaatgactttttcaaaatcctgtaccgtacgaatgtccgggtatcccgcttccttgacgacacgatgctggagtttaaatcctacgtcgggtttaatttttttctcctcgacagcggaccaggtcggaatcacatagatcgatgggtcgtccaaactgtactttgtccgaacaagcttgtcacccagcatttttttgatgttcggtgcgtgcttgtcgatcaaatccgtcaaatcaatgattgcgccagcatcgacaagtttgccgacatccgccttagcagcgatcaaatcaggatagtttcctgtggctgcaatcaacgaaatcttttggaccgggtctccgacagcgaattcagcatctagagttgctccggttttttcagcgatgaccttaccgacttcatccttcatgctattccaatttgtgctggagtcttccgaaaaataagtaagtgtgatgtctcctgttgttacggccttggtagcctcagacggattattaccgctgcaccctgcaagggtcgcgactaaagtcagtgacattacgaaagatacgaccattctattttttctcgacttcatggagcgaaacctcccattataatgaatgtttgcttcgtttagctctttaccgctccgagcgtcatacccttaacaaaatatttttgtaaaaaaggatagacgataagaatcggcactgtaacaatgatggtgattgccattttgacggattccggtgaaacctgtgccatacgctcggccatattggcagcgtcctgggaattggttgcgcttgttgtcgtactttgcagaattttcatcaattcatattgcagggtcgtcaacgattcgttggacccattaaacaggtaagtatcgaaccaagagttccattgcccaactgccaagaagagcgctacggtcgctaatgccggtttgcaaagaggaagaataacgcgccagtagatcgtgaaatcgttggcaccatccagcttggctgattcctgtaacgcataaggcagaccatcaatgaaggaacgaataatgaagacattaaacgcacttacaagacctggcaaaatatagacggcaaatgtatcaattaaatgcaattccttcatcaggataaaacctggaatcaaccctccagaaacatacatggtgacggccagaaagatggagatgaaccttctagcttgaaaatcacttcgtgcaagcgtataggcaagcatcgagccgctgaccaagcccgctacggtgccaatgacggttcgcagaaaggagatcttgaatccagtgattaacccctcataggtgaaaatcaagtcgtaattcttcaacgtaaattgccttggccagatggtgatcccacctctaatggtgtctaccgaatcgttaaaagagatagctagcacatttaagaacgggtagatcgtcagaacggtgaccacaatcatgaaaacataaacaactatccccaggattcggtcttgtggtgatttcgcctgaagcttgttgtttaatccgccgaccggcgtagtgcttttgacagcctccatgtccattctcctccttacataatgctctcgttagtatagcgcttaaagattccattagccgcaaacaataggatcaggcttatcaccgaattaaaaatattaatggccgttccgaaagagtaacgtcccatcgccagaccataattaagcgcatacaaatcaagtacttcagagtaatcaatgaccaggtgattgcccagcagaaattgtttctcgaatcctgtaccgagcagatgaccaatagacataatcaggagaatgataatagtcggccggatccccggcagcgtgatatgccacatttgctgtaatcggctagcgccgtccacccgcgcagcctcgtataattcaggaccaataccggcgatggcagccagataaataatggcgttccaccccgtttccttccagatgtctccgaaagttacaacccaccaaaataatttaccttgggccataaactggactggctgatcgatgatgcctagacccatgagcatatcgtttacgacaccgccatccgctgaaagcattttggtgacaatgcctgcagcaaccacccatgaaacaaagtgcggcagataagatacggtctgaacaaatcgttttaccacttgtatgcggacctcgttgagcaatagagcaaagacaacgggtacaataaagccagcgaccagtcccataaggctcatagccagcgtgttccgcaatacttggtagaaatgatcatcttggaacaatgtacgaaaatgctccaagcccacccacttctgttcaaaaaaactcaaaccaggtctgtatttctgaaatgccattgtccagccccatagcggcaaatactgaaagatgaagacccagataacaaacggaatggacatatagtaaagatacctctggcttttaaataccttccaagcattccgcttcggttttttgtatacgttttccgaatttgctgttaccgctttcatttttttcatcccctctcttaaaaccaatcataaaacagaggagagtcagaacccatacaacggatttcggaaaaaatcatccacaaattatggatttctatattccgacggtgaacggccttcgtatcttttgaatttgctgtaaaagtagttgacgcttgtatagccgacgctttcggcgacttcgtatactttcattccctgacccagcagctccttggccttttgaatacggactcggtccagataggtattaaagtactcccccgtcttgttcttgaaaagctgacccaaataggcggtactatagtttagtagtccggctaacgcttccagcctcaggttgtctgcataatgcttgtgaatgaagtcgatcatttttttgaattccagctcctttccacggtgttcagagtcttgcgccaatgttagcaggaaacggtgggtctcttccaaaagatcatatagatgatcatgctggtatatcccatttaaaaaacgggaaacttcctccgtctctttcaactcgatacagaaacccgcggtcagcttatgaatgattgcattggacagaaaaaagaaggactctttgatcgacttctcatcttgcccctgtttgagtaaaaatgcagccgcctcgttcaataatggcagtattgcggtttggtttcctacttccagactgtaatacaggcggaagatgaattcctccatcgtttcctcagctttatcagcagacaatcggggagaatccagcgaagaagaaaagaaaggatacggacctagcagtcggttcttctcgctgaaaaaggattgttttaccgcttcctgggcctttaaaaaagatttacaaatatcttcaggagcagatactacccctccggttgcagcggcgaaccggacattatccgcaacattacgaatctcattgtgcagaatttcacgccgttctcttccgcgcagcggcgcgttgagcaacaggactgtatacggggggattactgtgacaagtcccatcatctgcccctctatctttgccttcaatccattcgaaagctggtatgcaacatcagaacggtccacttcagaaacacgcgggtagacgaccacgacttcgtagttgctccacaacaaatctgcttcttttgccttacttctcaacttggccggatcttcagttctctcttgagggacgagcaggctatgcaggtataaatcccgatttataacctctctcttacgccactccctttgaagacgctcctcttcgatccgctcgcgtatccgttttaaactggacgacatttcatcaatgtcgaccggtttaacgagatagccgaacaccccgtatttgatcgcttgtttggcatactcgaagtcggcatatccactgaggatcataaagtgcaaatgatgaccgctggatctcaagtgctcaatcaactgtaaaccatccataaccggcatgcggatatcgacgattacaacatcaggagctttttcctcgatgactcccagtgcttcctttccattggctgccgtagctgtaacgataaatccgaggctttcccatgggatcagcgtttgaagcccttgacgaagcttcggctcatcgtcaacgatgactaccttaatcatttggattcacccccaggtataaaaaactgaatacaagtgcctttcccaggctcgctctcaatatgtaaagcactagaggtcccatacagtaagacgagacgatcatttacgtttcgtagtccaattcgctggacctcctgttcatgtacggatgcagcaagctctgcttgtactagggcgagacgatcggccgtgaaaccagcgccgttgtcacataccataactcgaaccccctccgggatttccttaactttcacttcaatgacagctccttctgcttgattatccagaccgtgtacaatagaattttccaccaatggttggataatcagaggtggaaccaacatttcctccaaatttggatcaacggttaagcgatactccaaacggtcttcataccgaaacttttgaagatcgagataacagcacacttgttcaagctctttacgcagtggaatcttgtcgttaccagcctccagactgctgcgcaacaacgcgctcaactgccagactgctttagcgatatcgtcctgttggcgaatgtgggcctccattctgatagactccaaagaattgaagagaaaatgcggattgatctggcttgccagcattttgaacttgatctcgttttgtctttgctccacgagtcttttctggcgattcgtctcttggacctcctggaccaaatggtttacgctgctgacgagcgcgttaaattccctcgataatagacccacttcatctttcccatcaatatggagataggtttcccatgagcctgcccctacttgggtcatatgcttgctcaagcgaagaagccttctggataatagcgaagcagaagcatagataagcaaggctgcaaatatcaggctggctgtgatcgcgattccgccgagccatatcacttgattagcatctcgggtaatctcagaaacggaaaaaatggaaataatgcgaagtccattccagctattctgtggagctagattagctataaccaccttcgacgcttttccatcgatgagcatgttgtaacttccttcctgatggaaaagtatattttcgtcggcatgaatttcagaaagattcttcccgaacaactctgcttcattggacgcgacaatctgattccggttatccacgatcaaggtagggaacgattcctgattcaggattgaatttaattggcgctggttaacatttatgaccagaaccccttttcgtcctggtgaatccactgaaaatgatcgaatcaggctgagataatcggcatcgtccctctcatccttgattaaattccagccggccaatcctttctgcgcgatggcctccttgtaccaatctgcggttgtgatcctatcatccggttggataaattcccaattattaagtgctccaggattagagacatagacacggatgccggatatctctttgtacaactggaggtagtcacgaatacctgtatactcccggtatgcctgaatgacttcgatatagctgtcatacttctggctggctaccattttcatccgattgtcattggtcagccggtacgagatgtccagcggcactttgatcaattcttctgtacgattttggacccgctcaacattgttggacacttgcataaaggcgtctttaatgacggcctctcgaagcttccccgtcagaaacaggccacacaacagcaagggaagaacagctaccgaaatgaatgtaaacgtcatcttctttctcagtttcatgtcattcatcattcgtataaaaaacatgacttgcccctccccaatcagtacgctgatgcgcgcaaaatgccccttttcatataaaaaggggcataactccatcgattgtttttctctttcggcaattatactgttgtactgatccttaagccttaccaggctttattgcccgaagcctgaaccatccactttcatagtctttctgtctgtagagaagagggaggcccaacttcataagccgatcccccccatggatagacttttgcccgctatttcctgacttaacttcatattcgagctctggatttagtccgtcaaggcgcagggctcgccaaggcgcgttcgggacagccatcacttggaaatagtagacgatggcatcctcttggtcttcagaaacaaacatccaagccgattcgttatcttcaaacgggctctttaagcgatacaagtcacctttctgtactaagccacgtatctgcttgtatactgcgatttggcgtttgaccgtctctttttcctcatcggtaaatttcgtgagatcaagctcatatccaaaatttcctgacatggccacatcacctcgaaaatcaaggggtgttatgcgtccaacttgatggttcggaactgccgacacatgcgctccgatggcgcttacaggatagacaaggctagttccatattgaatcttcagacgttccaccgcatcggtattatcactagtccatacttgaggcatgtagtaaagcatgcctgggtcaaaacgtcctccgccacttgaacagctctcgaaaagaatatgcggaaattcggtggtgacgcgctccagcagctcatacaatccaagaacatagcgatgggcagtctcagattggcgctctggcggcagagctgcggaaccgatttccgtcaggcagcgattcatatcccatttcacgtaagaaactggggcgctggagaaaatggcagccagcgaatcgtagatgtaatcgcgtacttccttgcgagtatagtccagcaccaactgccatctggcttcactgcgtcgccgtcctggaacgtgaaggcaccaatctggatgctcccggtacaactcgctgtctggagagatcatctccggctcaaaccagagtccgaatttaagccccaattgattgatgcgtttcgcgacatcggcaagtccgtctggcagcttccgacgatcctcgtaccaatcgccgagagacgaattgtcagaatcccgttttccgaaccaaccgtcatctaagacaaaaagttcgatgcctagctctgccccctccttcgctatcgataccagcttatctgcattgaagtcaaaataggtagcttcccagttattgaccagaatagggcgttcttcatcccgatatttccctcggcaaagacgagtccgatacaagcgatgatatgtacgcgacatttctcccagcccttgaccagagtaaaccataacggcttctggcgtttggaagctctcacctgggctcagtaaccacgaaaaatcaaaggagttcacgccgatgctaaaccgtgtagagccgaatgaatctatttctgctcccgcctcaaagcccccgctgtacacgaggctaaagccgaatacctcaccatagctttccgttgttccccgagtgaccaatgcagcaaaaggattgagttgatggctgctcatgccccttttactatcaattcgggtttcaccttgaagaatcggtttgcgggtaatattcccctcccgagcccatgctcccgaaagatacatgaactctagatcgcttttacctgaaaaatcgacactggcacttagagcacgaagaagccgaaggttcttggctcccgcattactcaaacgagccgaacgagcgattacgtttcgatccgtgaagacggtataaagaagaacaactttaaggcctgaaaagtcatcttgtaactccagttccagcgtatccgcttcgtcttcattttcggtatatacggccggaagcccggttaatgatggctttcccttagtgatccggtagccaatatactttaactccgtgatacgagttccatcctcaagctctacttgatacgccgggttacggaagtccccgctcccatactgcggatattcttgcggtagccgatccaatccagccgtcgcgggagtgtgaagcaataggtcagccatgggttcgcggtgcttcaacctgtctccccagtatacatggacaggaaatccatccacaatctgaataatataactcatgcccgacgactgtaaatgaaacagccctgtttgctcttgaacaatgatacccattgggaaaataacccctctcttagataataatcatcggagttccacaccaaaaagacactcagaagaagcattttgtaacagccatcaactatgttcatatggtgtaaagcttgataagattcaacaatatagcagtaggttctacagaaatcatatattaattttagatatgaagtacatggcatggtgctcactatttatgttataatgcttgataatttacataaggagatcttagcgtgatagaatatttgccgcgtagtaaacagcattctgaattgtatctaactcagtttggcatagaggaatgcataccgagtcacttttttggacctgcgataagagatcactatctgcttcattatattttggacggagaaggtaccttcgaggtcggtgggttcagttatcgcttgcggaaaggacagtggtttctaatctgcccccaggtcattacttattatcaagccgatgtagtgaatccttggtcttattgctggtttggatttgacggggcactggcagaaacactcctcaagcaagcaggtctaacgatgacgcgtccaatcctcaactttgaaggagaccatttgatttatcagtatttgcagcgaatgaacgaatcaagtgaatgccataaagctcgggaaaccagactgaccggtctgctttgcttaatgatatcggagcttatagaattcggtccggtaacacctcccgaacaaaaggaaagccggtcggaaatttacgtggaaaaagtgaaggattttatcgaaatgaattatgctcagaaaattaccattgagcacattgcaaattttatcggactcaatcgaagctatttatgttcgttattcaaacaacaagtgaacacaagtattcaggattatttggttcgctataggatcaacagagcatgtgaaatgatgggaaacgctgaactttcgatcggtgatatttcccgttcagtcggctataacgaccctttactcttctcgaaaatttttaaaaaggtaaagggactctcccccaaacattatcgaaccgaaacccatactcaaactcaagtcgactactaacgaacaaaagaggtcaaccagaaaaactggcagacctcttttgtttattttgtagtttgtccttccaaataagaaaccggctctttaacctctactttggtgccgccaaattcatctttaatgtatttttgagtatcctcgttatgatagagatccgctaacttttgcagccctttgtcattcgccttatcagatgaagtaaccaggacgttaatattatttttggttgcctgactgatctcctcatggaacaaggaatctttcagtacattcagacccccttctaaagcaatcgtattcccaattagcaccaagcctacatcttgaatcacgcgtggtcctgttttgtcatcaattagttcaaatttcaggtttttaggattgctagtaatatcattgactgtacccaaggcatcattaaagtcagccttaagcttaatcaaaccggatgcttccaataactttaaacctcttgccgtattggctgggttatctgccaaagctaccagggccccgtcggtcacttcatcgatgcttttaaatttttgcgaataaatccccataggctccaggtaggttgtggctatagccttcaaatcagctttgctctctttgttatagctaaccaggtacgcccacgattggaatgcattcacatctacttcgccttctttggtcgcattgttcgtttcgattccgccgttaatttctttcacttcaatgtccagcttggcatccttggcggcctgggactgggcaatatgcttccagatctgggcgtcagagcccatggagccgatgactactttttgcgtttccgaaccggaagcggcgctggagccattgctgtctgaacttttattaccgcatcctgcggcaaccaataataaactaatccctaatagtaaaacgaacgatttcttcatgttgttttcccccagatcatgtatgctagtgcatcgtcattccacctgtaacattaatcgcttgtcctgtcatatatgcagagagcggactggccagaaacagcaccacattggcgacatcctccacctcagccgttctccccaaaggtacctgtgaacaatcttcttcgtatatttcttgagcagtcattccgcgaatgacgcccccttcaatccgttcgcgatgcttcatcggcgtttctacgatacctggacaaaccgcattcaccaaaatttgatgcggagcaagctcaatggccatcaccttggtcaagccaagaaccgcatgtttggatgcacaatatccgcccatggcccgatatccattttttccagcctgcgaagcaatttggatgattcgtcctggtttgcgcgcatccaccatttccttggcgaaacgtttggacgttacatataatccggttgaattgatcgaaaatactttctcccaatcagccaactcactatcaatgacataatccatcgtagaagtacctgcgcagttcaccaatatgtcaggaactcccgtttcgctgattagtagatcgcaccatctttcgatatcatccggtttcgatatgtccaattgcgtttcaaccaactgtggattgaccactctatacggctcttcataagaaatatcagcagaaatcactttagctccgctttgaatgaaaagctctacaattcccttgcctatgcctgacttgccgcctgtcactaccgctgtctgatgagataggtcaatcgaaatcatagattttaaagtactctttcgaaaggatcgcggctaataccagcttccaatacaatcttcacatattcctgcgcggaaaaaagagagtggtccttgtagttcccgcattccaaagcagtaacagccggaacctctgtcgtttccagaattcttttcaaggttttttccaaagcgagtgcaatttcctcaggctcgtgttcattccataaaatcaagtagaaccccgttctgcatcccataggagagatatcaataattcctttgatttcatctctcagatacgttgctaataagtgctccagcgtatgtacagcagctgtagggagtgcatcttcattgggttgcaaaaatctcaagtcatacttttgtactgtgcttcctttttcgtcatgctctactcccgccgctcttacataaggagcctttacaatcgtgtgatctaattgaaaactttctacttttgccatttttcttttcctcttttctgtaatttatatttttaatctaatgatggatactctacatttgtgattttttcaaagaattaaatgctccaaatcagcatttttgtaattatacatcggattactcggttttaccactataattcttgtcgtatttcttttttctttgatcgtctctcctttgcctgtaggttttgacatagtgtacaatgtatacgataatgcatttttacgaaaaagatcgaggacatcataagcctcatttaggagaatgctctgtgaatgaaccggattggaagcacctgaatgctgtcccattacccttgcaggaatttcagctacagctggatcaaaacagtgtcgacgccaagcaactagaggagtggagaaagattcccgtcctttatcagctggctctggaggaattaaagaataaaattaagctgattcagacggaatggaagctgttagacggttttagcccgattgagcatattaaaacccggatcaaagagccccacagcatcgtggaaaaggttcggcgcaaagggcatgaagtcaccttggacaatatattgcgtgaaattcatgatatcgcgggaatgcgcgtggtatgcgcttttgtgaaagatatttatcgtctgatggatcatcttcacacacgggaagacattcgtattctggaggtcaaggactatatagcccatcctaagcccaacggctatcagagcttacatgtcattgtggaaattccgctgatcctgtttgagggcacacgctggatcaaggttgaaattcaattgcgcacattggctatggatttctgggccagtatggagcatattttgtactataagtttgataagaaagtgcctgaacatgtcgttaatggattgaccgaagccgcacgtgcaacctacgagctggatcagaaaatgctgaagttgcgcggcgaaattttatcgcttagcgaggagcaggatgcggaagaatccccggccaaacaatccgaagagacgtccttgaagacactctccctcccagcagatcacgccacttcacggccacaaacctgctaagtatttgtgtacaagataatttaagaattcagtcgaggctgcaacaactatggttcagtcttacgctggattcttatgtattgggtacaaaaaaagagccatcaaaaccacgttcatcatggttttgatggctcttttacacattttctcgatcaaatattactgtttctcgcgaatctctgtgctgattttctcaacgatatccgcaatgctgagtgatcccagatcgccttcgccacgtttacgaactgctacagtaccggttgttttttcattttccccgataacgaacatatatggaaccttctccagttgcgcctcgcggattttataaccaagcttctcattgcgagtatccacttcgacgcgcagacctgctttcagcaacgcatcctgtatctcattagcagtctcgatatagttctcggatactggcaacagcttcgcatgaacaggagccaaccacaatgggaatgcacctgtaaaatgctcagtcaggatgcccatgaagcggtcaatcgaaccatagatggcacggtgaataacgactggacggtgcttctggttgtcctcgcccacataagtgaggtcgaatttttcaggcatttggaagtccaattggatcgttccgcactgccagctgcgtttgagcgcatcgagaatgtggaagtcaattttcggaccgtaaaatgctccatctcccgcattaatacggtagttgatgcccaggtgatccagcacgttttgcagagcttgttccgcttgatcccacagtgctggctcgcccataaagtcatctggacgtgtggacaattccactgtgaagtcaaagccaaacacactatacatttcgttaattagcttaattacgtctgtaatttcttgttcaatctgacctggtgtgacgaaaatatgcgcatcatcctgacagaatgtacgaacacgcatcataccgttcaacgcgccggacagctcatggcgatgcacttgtccaaattcggctatacgaattggcagatcgcggtaagagtgaagctcatttttaaacacaagcatatgccctgggcagttcatcggtttcagagcaaatgtagtttcatccacttcggagaagtacatgttttccttgtaatgctcatagtgtcccgattgttcccacagacggttgttcatcatcagcggtgtacgtacttcctcatagccatgcagacgttgaatgtcacgggagtaatcttccaatgcagtgcggacaaccatacctttaggcaggtagaacggcatgcccggtgcttcttcggagaacatgaacagttccagctctttacccagcttgcgatggtcgcgttttttcgcttcctccagcaaatgcaggtgctcatctagttgtgcttttttcgggaatgctgttccgtagatacgttgcagcatcttattgttggaatcgcctctccagtatgcgcccgctacactcaacagtttaaaagctttgatgcggccagttgatggcaaatgcgggccacgacacaggtcaaaaaattcgccttgatcatagattgtaatttccgcttcttccggcaaatcacgaatcagttccagcttcagtggatcttccaactctccaaaaatacgagtggcttcctcacggctgaccacacgacgtgtaatcggcagattttcctgtgcgatcttcgtcatttccttctcgattttggccaagtcgtcaacagacaatgggttttcgatatcaatgtcatagtagaagccgctgtcgatgaccggaccgatacccagtttcacgtttttctcaccgtaaatgcgtttgagcgcctgagcgagcaaatgcgctgtactgtgacgataaatttccagaccgtctgcaccgtccagcgtaatgatttcaaggtcaacgttctgatccaaaacggtgttcagatctacagccttcccgttcactttacctgctacggcgttctttttcagcccggagctgatcgaacccgccacgtcggcaattgttacgccctgctcgtactcgcgtacggctccatctggcaatttcacttgaatactcacgattaaagcctccatttcaaattgtgttctatatcaaaattgaacgcaaaaaaaacgcctctctccctcaagggacgagtgcgttcagctcgtggttccaccctagttcggcccgctcctgtgcgtacatttatgttcatcggaacatgctcatgcacgacatgcgtgaccctccattggtatccgttaacggggataaagcggtaggcgcttactgatgttactgccagattgcacagctacatgttcaacgtcacggctacaaaggggtaacttcacatgcggttgccggaaaagctctcagcctcgtcttttctctctgaacggcccttcaaggaaatcatgtctttggtcaatgccttgaatatcactatatgctacagcattatagatcaaattcgcaggtatttcaagtgggcgtttatgtaatttcatgcctcctattgggtattcggcggacaaaaaggtgcaaaggcagcgatcccaagcacaggaacggctttgctctttgagccgtttttcagtacctttcattcctacggtgtaggcttgttgtcgtgcgtatttattttacgttctataggagatttcaaatgggtagggttcttcaagagaaaaaaaggaactgtttttgcaaagtgggacactgtgctctactcgcccctttgttttctcttgggaacagccattttaatgattatgtttttgcgtacggcatagcttaaagccgacctctatcaggtggtttgtttctttcgcacgtctccactcgtttctttctcagtgaaaaagtacagcaaagccagcacaggcaggacgactccaatcagagaactaaaattccaacctcctaacgcatacgaccaaccacctaatgatgatccaatcgctccgcctatgaaaaaaatagacatgaataatccgttcagacgccccctcgcctcactccccaaggagtaaatcacacgctgtccaagtacaagatttcccgatacagccatatccagtgtaatcgctgaaataaagagaagtacgagtgcaaccgtcgaatgactttgaaaaagataaatgagcaaaaaagacaaggctgcaatgatcatagctaacccggttaaacctttgctccaacctttatcagccaatctcccggcaatcggggcagctactgcaccgcctacgcctactaaagcaaacaatgcaatcccttgttgagacattccgaaatcatccgccaaacgtagaggaacaacagtccaaaataggctgaaggcaccaaataggcaggcttgatacagggcacggcggcgcagtgcaggcgtttgttttaaaagagtgcctagcgagaaaattaatttactgtaagataccgtaggcacaggcttgcgctctggaagagctcgtgagagcagaatcgtcaacagcgtcaagacaatggctgacaaaataaatacggcttgccatccccagatgctggtgataaagcttgctactggccgtgcgaacataatgcctagcaagagtccgctcatgacattcccaacaacgcggccgcgctgctcttcggatgctaaataggtggcgtacggcaccagtatctgggctaccacagatccaattccaatgaataaggatgcggtcaggaacaacggggcattggtggcaaaagcggcaacagccaatgcacagactgtgataattagcgatatgaccatgagccgtcgattttcaataatgtcgctgagcggtacgataaataacaaacccaccacataaccgatttgagttaaggtgacaatgaagcccgctgctgtagaagaaagacccatagcaacgtgaataggtcctacaagggtttgagcatagtacaggttggcaacaataaggccgcatgcggctgccaacaaaaacatcatccaatttgagatacggttactttttaaggcttgttgttctctttgcataataatcctcctcattaatttaaatactaaacgtatagttcattaatttgataatcaaataatatactgaacgtttcgttttgtaaatagacaaaatcaacttttttatttcacataatatttgatatactgaacgtatagtttatttttcgcgtttacttatatctgttaagaaggtgagcattccagtgcagagcaaaagaggacgtccacgtaatgtcgagacgcaaaaatctatccttaacgcttcctatgatctactgttggagcaaggctttggggcggttacggtagaaaaaattgctgagcgagcaaaagtgagcaaagccaccatttataaatggtggcctaacaaagctgcagtagtaatggatggtttcctgtcagccaccatagcaagattgcccgtgcccgacacgggttgtgtattagatgacattctcattcatgccacaaatttagtgcggttcttaataagccgagagggtaaaatcattacggagttaataggcgaagggcaacttgattcaggattgtcagaggcataccggacccgatatttccaccctcggcgacttgaggccaggcttcttattgagcgcggaatagagcgcggagaattgaaggaaaatctcgatattgaattatgtatcgatctcatttatgggcccgttttttatcgattgctggtaactggttatccattagacgattcctatgtgcgacaattagtcatgaatgcgttcaaaggaattggcgtggactgaataagtggtatcaagcagttctcacagagtatcctctgtgagggctgctttttcttttacctaccacgatcctctggttactccttatttgtttatttgtttattcgtcagggtctatactaatcttttgcagtaagtcgataagaagatcctcttcctcttcggatagtttatggacaaggctgacattgagctcgtccaatattccttgtaagacaggggcaaactctaacgctttggccgtgggagatacaagataggaacggcggtcatttgggtccgttttccgttcaatatagcctgattcctccaattgtttcacagagcgtgccgtggttgccttgtcaaatttaagttcattcgtcaactgctcttgtgtaatgcccggtcgctgcaaaatgagctttaaaaagctgtgttgtcctccactgccgattccgtaaggggccagttttttggacagtattttttgatttcgacggtacaagtgggaaattagctttccaatcggtttttttctcatcaaatacacctcattggcttgaaaatgacaaatccccagttgggaccaaagcaaagtttacaacaatattgttgcgcacgcaactaatttgctgtacactagaaccgttcatttagttgcgcctgcaactaaatagaaattgttaacgataacgaggtgtaatgatgagttcaacggctacaacggctacaacctatcaagagaatatcgaagtccagaagaaacgttggctgattttaattgttttgaatctgtttacatttatgtccacattggatggaagcatcgtcaatatcgctcttcctgtgttgtctcgcacgttacatttacccgtggcacagattgaatgggtgacaaccgcctatttaatggcgatatgtaccgctatcttattttttggcaagcttggagatatcgtcggtaaaatcaaaatattcaaaatcggcacaatcgtattcattcttggctccctaatgtgcggtcttagctcttcgctttctatgctgctgatttcccgtattattcaagcatttggagcgtccatgaccatggcgaacagccaggggatcgtgacagatatcttcccgttcaatgaacggggcaaagcacttggcctcattggaaccttcgtttctctgggcagtatcgccgggccaagcttgggcggtattattgtctcgtcgctgggctggcagtacattttctgggtcaatgtaccggtagggctggtcgctgtctttcttggctggaagcttctgccgaaggatttgatcaaggtgaaagataaaattgacgttcccggtagcttggtatttgctatttttattctcactttgttcgtcgggttgttgctgggacagcaggtcgggtatggcgacaaacgtatcgttacttcgctggtggtggctgtagttgcttttgccatgttcattaggttggaacttcgtcgtcctgggccgctcttacagctcgcgctattcaaaaatccgttattttcgctcagtattttgtgtgcttttctggtgttcgtcgctaatttttgctttaacatcatttcgcccttttatgcgcagaatatgctgaacttgtcgccttttcatgccgggttcctgctgatgctgctccccatctcgatggttattgtggcccctctcagcggtgcgctttccgataaaatcggatctgaactgcttacattcgccgggctggtcgttatggttattgcccaaattggtttggcccaactgcatgcaggcagctccatcccgctcgtgggtctgtggattgccatgctgggcattggcagtggtttattccaatcgccgaacaactcgctgattatgtctacagtaccccgcacacagctcggctcagccgggagtgtcaattcgctggttcgcaacgtcggtatggttgtggggatcactttggccacatcgatcctcttttatattatgagtaaagaggctggttatcgggtcaccggcttggtctcgggtcatccagaaatttttctggcaggcatgcatgtagtctttatgacgtccgcgtccatctgtcttgtggcggcattgttaacaggctggcggctgatcggggctaggcgggcaagaacgcagcaagaaaagggataaagaccaagcgaagaaataaagcgtccgtagacagagcaatgatcagaattaagatgatgagtattgcagtacaaacaagcattaaaagcaacatttacaattttaaaaatgggatacaagggtggagcttacatgaaatattgctatgaatgcgggacaaaattgatggtgaaggagtgtgaaggcgaaggccctatccccttttgtcatacatgccaggtctttcgtttcccgatattcagcactgcgatcagtaccgctgtattgaatcgtcagagagataaggtgctgctcatacagcagtacaatattcaaggcttcattttattggcaggttatgtgaacaagggggaatccgccgagcagacattggtgcgtgaagtgaaggaagaagtaggattacaagtcgatgagtatcaatatatgcgcagcgagtattttgaacgaagcaatacactgatgctgaattttgtgtccattgtgaatgacgatcagttggatgttcttagtacggaggtagatcaagcacgttggtttacactggaggaagccaagcaagctattttgaaaaacagcttagctgaatccttcttgctggccattattgaaaagattgaggcaggattgatttgaagtgatataagcgtggcgatgcgaaaatgatgaaaaagatgtctttacagatatattgaattgctaaaccgcaagatggctgctctttccaaggaaccctcttgcggtcacagcatgtttatactttttgtcattgctggaatttcagcgactcccctcacatccctacatttctactaaacgtccattttctttccaggattgcagtattttttcaagtacccactggtttttgtagccgtcctcgaataagggagcacgatccacagactttccccttgccagctcaacaaaatcttcataggccgtatgattatagattgcagggacagcccaactctcgtatttggcacccgggtgttccaggtcacgcagcacaatgcggatactttccgggttattgaggctggcgtgcagcgtaccaagttctccatagatatcgacttcgatatcgtgccgtatgccgatggcatttttatgagtgataaaggttcccacggtattgtcgcctacgatgccatgaaaggcagcgagatcttccacatccacttttacaggcagacccgtgatcggatcgaaccgctcgggtgtaatggtatgtagcaatgctgcgacacttttaaattcacccaccaaaaaacgggccagatcaatgatatgtgaggctgtatctcccactactccagaaccagccttggctaaattgtgacgccatgtatacggatgctgacgatacggcgcaaatgcatccattagataacgaaattgaatgttatagattttgcccagcttttgctcatccagcagttgcttggtatattggaaggccgcgccatagcgatgcttatagtgaaccagcaaaggtaccggattcgctgtatatagctttttcaactgatccgcttcttcccatgtgagagtcaatggtttttctgccagtacagctttgtgttcttccagcgcaatacgaataatgtcaaaatgcacatcattgggtgtcagcgacagaatcgcatctacctctgggtcacggattaatgcttcataatgggagtaccgcttggaagcaggcagttgcaattgttctccgatggcttgaaggcgattgggattcacatcactaacggccacaatagatacccccgagatgctgtgcagtgatcttatgtgatattcagcgataagacccaggccaatgatacccatccgaatttgtttggttggggaggtggaggtactcatatgttcagaattcccttctcttctatttggtttgaactctgtagcaaattccttttgctatgcagtatcacccgttgctttatagaatagtccccacaggaagtgatcgttgcaacctttaattcaacagtctgatgccgggcagtgaatgcaatgttccataaaaaaaggatctgcagctccgttgtccggtattgcagatccttggtattccttctctatgtcgactacatcaaaaatgtacctacgacaaaagacaccccgacgatgatcgagcgcagcagctgtgccagagccacattgcctttggcaatttcctcgcacaccttggtacgcggcgtcaccagatcaaaaatcacatagaccaaacacaatactacaatgcctacggccgaccatgtcagcatttcgagccatgaatgactgctgtacgacaccatccccacgatgatacacagacctagcagctttgcacccatatagatgcctgccgcctcattgccgcgtgcgatttcttgattatcgttataacgtgtcagcaaactgaacacaaaataacctacgattaagatagcaaataggataagcaggccgatacctacattgcccaatgcgttccccaaactgatataagagtccaattttcttcctccttatgatacttcaggattttgcaaaatcctcacttgtgaaaatgaacagatatgttcgaatattatacattttttaattcagcttatataatgtgcggattaggaggtgcggtggcaacggcggcggcgcaatagtaggccatatcacctgttaccttttcaccgattcgcggcaggacacccgcaaaacgccccccaatcacgaatatacctgttagtacatagccatgaaataatccttcgtcggtctgtacctctgcgctctgcatcggccacagccgctgataaatcttaggctgtccctcgtaataagcggcaatatgtgcggcttcctcctgctcaggcgttcgtggagcgtcagcttggtgaagctgatcagggttgtcaatctccgcaggttcaacctctcccaaggcgcctttcagcatctcctcggattgaggatgttcaatcaagtgcgtccctttaccctcccgtccccatatacctttggccacataaggctctttattttgcataaacaccgagggctcaaaatacgtaggcagcaggtaggttcgtatcacctccagctcgcgatcgtcaaacaaacgaaagccacagaactctggtgtttgctcatttcgctcatacagtgaccacacggttgcggtgaaccctttgctctgggtaatgatatgctgcggcgggttgattaatcctattttcccgtctgccaccatatccattagcgcctgccccacctcaagccccgtattctcttcccggtcatcaattagatattccagcggatacaggcgatagagaatgtggatctgctctccccggtgatacaatccttcattcgggataatctccagttcttccaaaggagcataaacgacttcgaatccggcttgttcacataaatgcataatatatttggtgttggtctgatcctcgatgtgccagtcatagcaagcaaaatacacctttgtccctaatcccttgcgactataaaaatgaataagctccgtcaaggcagactgaatcgcctcgtccattccagatgagggtccatgtagtgcattgtcatcttccgacattccatccctactcagcacctccagcagctttccttcgagataagccacctcgggaatcccggttggggtatcggtgttattctcaatgcacttgatacccgcttcccccacaatccaatcctggcgggttatcccatccggctcggcctccatacgtgcagcacgcagcaagcccggatgaatccccaaccgttccaccaggtattcatccggcatatagcgctgaacgaattgctgaaccttgcgataaatacgatgtaccgcctcagaagcaacctgaagctctgccagctcgctttcccgatataccgttaaggccggcacacaataggatttgccatacatgcggtgatacgggatggtacggctgatttcacccttaaaaagctcatcatgttcataaggcaattgccgaatcgtacgcatgctcatcttaacccccagagaaaaagccgctgcgtgagccgctgctgccaaaaccgctgtgtgagctggaagatgaggatgagcttttgcggtatgagctggaagatgaacgactgctatggtatgaggatcctccactataataagtcgatccgccatagtaatacccgctgctgcctgaatcccgacacgccgtttgttccgatacaggaagctcatcgcagtcataatactcgtcgtcaccgcaccccgtcagagcagctgggacagccaacatcagggcaaaagccgccatccgtgtacgagagccgggcttggatttcatcttttcccaggaatgctccatcacagatcgacctccttcacaaacagatgtacctttttcagctgagggtccagtaccgaatatataaattcatatgttttgccacccagtactgtatagtgatctaatagccgttgggccaactccaaagtaaataccgaaccttcccgctgatccatactacggaatgcaggttcatgccatatccagtacattgcactgtatgtggaagtgtaacctccctcactggcaagcacgaggtctgtgatggacgcaccgtaaggctttgcacgttcccctgtaaattcagtcacatagacggaatgatccgtatgttcctcactttcattcgatatatgcgaccatagtttgtcatggagacgcgtagcgtctacaagcttgcgtagaaacagctcatctcccgatacggattcccgtgtcaggctgcgcagttccttttgagtgtcttccgaccattcgcgatacgttaatgaataataaatgatgattcccttcccttcctgtacgcttctgtcatgaggtttgcaacaaatcaaagcgcttatgtcgtcgctcactatacgagattctaccttgaaaaggttcaatttggaagaaaaatacgacaaaaagccgcaatccctaggattacggcttggatttcactgctacagcttgatattgttctcgtcgaaatattcctccagcgtcatcccctgcttggctacatcctccgcaatgtctattcccacataacggatatgccaaggctcgtacacatagccggttacatcttccttacctttcatataacgaataataaatccgtactccggtgcatgtttttccagccattcgccttccttggaagctccgaaggattgctccagcacattacctacgcttgggctggatacatcaatggacaaaccagtctgatgctcactcgtacccggtacagcgctaactttagaggcatattcctgtccctttgtctttacattgttgttgaaaatagatacctgacgcttataggaacggtatcccgataccgcacgcagctcaataccgtctttttccgcaccgtcgaacagcttctccagtgcctctgccgcttccttacgcaaatgccgcttttcatgcggtccctcgaaggaaaaaggcacctgcggctccaccaggtcatcggggacatagcctacaggcaagctacgctttttgttcacaacgactgtatcagaagtcgcattggtgacaatcgcagttccatcctcttccttaaccgtggcttgcagcgcactctggcttcgcaacgccatcacagggtcggcctgtccactttctgtacccgcagaggcttgtccagcgctagtgctgccattgcccgcatccggctgggcggaaggctgtaccttgtcctgtaccgctgtagatgacttcaacggctcgctttcctgtccacctgatcctccctgctggcaggctgccagtaatagccctggcaggatcagccccggaatgagcgctttggtccagcgcttagatgctcgcgtctgttgtatatgtcgtttcatgctggtatctcctccaatattgcatttgatgcatgacttgctgtgacttttccgtttccccattgtaactgaacttttggcactcttcgaagccattatcccgttcgatgaaggcgaatagactcgaaaaaggaagtatatacccgaattgttacggagtatgacgtttttgcgggattgcagctcgggcccgctcagctacccgttcacgtatgagtttcaatgcctcttccgcacggggtaaacccggcagcaaatctgtaatatccgcttccttcttaggagcaagcttctgcggcagacgaatctcaattgcatgaaagcccgcaccgggacgatgcaatgctccttctgcggcagactccgcaatccattcgctaatcgctgccgatccgctgcgtccgccctctggccgcgaggtagactcaagcgcgggggatgtcccctgcacatggaataactccccggcccaagcactgaatacgtactccagcagctcttcccgtgtcattccgatcagttctagacaggtctgcggctcgctttccagaccggtttgaagagctttcttcacctcgtcgactacacccacgccatcctccgtgctagaagtggctgtctcagctgctagctgaacgatctcatccagcgatagacaggtttccccttgcaaaaaacggtagatgtccaaaggatctgcttttagctgctccagccatgcttttcgctgttcggggttcagtacaggcgctgggccagtccattggacagcatgtgtggaaggtacccccgttgattcgccttccaacccatttccgtctaattccgctatccattgaccgtcagttacttttagcttcactcgcggcctcgtcatcgccttcatcctttctctgctcactcaatccatacatcattttgcaacgcaatcagaccgcgcaattcatcatcagacatttcggtgagccaatgttcaccagagccgacaacctgctcggaaagtgcctttttgctctcgatcagctcgtcgatccgctcctccagtgtaccttggcaaatcagcttgtgcacttgtacattgcggctttgaccaatacggaatacacggtccgtcgcctgattttccactgctggattccaccagcggtcatagtgaatgacatggctggcacgtgtcaggttcagacccacgccgcctgcacgcagggaaagtacgaatatattcgggccttctccctgctggaagttgtgaacaatttcatctcgtctggttttcgccagtcctccatgcagaaaatacggctcttccccgaagattttggccaaacgagagaccagcaattctcccatcgacacatattgggtgaatatcagcgccgattcgccgttctcgcgaatcgtctctaccaattccagcagtcgctccattttgcccgagttttccgttttaccactatcagcccggcccggaatgatcagacccggatggtcacaaatctgcttcaacttggtcagtgaagacagaacaagccctttgcgagccataccgatctgcccatccagtgttcccaataattgatccaccacgccccgatacaatccggcctgctctggtgtcagtacacagtaggatttcaactccagcttctctggcaaatccttgcgtatatctgggtcgcttttgagtcgacgcagcatgaacggggagacgaggcgatgaagctcgcgcaacgcggacccccgctcttctcccgccagactgtaacgctggcggaacgaagacgccgtaccgaggtaacctggattcaggaattgaaaaatagaccacagctcgctcagccgattttctaccggagtacctgtcatggcaatccggtgtggagcagacagcttcatgacgctttgtgcttgctttgttcgtgcattttttatatattgcgcctcatccaacacgatggaggaccagtataccgcagataaatcgctgccgtcccggcccgccaaatgataggtagtgaggacgatatcatactcacgtacactttcctgaaacagctcaccgtggagtcgctggttgccatggtggatatacagtgacaaatccggtgaaaagcgcttcagctcgcgctgccagttgccgagcaaggacgtcggacagatgatcaacgccggacgttgatcatctgcgccgatgccaccgtcgagtaggcaggtgatgacctgaatcgttttaccaagccccatgtcgtccgcaaggcagacgccaaagcccaatccacgcatcgcagccagccattgaaagccgcgctcttgatagggccgtaatgcgccgtgcagtgtctccggcacaggccgcggctccaccgaacggagtacgccgccctcagccaaagacgcaagcaatccggcggattccgcgccaaagatggacaagcctttccatgaggcctcgcctgcactttcattttctgcagccagatgcatccattcggacaagctcatctcaccgttttccccgcgcttgataaagcgcagcacctgacggatttccttgggatcgacctcgatccattcccctccgagacgtacatacggcaaattggccgcgacgatgctttccagttcctccatcgtcaaagtcgtatcacccagcacagcctcggcatcaaacgagatcatgcggttaatgccgacagacgatgtatcggcaatcacaccatctggcttggcaccctgctctgtcgaacgcattttgagccgcaagcctgcacgtcttcggccctcccggctccagcgtgaaggcatttgcacggtgataccgttcttttgtaatgcaggaacggcttccgtcaggaagcggaagaacaactctggctccagtgtcagcccctcgggataaggacgattcaacgcttcttgcaatataggtgctgcttcagccgcctgtccgagcctcattagcagttgcacctgcacttgacgatatacaattccgcctcgaaccagatcacgttcaggatgcgcccacagtgccagagcaggcagtcgcaaccccggctcagcatcgctttctgcccaaaaggtaatgcgccaatccttgacactctcttccagggaaggctccaaacgaaggcacaaccgcagttgcccttctatcggctccttgtcttcccgttccgtgacaggcattgcgcttccctcaacagaggacgcttgaagcaccagctcctccatctccgctggcgttccctgaatcgccaccgggcgggaacctgtcagcagactgttccaccacagctccgccagcggcgatcctccgcgccgatactctgcgcgatatcgacccagctcacggtctgatgctgccagcaccgcggtcgtttccgcatggatgaccgcacacaagaaggagtacagcacgattccggctgcatcctcgcgtgtttcaggctccttacccgcaaaaacggccggagccgccatacaaacagctggcatcgcagcagccagctcatgaaagcggcgtatgtcctcctcttgacacagtcgaggaatccacaccccgacagccgcttccggaccacgacgacgcggtcccgatggacgcgcctctgtaagcgatggcgcaatttcgccccgttgcatcagctctagcgcaaaataagcggctttttgccaatattgcatttcctcgcccagcgtaatgcccgatgccgcacagcccttctcgtccatgcgggtcagcagtgccatcgtctcgcgcggttccagcgccaaaccctccaatgtacgccccaacatggaacgtcttttgccacctctgcccgcggtttccacacgagcagtgttcggtatccgtacctcagcaagacgcaacgcagcctgccgaaacggccgaaggtctccctttagcgtcagcctgcggattacactgctccacgcatcgatacgtggttccgacgtctcaccagaaaagcaaaaaaacacatctccgagccatattccataaagcggttgattcatatctgtctcccgtccagccttttgaattattactcttcatcatatacgaaaacgggctcttttcaaaactttatcacaaaaataaatggaaagtcataagttaataaccttaaatattcatgtgattaactataaaaaaggggagtccgaaaagccatggaaatggctatggatactctctcctattcgtcatcctccttcagataaggatgcaggctgtcttgcagcaattccttgaccctcatccgcagctctttcggatatatgacctcggcctctggcccgtattttagcaaaagtcgggacacatatctaaactcttcgaccggaatatatccctgccattcctgatcctgcccttcttgatgggaaacattttggaagagggcatctgatccagccagcctggcacccaatgcggtaaattttattttggacggaattcctatacgggaatcctccgaagccaaccattcctgaagtgtgggaaggctgtccaaggtttcgtccagcatcgttattgtaatcacccgatctgaacggtacagaatgatgcggtctctgctatgcgctggcatgtaccaatatccgtgatcaaaatacagtccaatcggatatacttcagtccacttttcaccggaagcggagcggtaaaacatgttcacccggcgcttattcaacgcagcctccaaaatgattgaggtgtagggtgactctgcgtgagtgggtagcattcgaaaagaaatgtactcctttaattgatcaatactgtcctgcacatcctgtggaagctcggcataatagtgctctgataaatgtccacgaaccgagccaaaagggatatctggaatgttctccaacagttgcagcatgaggaaaagacccagagcctcgtcgcgagcaagatgaaggggaggaagaagccgattggggagtgcccgatacccgccatgaggacccatttcggtataaaggggtaacccggtctgctgcaaatagtcgagatctctttgtatcgtcctgacggagacaccaaaacgttcagccagctcacgcgccgtatatttttttcgggaatccagtatcctcataagagcaattctgcgttcgttcataaggtacccctcgaatccaaaattaattttaaatgaccgttttaactacgacatactatgtcataaatacattgtaacattaggaaatagaaaggagtgaatgaactatggaagatttgaaatcaaacgcagttgtgctgtatattgccatgagtctcgacgggtatatagctttgcaggacggttcggtggactggctgtatgatgttaaaggggatggcggggacaatggatatgccgacttttacgacaccgtaggtacagtgctgatgggcaggctgacgtatgaggaagtgttgaaactctcagatgatttcccttatgctggcaagccatgctatgtgctcacacgagcattaacggaacaacagcaagcgccacatgttacatttacggacgaagctctgactgaactggttccacgtctacaagaacaatcggaaggtacggtatggctagtcggtggaggccagttagttcatgccttcttacaagctggactactggagaaggctatcattgcgatcattcccaaggtgcttgggcaaggaataccgttatttccagaaggaacgctaccaagtacatttaagctcaaagaaatagaacgccgtggggatatcgctctgctccattaccatttataattttatttacagaaaagccttcatatttcaggatcatgcaatctccctgaaatatgaaggctttatcgcgtgcttttgttcattatttggtcttcaaattatcccatgttctctggaaatcctcgaatagcttcccggcatccgatttacctgccacataagcttgcatctgacttccgaattcttgctgtgctccttcaggatagcggctaaagaaccagcccaacagtttgttttccttactgtatttcaccacttccgcacccagatggcccatatcagcctctgccccttcgatgctcttgaacgctggaataaacttgaattccttggtgatatactttttaccctgctcggatgtcaccatccagtttaagaactccttcgcctcgggtttgacagtcgaatttttattaaccacccagttgttagcgacacctacaaacagcttatctccggctgttgcgtcttcaccaatcggcataggcaaaatacccagattcagcttcggattaataccgtcaatttggacctgagtccagttcccttgctgcatcatggcagcctttccagtggcgaagttcgttacctgcgtgttgtaatcggtcgtgagcggcttcgaattgccatacttcattgtcagatcgaacagcttaatccactcggcgaatacagcgttgcccggaatctttgctgttccatcatttagtcctttgacgaaggccgaaggatccggctgattggcaaatgccacgttcagcaaatgattgcccagcacccaaaattcctgatatccattagaaaatggagtaatcccagcggcttggagcttttgcgcagctccctccagttcggacaatgttttaggggtctccgtaatccccgccttcttgaacaaatccttgttataaataaagccgtacccctccagattcatcggctggccatacagcttgccgtctttggtcatcggttctttggcgacatcgaccacatcgccaacccaaggctggtcagacaggtcctccaaatattccagccacgtatccagctcgcggtaacctcctacgttaaaaatatccggctgctccccggaggcgaacttcgcctttaacgccgctccatagtcactgcccccgcccacggtctgaatatcgagcttgatccctggatgagacgcttcgtattccgctttcatgcgatttagtgcttctgcaatctctaccttaaactgaaaaatgtgaattgttttttccttcacttcctctttgcctgcgttttgtccgccactgctgttacaacctgccaaaaccagggcaaaggccgcgagaagcaagatcagtgcttgagctttctttttaaaagtatgcgttttcatttttatgttcctttctattctaaattcatatcagatgaactcgaagtattcatgtggaaacggagcaaacggaatggtgctgaacaagcgatagcgctcgcctttgtctctagattcccacctttattcgtttattcaggggaatctggaggcaacagcgatggtaagcaccatccgtttgcggagtggcacaccgtgtacattttcagctcatcgccacactcaacctttgaccgaaccagccataataccttgtataatatatttttgcatggccagaaagaatacgatgactggcaagatgcccagcaccagagcaggcaaagccaaatcccactgcttcgtgtattgtccaaaaaaggcataggtcgcaatcggaatcgtgcgcagttcagccttttgcaataccagagaaggcaagagataatcattccaaatccagagcgtatttaaaataataacagttaccatcatcggtagcatcaacggatacacaattcggaaaaacactccgtaaggcgtacagccgtccaccgtagctgcctcttccacctcgactggcacacctttgacgaatccatgaaagagaaagatcgacataggggctccgaatcccagataacagattaccagaccacttatactgttcattaaatccagtgtacttacaaccttgaccagaggaatcatcaccgattgaaagggaataaccatggcagctacgaacaggctgaacaacactcgattataacgcgtcggacgccggaccattcggtaagcagccattgagctgatcagtacgagcagtagattactaactaccgtaactacaagtgaattccataaagcttcgggaaaacgcgtgatgctccacgctctagcgtagttgctccatacaaaggtttgtggccaggccgcagaatcggtgagcaggtcaccaaagcttttgaccgaattcacgaataaaaagtaaaacgggacgaggaataacaatgcgaagaggatcatcaccatctcggtcgcccatgttccaaagcggtagcgcttgcttgtttccatttacgcttccacctcccgacttttcgtcagtcgtacctgaaggctcgtaaccagagcaacaatgataaagaaaatgagcgctttagctgttcccagcccataacgattattcacaaacgcttcattgtaaatattgagtgcaaccgactctgtggacccgaaaggaccgcctttggtcagtgacaaattgagatcgaacattttgaatgaccatgatatcgccaggaaaagacataccgtaacggcaggcatgatcagaggaagtataatcgaccgcaaaatttgcatccggcttgctccgtcaatttcggctgcttccagcatatcgcggggcacattggtcagggaagagatataaataaccatcaaatacccggcagtttgccagataaacacgattacaatgccccagaaggccgtgatctcatctcccaaccaggacaggttgaagaaggacaagttcgtgctctctccgattgctgcaaatcccttgacgaaaataaactgccagataaagcccagcaacagacctccaatcacattaggcataaaaaagatggtcctgagtacattttttgttttcagcggtttggttaaaaaatacgccagcagaaagccaaaaatattcgcagccaccactcctaccaccgtaaaacggaccgtaaaccagaacgctgtcccaaatttgtcatcattccataaaatgtgactgaaattatctagcccgacccactttgcctcattggctaccccattccactctgtaaaagaatagtacattccgagcataaaagggattacaataatgataacgaaaaataacgtcgacggccctacaaaaatgcattgctggagccattgcgacgacttggcgcgattcaatccgatcccccccttttgttgtctgttggtgtctggaacgctcccttacggctttctttcagcagcatgatgcttgggccgtacggatatgcgattcacatgttcattatgtcgaattagcgctctggagaacacgtaggatcgtgaaccattaggggggaaaatattgacctctggctcgccttgaattgtgaaaggagctcactgcatgaaatttcacagtattcgttcccgcctgatctggtttttgctcattgcggtcactctgccgctgctgctgtcgatgactatgaccttcgttctcaccaagcaatccttgcgggagcaggccacacaagaaaatgaacggcttatttttcagggaattacgaatctggataactatttacagggactgaatcgggcgtccatcggagtctataatgacccccattttctgcgtaatctggccaaaattccggatgattaccgggccgtcgctgaaatttacaccacactgcaaacgatgatgaatgcttcgtcaggcattgaccaagtgtatttgcattcttttgaggctgggcaatccacgttgattaccagtacagtcccgctacgggaattccgactggagccctttactggttctattcattacggcccttctggactattcatacagccttcgcacatgaagcatttgtacggcttttcggcggtttcctatacggagcacagcacaaagcggcaggtatttacacttcatcgggcgattcggaacattcctgcctcagagacgcttggggtactagctatagatgttgatctggagccgctgcgcagtatttgccgtcaattgtatgatgcagatacagaggagctgtttttgatcgatcggaacggaacaatcatatatagcggaaaagaagcagcgattggaacacactggaaggaatctgacctgctcaatcgaatttctaaagaaggcgagcacggagtgattgaggatgatacggcactgcacgtatacggcaagctggatgccaacctatcaggctggacactcgtcaagaaaattccacatcgtacgctgtatctacgggctacccgcctgactcagattaatgcggtcattacaggcgcagcgttgctacttgtcattgtggccacgttatggatttcgataaaaatcacggaacctattaagcgactgactcgctacataaaccagattcagtccggtcaactggatgtagacattcgggccatgagtaacgatgagatcggagtactgtcgcgccgtttcagacagatgatggataccatcaataacctcattttgcgggaatacaagctagagctggctaataagacacatcagttgaaagcgcttcaggcacagattaatcctcattttttatataatacgctacaatcgattggaaccctggctctacagcatgaggtgccgcggatttattctctgctctcttcccttgccaaaatgctgcgctataacatgcgggaccatacggtcgttacactcaaggaagaagccgaacatgtaaaacaatatcttgatttacaaaaggaacgcttcggtgagcaattagaggtcacttaccagtgggaagatgaggtcctgaatgatcgggtgcctaaaatgattctccaaccgttggtagaaaactactttaaacacggagccgatccccggctggggcccggtgaagttcgcattacaggcagccgaatccgggaaggcattgtgaaaataaccgtggaaaacaacggaacttccattccacaggccgaattggagcagctccagcatatgttaaaacgtccgctgaaagcctacgaagagccggacactagcgagcaggattccattggccttcgtaatgttctattgcgtattcagcttcactcggaggatggttccaacaccctgtgcgtagacaacatcctgcctcatggtgtccgttatacactcgaaattcgcactgaagcccctgcagaaattcatattaagggagagtgatctgtcaatgaaagtcctgattgtggatgatgagaagcatgtacgccatgccattcggatgctcgtacattgggaagcgtgcggtgtgagcgaggtacttgaagctgagtcgggcgatcaggcgattgaggtcattaccgccctttccccacccgttgtacttacggatatgcggatgcccggcaaggatggagtagcactgatggagtggattcaagtgaattccccagcaacccgagtcgtggtggtcagtggttatgatgattttgatttggttcgacaggtcatccgccggggaggcatggactatattcttaagcccgtagatccagtggagattaacgaggctctaaataaagccactcaagcctggcggacagcggagcaagaccggaacaggcagacgatgcaggccatggaggtcaaccggatgaggccgcactatgccgataagctcctgactgagatcgtttccggtatagcgagtacccctctttccattacgcccttacgtgaggagttacgtcttccagcagctattcagatatgtaatgcagctgtgatgagtaccacgcagctggatgccgatatactggacaaatataaaacgcgtcgtgcgcttttgagcttttccctgattaacatttgcaacgaatttcttggaacttctcaaaccggaattgcattccgtcatctggagcgtatggacgaaattattctgctatattggggcgagccatctcgttggccgctgctcttgcaggatattcacacagggatcaaaacggctttgcgatgttacatgcacatcggggttggctcttttggctcttttggcgcttttcccatagcggcagccactgcctaccaagaggcacggcaagcgttgtggaaacgggatgtgttgcaaaccgtcgactggatgcaccagagttcccagacacggcaaagcattcgtcttccccagttgcctgagatggaagaggaactgcggcttagtgcactcagctgtaatgccaatcgtgtgtcgatagcggtaggccactggatagcagccgtagccgagctgccttcggtgacagcagagcagctagccagttggaatcaggagttggactggatgctggcccgctggctgaatgacagacccggagataccgatggcgaggaactggcagatgagtccggctccattcatgcattgccggtcgacaaccgtggcatgctttccctgcccttatggcaaagacaggttgaaaaccgactgctggcagccggtcaggcacttacaccaagccatagcccaaacaacccgaccatccgagatattgcccgctatctggatgcacactatgacgaggacatttctctacaggatatggcgagtcgcttttatctcagtcgcgaatatatttctcgtaaattcaagcaggagtacggggttaatctgtcagactatttgtgtcagatcaggatgagcaaggcaaaactattgctgctgaatgacaagctgcgccttcatcatattgccggtatggtcgggtatcaggatgaaaaatattttggcaaggtgttcaaaaaactagagggggtcacgcccggcgaattcagaaaacgccattctgcaaatcctcagccgtgaccgcatacaacacgtgatcttcccacacaccattaatcttcaaatagttgagagccagcccttcgcggcgaaatcctgccttttccatcactcgattggaaggcgtatttcttggcatcactccagcttgaatacggtgtaagtccaactcatttaaggcgtagcgtataatatccttcactgcggaagtggcatagccttgtccgtggtatgcaggatctacaaagtagcccagattggcgttttgaaaggggcctctagcgatacccgacagctccattctgccgatcagcttatcattttccggcaaaaaaaagtccaaacgtatatccctgtccggcttgtgccgcttccaaaccattagaaatcagacgagcctgttcttccagcgtaaagtaaatttcaggtcgttctggctcgaacggtttgaaaaaattaaaattttcacgtctgatctctaataaacgttttacatcacttacttgtaacaatcgaatctgtagccccggatgggtggactttatcaaaatggcgccattagctttatgtaacattgtcatttcccttctttctcagttattcctatattattgtgttcacggtcacgagacaggaaaataccccaggtgcatgagagcagcctagggtatctccatcattcaaaatttagtccgtaacaggcatccagcctggaagggtcgtcaacgcaccccacaagtagtcaggaatgactagctcctgctgggcttgcttggataatgtcgtgcgaatggtatcttctgtgccgttttgcaccttctgaacccattgcggctccatcaaaagcggacgtcccagcgatacaagcggtacacctgtctccagtgctgcaagcgcctcgtccggtgtattcagcgacccaactcccataatcggcacacggttacctaccttctcatggatgagaacggtacgtgaccgttcgtcactgcggtcacggaacgaaccaccgaagaaatgatttacggaaatgtgcaggtaatccagcccttgatccgccagacggtctacaagcaccatcgtatcctccagcgtaatgcctggtgtgtgtccttcctcaggagacaagcggtatccaaagatgaatggccgctttgcatgttctgcgatcactttcttcacttcgtgaacaaccgccagcggaaaggtcaatcgtttttcaagacttcctccccattcatcggtacgaagattggagtgcggggagaagaactgctggaccaggtaaccgttcgctccgtgaagctccacaccatcatagcctgcttcaatcgctcggcgagttgcttcgccataggcacggatgacgcggtggatatcatcggatgtcatttcacgcggcacaggcgcaccttctttttcctcggctactgcgcttgcactgatcggctgtccatctggaatttgatctggtggacacaggcggccaccatgataaatttgcaggatcgcttttgcgccttcttgatgaatcgtatccgccagacgacgcaggctcggaatcatttcatccttgtccgcaccgaactcattgacaaagcctttgccatctggagttacatacacacaagcggtaataaccgcgcctacaccaccggaacgttcacggtagtatgccagctcctcatcactgacttcaccattttcgtgggaagcaaagttagtcataggtgccatggtaatacggttcttcaacgtaacaccggatggcagggtaaaagtttcaaatagagacttatattttgggttcattcgttctctctccttcaatttaaatcagatcagataatataaggctgttgagcataaagccgaatacgaattcgatgcagttttccttccataacgaacttaaactactgttgcttacttaaatacagtggttgtaataaccacagtataaagatccgcaactataaagtcaaatccatcctttctgaccttctctaaactgttcgaaaaagctgacgcagctacttgtcaccagccactgacaaagcttaatggttcccggctgtgctgttcttctcctcccggcgggaaaaccaagtcgcgagcaacgagccggaaatattatgccacacgctaaaaatcgcactcggcacagcagcaatcgggttaaagtgagctgctgcaagcgcagcgcccagtccggaattctgcattcccgtttccagcgtaaccgctttacgcttggaaagattcataccgaatagcttggcaaaccaatatccgagcaggaacccgataccgttatgcaaaataaccacaccaaaaataatcggacctgtctccagaatctttcctttgctgcctgcaaccacaatagccacgatgagtacaatcgccagtgttgatatgagcggcagcgcctgaacactggcttctgcctgtttgcgaaatagcgacttaacgataacacccagcactatggggacaataactacgatgagaatatccatgatcagcgacttcgcatcaatattcatccatcgtccagcaagcaggttaatcatcgccggagtagccagtggagcaatcagcgtcgacaccgaagcaatcgatacgcccaatgccacgtcgcctttggataagagcgtcattacgttggaggcagttccactcggacaacagcctaccaaaatgacacctaccgcaatatccggtggcagttgcaatactaatgccaatccaaaggccagaaacggcataatcagataatgcccgaccacaccaatagccacatccactgggcgccggaatacttcacgaaagtcagccgtagataaagttaatcccatcccaaacatgacaatgcccagaaataactgtatgtatcctttcaaccctgtaaacgccgcaggaaagaaaaatcccaagcatgcaaataaaagtacccagatggaaaaggttcctcctacaaatttccctactttctccaagccattcattctacttatctccttacttctatataagttgaatctgaggaatttcagcttatatagtgcttaaaattttcaccattgtactacatatgactgcatatacatacaactttttatgattatactgggatcaagaaactttttcccgttaggacatattcgaaagcaaagtgggtatattcataatagaagttgtgaccagtcggtcatttttggatcatcattcgttgaggaggagatatccctatgtcacgaagtcatccgtataaatggtggaatattattgcatttatcgctgtcattctcgttaacattctggcgtctacacttcctatcggcggcagaagcactgctgctgtatccaacatgtaccctaccttgatcacaccagcgggttacgctttttccatctggtcggtcatctacgtattgctcgcctgctttgtcgtgtaccaagctacacttacagggcaatccaagacaagcgttcagtccatcggtattttttttattctaagctgtctcttcaatatcatctggattttcctctggcagtatgtatatgtagagctgtgtgtcatcgtcattattctatacttgctttccctgagcgtcgtgtatgtacgtacccgcacgccgcagccaacccttggagaaatgtggttcgtcaagctaccgttcagcctcaacctcggttgggtatccgttgctactattatcaacattgcagtggcactggaaaagaatgaatggagtggctggggactcagcgatacgacatgggcgatcattatcctgctcatcggcaccgcattggcgatcatggtcagcttcccttatcgcgacagcatttatcctctcgtatttgtatgggcctatgtcgccatcgccgtcgagcatccgaacaatgaaaatgtacggctagccgcattgatcttggcggcaatcattctggtatacgcgctatggctattctttgcccgtaatcgagaccgggattaaagaaaacgaatatgatctctagcaagaacaagcgagtttgggtctgaatcatctagcccaagctcgcttgctttgtttattcattttaaccatgtgattaggtatggactttaaacaaatctataagcttgcttgtcgagtgatctgcattaattttcttcatattgataatataatccgaccttttttcatacaaacgaaatatcatgtcgacaaatcgttcagattccaaacaaaacactttaaatttgagcaaacgggtgtctctatttaatagggacacccgtttgtcatgcaaactttttattttatgaacggatctttcagactattcgcccttcaatgcaatgacttcaatctctaccagtgcatccttgggcagacgagctacctctaccgcactgcgtgctgggtagggttgttcaaagaaagaactgtacacctcattgacgctgacaaaatcgttcatgtccttcaggaatacagtcgctttcacaacctggttcatgttgctgcctgcctcttccagaatggcttgtacattgctcaaggacaggcgtgcctgctcctgtacatccttaccaaactcacctgttgccggattcagtccaagctgtcccgaagtgtaaataaacccgcctgcctctaccgcttggctataagggccgatagcaccgggtgctttttcagtagcaattgtttttttcatatgggttggattctccttcctgatactggttcaccgtattatagcatgtgcagtccaaagccactattccgtgcgacggattaacgcacttgatgaattagagattacgatagatgtgccgcaacatacaaactaccaataaaacacaaataacgccactgttgtccgaatcatcgggcaacagcggcgttattgtcatttttaactctagctgtggttttacacattctcatcaggagccgttcctgtaccgggttcctcatcatcggatgttagttctgctccgatgactcgaatgatgtcgttcggataaatatgtacgccgctcgcctgtgcgagagcaattcgtaccatggctcgtgcgatgaccggggccgggatggcgcggtaggaagcgagcttgcccgtcatcaggccgtccagtgccttcatgacaacagcggcagcggcttcgcccaaacgtcgttcaggtctcgcgcccaaaatcagcgacggacggaacaaatgcagcgcaggcaatgcgacagcagcaagcgcctcttcagcctcacctttggtgcgattataaaacacgcgtgagtctggatcggcgcccatcgcagagaccgcaagcatctgtaccgctccagcttctttgcccaactgggctgtcagcaccgggtagtccagatccacctgacggaactgctccttggagcccgcctttttcatcgttgtcccaaggcagcaaaaaacatcatccaccccttcgaaggcgaacgccgctttctgcggctgttcccaatcgatgagcgcctgctccagcttgggatgcttgatgtccaatggacgtctgcccataaccatgacgcggttgtattccttttgcaccagcagctctcgtacaacataacccccgacaagccctgttgcacccacaacgaccgctttgcgttccatgatagacctcctttgtgccatagcgctcctgctcctacaattgcgattaggttaatttaaagggttgttcgtccgcctccttgcttttggacggacacatcggtaggtacagggaaaatgtacttcccttgccctcctcactctccagacggataaacccgcccaacaagcgggaaaaatcacggctgatggacagtcccaacccagttcctccatatttacgattaatggaaccgttggcctgctggaatgcctcaaaaatcacatgctgctgaagattggaaatgccgatgcccgtatcttttacagcaaatacaacccaatctccctcttgtccctttcgatccagatgttgtgtgctgatttccagcaatacacgtccttcatgagtgaacttaaaggcattggacaatagattacgcaaaatttgctgtacgcgtttggaatcagaccggatttcattcggtataggctcatgctccttcaagctgaattccagatttttatccttcgctgtgacttcaaaatgcatcatcatcacctgcgctatctcacgtacactgactggctcacttacgatttccatgtgcccagcctcgaccttggataggtccagaatgtcgttgatcaattggagcaaatcatgcccggaggcataaattagatcactgtactggtctagctcgtcctcatccagctcttttccctgctcgttgataatttgcgccagattaatgatgctgttaagaggtgtacgtaactcatgcgacatcgttgccataaaatccgatttatattgggaagccatcatcagttgcttggcacgttcctctagaatgacctttgccttctgcaactcatctcgctgctctgataacaactcattcgcctgcttaatctgatgattccgctgctgctccatctgaaagtcacgtaaaatcagagcaaataaaaaactgagaacgatgccgataggcagtgtaagaggaacaacctccgctagatagtagcgccagggaatgacgcctagaaaggcaatatttaacgtatttacgatattaacagctaaaatggttaccgatgccttgataatcaaacgccaggtggaacggcgcatccagtagttcaatccagcgcacaggacgcccagaatgctcatattcaaaaagccgacccacgccgccatatgcaaaccgaaggtaaatctcgtaagtccgattgcgaccccaataataataagcgtataagagcgaggatacaccaacgccgcgataatcagcggtacgaaacgcagatcaaaaataactgtttcactaaagttaaaaccaaagcaagagctgacccatccgccaaatatcactagcagcaccgagctgacatatttgaaccgcgaagaggtacgactcaaaccatatttataaatcacgttcgccacataggcaacggcaatcagcatccccaaattcattaaaaacatcattgaaaattgcatggactcacactcccatagcgcaaaaaattggatgccaggcctatgttaaccgcgtctgcctttcttgtacatcataacatgaagccccatctttcgacatgtcaaaagatcttatatccgtatataaaaaaagcgaacctcaatggctcgccctagtgctgatacctatagagtcagctgtgatgcctttgttccggcgccactctttgacaaataactcggcaaaataagggtcccattgggttccctttccctcttccaatatcataaccgccttctcttccttcataccttgccgatagggacgatcagacgtcatcgcatcataagcatccgctacagcaatgattcgcccaaataaggggatatcttccccggcgagctggtcagggtatcccttgccatcataacgctcatggtgcgagcgcacgcccggcaaataaggggccatagcataagccggctcaacttgccggagaatgctttctcccataaccgggtgcattttaatctgatcaaactcctcgtccgtcagcttgccgtccttgagcagcacagcgtcagccacgccgattttaccgatatcatgcagcaaggctgttttgcgcagcaagtcgaggtccgtctcattcaaacctcccttacgcccaataagtacggaatattcagctacacgcaaagaatgtcctgcggtataggcatctcgcgcatccagtgctgccgccaaggtggcgaagtaactgtccaatagctgaccgttcttttcttcccgttccttcagtccctcgatcatcatgttaaatccttcgaccagctccgcaaattcgtctgaatacaaatcgctggcattactgttcaggcggccttccttcacttcattcattttttctagcagatggtggatcggttgttcgatctcacgggtcagcaacctgccgcccagataagcaaaggctacaccaaaaattaaaatcgtacccgcccaagcccaataggaggtagaatccgtcgcctccaaacgttccaggcgaatctgtgtagctaaacaaaataaaaataaaggaaaagcaccaatgagcgtcgcgcttaactgaaatttatgccgaagcgatagcaggactcgtcctcgcagggacaggtttaatccatattgctggtaggttcgatcacgaatttcctccagaagcggtttgattgctctcatggtcaggaaaaattcaaccagtgcgtgcatggaagcgaccagacaagctcctatacaggcgattcctacataataaaagggaaaagtaagttgtccagtatgtatcatccataaagcaataacggttgccgggatagagaagcctaacaaatgcggtccaacaatacgtaaaacggacaaattaggcagatgatgaacccggatatacaccgcttctacatccttaagcgtttcctggttacctagaaaaaaacgatgaacgggtctcaaatgcattcgaaacactatggtttcacaagcaatcataataacgctggaaaatgcaataattttaacaagacccagaatttcatagtgggctacatttaacgtggaaaatacaaaaatcatacctaccaacaatacagcgataaacgaacctataatatagttcaggataacatgctgaataaagcgcttataggtcggcaaattgctacccctcttttcatccgtacactctaaaatatcttgtgtattcaatatcggagtccaaccatcaaaagtttaccttcttgctcgagcattttacataaatacgaggacggcttttaatctgcaatttatagatggaaaatcatcttattcttaattaagaaactcgcgagggatggacattttagccaacattttttccagtctatcatcaaaaagccaaaaatgacttgtgttttataatcattcttgctatactattagaatatgtattaaccccataagattccacgcaacaagctattactcctaatcaccgtatggagcttctccaaattttatgtataaccctaatgtagaattttgagcttttgccgaagattttcacattcacactggcgcggtcatcggagccgcaaggacgaaagagaggtagggcttttgtcgtttggaaaatgaacagtggaatcacactgccccttatgaacatgctgaccatataatgcaaggtagcaggggttgaatatatattatgccatcaaacgatgaagtttgagcaggccgtgcagtatatgcaaactgcaccatcctccggatgatccccgggggatttttcatatacggaaagcatatctatgaacaaaaaagtggccctgccgatacatcggcagggcctatagcttgatcaaaaaggggttaataaggtcattatagtctcgctttcttaaaactaaatgatatgcaccttaaaaactcattaattttccagttttatataccttctaataattcgtccaatattctgtaccatcgggcggcatcgtttgcgtagtggaacgtcttgtttccgcttgggtgcgcctttgggtcgagggacgttcccacccttccagtaaaacaacatgctgggtacccgaattgttttcccaagtgatgtaacgctcctgttccatatgtcgcaaggcgactgtaatttcagcgtctcgcttgcctgtttttacggtcaattccgccattgtgggcatgtggcgatgctgggcgaaataattatacaaaatacgtagcagctttcgttccaaatctggcaacatcgtcttccctcctacaaagaacatacgttcccattataacatataaaaatgcaccctcctactggaagatgcattcgggcttgtatgcccatgttgaatttagtttttttccttctcctgacgaccaatagagcgcaaccaccaggcgattccacccacacttccaagtgccagaaccgttaagaaaataatatagaacaaatgaaatgcacgatcactcatggcaatcgcctccttactttatgtatacactttccagctaagcctgtaaacctctttttagtcccacattctaattttccccaagcactcgacaatagatacttgcttgagatctatcggtacatactaactaaaagtggttaataccaaatatgagacagaccaaggaggttattgaatatgaaattcctattgatcgtgatcatcgtcgtgctgatcgttgtattgcttatgagaagacgcagataagcagagacatcctcctcgtaaaaaaatacaaaaaaaggctttcggtgatgtaccgaaagcctttatccatctgaggttaaggcgtaaattacgccttgttcttcttgttatatttaataaaagcaattacaagcgctacagcaaacaatattccgctgaccacccatgttgtcagaaatgccatacccaaaccgacattagaccccatcgtcgggtgattcatggcagtaaacactgatccctgcatcataaatatggtacagaacaaaacaacgggcgctaaaataatcgtgcttgctgtcttccgagtaccagatactgcgatcacgcacagagcggaaatcaccaagatcacccaatatataactgcttcccaaatcactgaagtgcccacctgttcaacctcttttctatccattcgtatatgcctcttctattgtaacagacgtcacacagtgaaccaagccataatttgatcagaaaaggggtaaaccctgcggataacgtaaataatgtacagtagcgatcctacaccaaagacatgaaaggaaatgatcccatgagaagtgcaagtccttttgtcattgtaaacgatgtgcagcagtctattgattattaccaatcggtgttaggcgggaaaatcaaagtgctaaacaagcaggaaggcagactcttgcacgcggaacttcacctgggtagcagtcatatccatttttcagattcctacggtaaaccgctcaaaacgcagcatgtccaaatcattctcgactgtgaaagtgaggacgagcttaagcaagcttaccacgcactagcagaaaaaggtaccgttaccgtggagctacaagatactttctttggggcactgcacggcgaagtaacggatcatctcaaccagattggatgggtgatgaactattttaagagatgatcacgttcagccataaccgaatacgtcttatagccaccatcaacgttcctcacccgataaccgtattgagtcaaaattctggccgcaatatagcctcgcagaccgacttggcaggataccgcgatctccagatcactaggaatttctgccatccgctctctaatctcggccagaggaatatgaacagaacctggaatggctcctgcctgaagctccaccgcatccctaacatcaattataagaccacccttgcggtgaaaatcatcaacttcatgccactgtatcgtttggaccagtccatccatgatattcgaagccacgtaacccgccatattcacagggtcttttgctgaagaatagggaggtgcgtaagcaagttcaatatcagccagctcacggacgttcaaatgaccacgaatagccgtcgcaatcacatcaatccttttgtctgctccatcagctccaacagcctgcgccccatagatcatcccgttctcgggattaaagagcaactttatagcaatgggtgatgcgccagggtaatagccggcatgcgaaccaggatgaatatgaacagcctgataaggaacgcccagccgctgtaatgttttttcattattacctgtagaagctgaagtcaatgcaaaggtcttaattacggatgttccaagcgccccatcataagaaatggcttgaccgttaatatgatccgctaccaaacgcccctgacgattggctccccaagctagtgataccatcgttgcaaacccatgattgcggtctttgacctggatggcatcccccaccgcataaatggccggatcgctggtttgcagttgggcgttgacctgaatggcgccgcgaaaaccaagttccaatccgctttgcttggccaactcattttcaggaacaacaccgatcgccagaataaccatgtccgtatgaagcacacccccggaggtcaaacgaagccgtgtaccctgctcttcaaaagccgtgactccttcctctaaacgcacctccaccccgttcagcctcacatgctgttctacccatttggccatttcagggtccagcggattcaataattgttgacccatatcaataatagttactgcaagtccacgctcccgtaaattctcggccatctccagcccaataaatccggccccgatcaccgtgacatgctggggatgcctttcatctacatatgccttaataacgtccgtgtcatgaatgtttcttaatgtaaatacattcacagctccatgtaatccgggaatgtccggtatcatcggtttggctcccggcgacaataccacaatatcgtacggctgctcatctgtttcccctgtaatcatatcgcggaagcggacgagcttctgctcgcggtctatttgtatcacttctttcagtaccctcacatctatattaaaacggtctcttatcccttgaggcgtctggagaaacagcttctcccgcgcatggattgtcccgccaatatagtagggaaggccacagttcgcaaaagaaacatgctctccgcgttcaaacagaataatctcgtcttcctcattccatctacgcaatctcgcagcagcagaagctccacctgctaccccgccaataataactattttcctacccatttcttccccctcctcatataccctacggggtataatatatacctatgggggtatgatgtcaacacgcaaaaaaagacggaggtcgccccccgcctgatcaaccctgaacgaatactgatctggtcgaaaaatcacttgcgatgctcacgattgctctgtcacacttagtctaagaagggtctactgctactactgctggctggccgcgatcgcctgctccagatcgtacaatatatcgtctatcgcttctgttccgacagataggcgtaacagctctggtttgactccggcagcgacctgttcttccacattcaactgctggtgcgttgtgcttgccgggtgaataattaaagacttcgaatcacccacattcgccaaatgagaaaatagctttacattcgcaattagcttgcttcccgcttggcttccacctttaataccaaaggtcagaatcgctccctgtccctttggcaagtatttctgagctaattcataggacgggtggcttggcagcccggtgtagctgacccactccacatccttgtggccttcgagatattgcgctaccttcaaggcattttgactatgtctctccagccgcagatgaagtgtctccaagccctgaagcagcagccatgaattaaacggagaaatggccgctcccaagtcccgcagcaattggacccgtgccttgataatatacgcgataggtcccaccgcctcggtgtaaacaactccgtggtagctcgggtccggctcagtcagtcccgggaaacgaccactcgctttccagtcaaacttgccgctgtccacgatcaccccaccaatagacgtgccgtgcccgccaataaacttcgttgcagaatgcacaacaatgtccgctccgtattcgataggacgcaacaagtaaggacttgggaacgtgttatccacaatcagcggaataccatattcatgcgcaatcgccgctacagcttccacatccagcacattgccctgtgggttgccaatcgtttcggcaaataatgccttcgtcttatctgtaatggctttgcggaagttctctgggtcatccgaatcgacaaaatgtactttaatgcccaatttcggcagtgttgtagaaaatagattatatgtaccgccatacagactggaggccgacacaatttcatctccagctcccgcaatattcaggatggagaaggaaattgctgccattcccgaagctgtagccaacgcgccagccccgccttccagtacggcgatccgttgctcgaatacatccgtggtcggattcatcagacgcgtataaatgttgccaaattctttcagcgagaacaaatcagccgcatgctccgcatcccgaaatccatatgaagtggtttgatacaacggaacggcgcgggcaaaggtagtaggatcaatttgttgtccggcatggacagcgagagtttcgaatgacagcttgcgttcttctgacatgattatttcctcccttgttatacgtgttgtatgaatcgtctcttcctgtatgcgtactcatggatgatttttcaatcattctcgcacaaaaagaacgatttgggaagataattctcattattcaggtaggatattataattttattgaaatatcaggtttcagatcggaaggttttgcccaaatgctcacccagaccaaagtaatggcggaaattatagatgagtgggctccattttgtcggatcaatatggttctcgccgaggatgatatcctgatgaacatgcacctggatagcatgagtttcgacgatcgcaaaataaggagaatggtcaggaattcttacatccttcactttggcttcaatttgaatagggcactccctgattcgggcgggcttgaccctattcgaatcaatcgaagttagtccactgatctcatacttatctttatggtgcataaatccatgtttctttttttccgctggaacaggattcttgcctgtataaggagccaatcgttctacattttcccacatcaaaggccccgggacgttgattacacattcgggatgccgctccatattttctaatgctttgccacctgttccaatgcctagtaccacacaatctcctaaagcccacgaggaggaaatggggctaatattggtcgttccatcctcattcagcgtattgagtaaaatcacaggggttccgtaatataaaatgctagggttaatcgttataacgtctgggctatgattcatctcattcatctgatgtattgggttcatcatctcttctccttctattcagatctacctccctattgtaaaatataaatatttcaaccttcatcgaagtatggattacaaagggggataaccgtgccatgagtaccaaatcaaatgtagccatgattgcttctcttgttagcgagccttcccgtgcagctatactcaccgctttattagacggcaggttccacacggcaagtgaattggcccatatggcaggcatcaaaccgcaaacagccagcttccatctggcaaaaatgaccgaggcacaagtcgttactgtggaaaaacaggggcggcaccgttactatggcattcaagaccccgaagttgcccgggtgatggagtcatttttatctatagctccgcctgtccctatccattcattcaaacatgcctctgaaaacgaggccctacggttggcaagaacttgctacgatcatgttgcgggtcaattaggcgtacagctcatgaattttttcattcaaaaggggattcttttcgaagatcaggacgggcttcatatcacggaaccaggagaggctttcttcactgactttaagattgatctaaaaaaaacaagacaaaagcgccgctccttctcacataaatgcctggattggagtgaacgacgccatcaccttgcaggtgctttaggaagtgctgttctagacagattattcgaattaaattggatcgagcgtctgcccacaacccgagcgatacgtattacagccgatggtaaaagaggttttaaagagatattttcgatagaagtcgactagatcatcatagttctagtccttttattatttggtattagattttatgactgggacaaggccattcgttttctcgtcattggacggacataggcataattgttttttggagcctttccttttgctacacctgctttatatcttccagctccagccgggatggcgaccaaggttccgtacgttctcatcgctcgttcaatcgggaaagatgtagaacgtgttccgtctgtagatccggcaaaatggaccgcggccgcatagttattcaaccgatcattactgtcattcaaccatacggaacccgaatctccaggcccagttcgtccctgggtaaaacgaatgaccgtttgatcacggaaaatcttgattcccgaatcgcctctcaccctttgttccacgccaatcgcctccacgactcctctggcgaagccgttggttttagccattcttttaaacgtcattcccagacggtagctcaataagtgcccaggtacggtaatgaggccaccactccagaacaataaaaaaggtgtgggctggaagcaaacgactgcttttatggatcaacctttcttgaagaactctaccatttctttaaatgattgctgagctgagtgtacgttatatcggggagagtacgggtcactgaatccgtgctgtccactgaatttatgtacccggatattacggttgtctaaagttgaaatgagctcatccacattaaatgatggttcttcctgtgggaaaaaaagcagtattggaccatgtggagctatttctaaataatttctaatacgagagccatagtatcctacgattccatcagcatacttttctttactacacagccaggcaatcgttgcccctatgctaaatccgacgataaatacctttttataacgagctcgattacttaataataaactttcgatatgatagaaagcgcggtcaaatcctacattctccataaaattggtgtaggcagtttcctcttgcgaatagtcataaggcgtttctttgcctagtaaatttggacaaatgacgtcataaccctgatctgataataggctacaaaaattttgtatatgctggttaatcccataaatctcatgcagcacaacaattagggtatccgactttttatttatgcttatcatattgtccccctaaccagttttgaatatgggaaaataattcatccggatacgcgtatttatacttagccgccacttccgaggataaccgtttgaacaactcaaaggatacgaccagtgcttcccaactatgattgggatcatattccccaaaagatttttttaaatcagcaacgacatcttggtcagcccattcatttatgaattttcctgcatgccaagtatcatattccgatccatgtacagcttttgcatgccactctatcatttgcagcaataattgtttacagtccatatctctttgcttagctacccacagatcattgcgcaaaatttgtttagccacatagagagaggcgaagcaatacatgttaacaacctgtagataagcaccttcagatatcggaggagtatacgggatcgttgtggattgagggatgatgtggtttccatttcccgtcttatcgagcagcatcctgaccccccgctgaaatccttcaggaatacgtccatttttgattatatgatccagatcagaagtatgacggaatagaaaatcaacctcagccccttggtcaaagagaacgagtttttccggatctccttttgccgttcgaaacataaagctggtccaaaccttgccgatgtttcgtaaccattgatcattttgaagatagtaatctggattcgttgaaaagacgactacatccaagtcagaaaactcatcaaaaggtttgtcctctcttgcccgggacccaacgatataaaccgcaataatttcctcattagagattccccattcggatatacgctcctcaagcacttcgtaagcattattcattacaatatatcctccttttttagaaaacattatatccaatccaataattacggtatatatttttagttaacattcaaaggaatgctgcctgatatacaccaatcatcaaatcaatttcccaatcttcagcctgtgatataattatttttaatattacagtttggaaggatggtggagatgtcggatcagcgggtatacatccggttctctgaggagacggacgccgcagagttggcagcaatgtacaagcgcaatcaagacttctttgataagttttcgccaaacaaccaagagaagtactatacggaggagtaccagctccagacgattattaagagcaaggccgacatgatggaggaccggaaatattcctttgtggtatgccacaaggaggacgaccggattataggcagcataggtctatcttttgtggtgagaggaccgcttcagagctgtatgatcggatacagcctagaccaagcatataacggcaagggttatacgacggaggcggtgaagcaggtggttcgctatgctttcgatgagctaaagtttcaccggatcttcggggaagcctctcctcggaatccaggatccatccgtgtgcttgagaaggctggctttcacaaagaaggcatctctcgaagcaacgtaaagatcaacggaaagtgggaggatcaccaggtactggcgattatcaatccatcagaggatatctagtttaaaaggaggatattatgaagtatcaatcaatcaaactgcatgaaaagttatctaagtttagtgatcattggtctccgaaagttattggtgaaatgaatgactatcaatttaaattggtgaaaatagttggggattttgtatggcacgatcatcaagataccgacgaggtctttattgtacttgaaggcgagatgttcattgattttagagatggacgggtacaggtttctcagggagaaatgtttattgtacctaagggggtcgaacacaagcctttcgcacatgaagagtgccatatcatgctagtagagccgagaggtgtagtaaatactggaggagcggagtcagaattaacggcagtcaatgatatttggatttaaatatataccgcaaaaacgccggacatttctcctttctgagtcctttcccggaatcgatgaggactccggcatttctcccatcgcaagaccctttccggctttgatcgcgaacgtttccataggatgcttaatgctgacatattggattttctatgtactcatacacgttagttggaagacaacagcggctgtctaagactttattcttcaggtcttggtctgccgctgtttgattttttgttcagtctaaagctttatttcactggatattttacagaaactgtactccttttactggactctctcagtgcatgatttctctcttattcaccttaacacctgataaggattgatcaaacatatcgagaataaaaaggaacctctccgcttcacgaaatacatgatcggccaataaaggatggataatgctttttattcggcactcgtcgattaaatcacgcgctgttttcttaaaatctcgcaaggactttacagagacacggttttcatcaacaaattgactcaggagtggaacggtttgtgactgtggccgcatatgacttaaatcaatcgcttgaaacatcagcatatcaaaatcattactaaactccctagcttgttcaaccagtttacgctcggatggatcaagcaaatggcctataaattttgcgtgatcagccatgatttttaagaaaaatacattttcgtcaataattgcatcgggtaatggttcaagctttcctgaattgagttctcctaaacggtttctgaaataattggcttcccggcttacgtgatctaccagtaaaggaaaattggtttgtccaggaagcttgcattgtaatataaggcccaataccattctcttaaatgcccaaatattcgtcgccgcattctgaacttccgtattaaactctttgattgtataaggatctgtctcggtattaaattcattcgaccttttctcaatatcctcaaaaatggcgtagaaccgattggcttctgttttaagttgagtatcttccgctcgaaaacctaaccccagaaaaaaggaatgctccttcatgatcctggaccaaaatcgtatttcatctaatgagcgtgaaacgaatgcatccaatcatatccctcctctatgtgagcaaaaaagcacttacttagtcatatgggatatgccttgtcattatgaatatcgaatcccaccctcatacaatctaattccgaagttgagctattgtgactcgtaactctgttgccttatttatgtacgtgaaatatttctctatactggctattgaccgtcggagttattagtcattctgggtcctctcctgatactaggtctattcgaaattcaagctggtctcgcataaaaattttacccgctatcttaactgattctggcttaacctcctctactactcccccataatcctcaaatgtcacacgcaattcctcatcaacggatacaacgtatacatgtgcctggactagagcagctccaaacaactccatgtctgtcttcaatactttatatgtgcgtttcacgatgatcacctcaaatattccattcggtgaacagtataagaactccttctatgacaaaaatttctttatgttcgtgttagcctttgttctttacgagattcaactggatgtcatagcgatcctctccttccaaccacagcagttcgttaagcaaaaaagtcatgccatccattgagcgtagctggtcaatggtttccgaaacaacctccatgaggtcacgctgaatgccttctgccaattgcagcccaccactgtctccatcgacgaataagcgtgtatgctctgggtgttctattctgcgtacatgacgcatccacaaacgtccgtcctcaatgtgaaagaagtagcgtccaccataaagcacaccttcatatatttcatacatatataaatggtcaaaaggtccatataccattgccgcccattctagtatggttgatttagtctccatttttctgcactccttcgtagtgttatccgtccaacttggtaagggcacctgatcgtaatgatagtgaatcgctgctacataacccattaggtaagaagggaatttagtgtttttgctatagagggggtaattgaagcaaccacaatttaacatatttatatcgaaagtacattgttataagcaaaattgggatttaaattgttaacagctgtgttcatcacatcaagaatatatactgcctcatgttcactcacgtagaattgcagatttacttgctgtacaataggaaagaatcactctgattagatgcgtattttcgacactacttatcatcaacgatgacaataacgagattgctaccatcgcataaatcaatgttacagtttaacgttatttcgttattcataatataaccatataacgttattgtcaacatctttttgcgttatcttttagtttcacttaaaatcaacacaagcataactaagcaagaatcaaggggaaggaacggtcggttatatgtcaaaaaaagctataatcgtggtcaagcttggaaagattctggagtcaaaaggaatgacacaagggactttatctcagttaacagggctacgcccaagtaccattagtgaaattgtccgtggctcccgtagtgttttgaataaagaccatctggcaaagattattgaggtacttgaaattacaaatatcggggacattattgaaattgattacatatcaaatgccaaggaaagtactgaataacccaaaaaggaccgcagatgctgagggtcctttttacgttgggacaaagcttctattattatagaacgatatattatcgaaaaggacattttgtcgatagtaaaataaactttaagttgaatccatcgtttactaaaacaatagaaataaatcccaaacacgtgttcttacttagcaaatagtgatacaaaaacaattaaattagatactcccacaactaaactggatgcgaattgctcgtataatattattgtaggaaccttcgttattgaagatcattaaatataccctcgaacaaaacagaatcaccagaaaaataatagctaaaagacaccatttgagaataaataatctccatataattcgttaagcccttctatctcaaagtatccgatcattatctcaaaaattcaaaccctaaattaaccctttatttatatatataggaattaatgtttagacaatcctttttggcttttgtatgtttaatgagtaaataaaacaaaaggggatttaacatgaaaaaaatatttttctcgctattatctatctttttattagcatctgtgtttgcaagttcttcttttgctagctcaagtgatgttaactcaattccaaaaatgacatggaataacattccttctggaattgctagtgctagtagcagttggagtgatagtcaccaaccatgggccgtatttgatcaatcccttaatgataacgggtggtctacagctgcaaatggcatccctggatggattggttaccaatttgaaaaaccagttgttgtgaacaaatatgtattacaggctcgtggaggtaataattacaaggctgaatctccaaaagattggacttttgaaggctgggatggagcatcatgggtggttctcgatacacaaaaaaatcaaagtaattgggatcaacctgtaaaaaaagaatttacatttagtaacacaaaagaatatataaagtatcgtctaaatgtatcaatgaataatgggcaaaatattctgactcttggagcttttgaaatgtataatactaacccagttgctccatctactacaccagatccatctactacaccggatccttctacaataccggatccttctacaaagcctgatccatcggatccatctacaaagcctgatccgtcagatacagatggggcctcccaaccaactggtgatcgcgccattctgactgtaacgatggacaatggatttgataaagaattcgatctgagtaaaaaagaactcaacgccttcatcgcttggtatgacgctaaagatgctggtagaggtgcttctttctttgccattgacaagcacaataacaacaaaggtccattcagcaatcgcaaagactacgtaatcttcaacaaaattctcacatttgaagtaagcgaatattcaactaaataaacatatgaagggcttcatgtcggctaacatgccgatgaagtccttctttacatttactgtaatctcgagatcacgcctaaactgctatactggacgatacattttttctagactaaaggtttgcaaatcgtttgtttcaataaaaaaagcacggcttccaaaaagcctggaagctgtgcctaagttaaataaaatactctcgaatgagtgtccgtggagtacaattcagtagtcttttccaaacagatagtaagactttacacttggcccccaactttgtttggattgagatcaatattttttgtgtacactttgttattaatgagactaatgatgctgttaactacaattgaagtaagtaccgttaacaacgttagccacaacaagatcaagatagataccttggggaagaaaacaatactctgaaaatagtaataacaaaaaaaggtgtgggttaaccaaatattcattgaatttttacctaagtaagcaaaaggtctggttagttttaatttattcattaaatgaatactaacgaggataaacaaaggggcaattatcatatcaatcgttgtcttctcaaatagttgactcgtggtacgaaagcgaaataacactacaattattataatatcaaacagtatgttattaaatatgatggaattataaatcttattcatccatgaatacaatttatatttagcaaagaacaaccctatcataaacggcagctgccaatacataatactgtaataattgccttgtgaatatgaattataaaaaacaagaccggaaatgagtagagttacccatgcgttacgttgaatggcttgaaagctgaccggaaaaattaatagcagtagaatataatcatataaaaaccaccactcaccattatatgaacttgagagcgctataaaattccgcaaaaaatccattattgaattatgctgaaatctatcagaatttccaaagaagtatagaccagctgggataaaaagcaaaaaaacaacccagtaatttatcattattttgcttaatcttgtaaagcttttctgcattaaatgatgtggattttgaacattgctcttatataatccataaccacttagaaacaaaaaaatagatattgctatttgaccaaaatgtcctaaataaaattcccctctttcatgaaataaactaaataatgaaacatagtcatactttaatctatcaggaaaagcgaagaggtgatggatcaaaagtagtattacagcaataccttttgcaatatttgtttctgcaagctttaattccttgtcatggtgcacacaatatcctcttttctagttgtaattgaatagagatatattagcacaaacaaaaaatataaaatatttatttttttaaatactatttcaccctccatttttatacaaagaaatgcggccccaaaaacctatagaccacgctgtgcctgagtttgtaagttattggtgaagtggataacccccgggtatgcaacatttcctaattttatagaatgatccatttatacaatttttatcaacacagtatatccttgttgttaaaacttaaaagtattatgtattcaacattaatattcgataataaaggtaacaagataaaatgagcaactacctcaaccgatgaggatactcacaggagaattcgtcatgttaaaaaaagttctatccattgctctactttctgtagctctaacagcttgtggaagcaattttaaagaaacaacgacaaggtctgggtcttcaagtacatcctttgccactgaacaaacaacaagcaatgaaaatactgctcagcaagcttctacagatcatcaggtcacagataagcaatattcatttgccgaattcatgaaggatgggacacccgtgttaacagaagatcaagcttctatggaacaaacatcttatgacttcattgttaaaaacagtgacttatttccttctacaggtaaaagcaaagtcattaatctagtagacaaatctgtaacaacaaaacacttaaataaaaatctgaatttatacttaaacaaatttgtaaaaataaccggcgatgtaatagacatagaagaagataacattcctatagggacaacggcgatcgtttatattagtgatgaaaatgataatacagtaatggcagtttatccgggagcaagtggagagatttttgaaggagacgttgctacagttattggagttcctatcgctaatttttcatatgaaaatgtttcaggtggctatacgaatactacattgttagcagcttcttttctcacgaaggaaaatcaataaattttaatgtgcttggcagcgtctatagcgctcacttaaaatttttcagggaactggtagtgtcaaaaccaaaaggttgccgatatgttgaacgcgaaagagaaactagccatcatcgcggagatcaaaagtggtgtcttaatctttattttccgtctaaagacatagtttgaataaaaacaatcccctccggccaagtatggttagcggggattgttaagttgtttttgagttgtatttacgattatcttttattgtggttttcaggctcgcgacgttttaaacctgccaatccaactaaccccaacaaaccaagccatccccaattatcattatcgtcatcattattattagtagttagcatttgtgttctaccattgtcgtttgtgcccatattgttttgactgttttcagcaaatgctactgccgctccaaagcttgaaatcattaatgcaacaacaaccattatcttcatttttttcaacatacctaaaccactcctttagatttgtgtttgcaatcaattttttaatgtatttagcatgcccagtagaacttatttcgtatacacacattaaatcttcactactgggaatcataaatttgtatatcaataaaattaaaaaaggagtggtttttataatgggtatcctaagcgggaatccaaaagacgagcccatgcattacggagaagtttatagtgtgtggcagttttcagcgttagcgaaaggcagcgtttcattttatcaagcatgtttaaaccacgcaggagacaaagagctcaaaaaagtactggatgatcttattgatcaagctaaactagaaatccaagaatgcgacgcaatgcttactgataatggaattgccccagctcctattttgcctgaaagaccgcctgtgaaacttgaggatatcccggttggtgcaaggtttactgatcccgaaattgcagctaaaatcgcattagatacctctgtgggattgacgtcttgcagccaagctatgggtcaatccattagagaggacatcggggctttatttgcgaaatatcatctaaccaagactgctttgggagtccgtattctaaaaatgaacaaagaaaagggttggctaatacctccccctcttcaattaaaaagacctgaaccagttaaagcctaaaattccagcataattcttcaacacactgttccttagatcgttcaacaaaaatccccgccgaccagttaaggtttgcggggatttgctttgcttacgtttaagcacctccgatggtaacttaaggctgaatactattgtggtggttataggcttgatccagcacagtaacaataaacaaaaagctagccgcgatgattagcagtaccattttttttaacattggtcatccacaccttttcgatacatagctggcatattacagcatcctgctaaaaagttgcagactaatctgaacggcgacgttaagctaacgagcaggaagttccaatatatgctactcaagtctcaagacctattcaccaaataattttaaaattgaatagattgttcacaatcaacattgatatgcggcgaagagggaatttaatcgaccagaagaggtcaattgttctctctcctattcagacatcttacaaaagaaaagcacgtcaaattactcagtcggaggaatcactattttgagaaagctatcattctttattaccattatcatgttaggtgcaatgttgtccgcttgttctgccattacatccaccgtggatcaagcgtctgcaggtgtaacgtccggcgagagcaaagaaatcgaaaaatacaatgcgtatgtgaggctgaataacttgatgacaggcagaatcaatgaggttctggttcattattttgagaagttcggagttgattcacagcctgtaatcgagaagaacttcagcttcatcatgctcggcgttgctgaaactgagcgggaagttattgataaagcgaacggctataccgcaagccaacctgcttttgcgaacgcagaccccgtagtgatcaaactgacaccagtcatcaatgatctgttgtccgtcctcgacgagatgaaagcctactatgatacaaagggctacgtggatgatgatttcgcaaaaggaaaacagctgcataccaagctggtaagtgccaatctcgcttacgagactgtctccaaacaatacttcacggctatgcaaaagttgggtaacgagcaacgtctggctgaactgcaaaaactcaaggattcagaccagcagatcaggtataatgccttgaagttcatgatagatgccgaggctacggccattgaaatggatgagcagggtatcaccgccgacaatgtgctgcagcttgatatgacgaagtttaaagccaaatacgacattatgaccgcagatctgagtgcgctcatgacaatctcaaaagacaagaatcgagttcaaaaagaagggattaacagcttcagtatcaggaactatgttgattcagccactgaggcaaaagcggctgcttcgaaagtcattgaacgtatcaataagaaggaacctgtatctgattctgacctgaacggccagttcctgaacactacggatggcacacctgagaatttcaattataagctaagcaaggcagtcgaacgatataatgaaataaattaagcgaatctacgataggggctgcgaaaacaaatacggagttccggtaacgaaaaagctctgccaaccataaggttagcagagcttttgctttaactcctccactggtaacttgagggggaatgctatgatggtggttaaaagcttgatccggcacattaaccataaacaaaaagctagccacaataagcagcagtaccgatttttccaacatttttatccacaccttttcaataagatttaaaagtgttaaaaaacattggcgattcaattacagaagagaaccctaaatgatcgctctaataggaggttttattatgattaagcgaaagatgacatcattataaagcagaaaagcgaatccaagggtcaattcaagtaaagaaaggacagggttcacttcagaccgccctgtcctttctttatagatgaggataaacgcgtgatcagtttacggttcgattcaaggtttacagatcgactctccagttgcccatcatcttggcgacttccgggtcgcggtacgataagaaaagactttcccgcgtatcgagggtcgaaatttgttcgatatcgtccgcactcaactcaaaatcaaaaatgtcaaagttttcaacgatccgctcttttctcaccgattttgggattacaacgacttcacgctgaacaagccagcgcaatacgacctgagcgacggattttttgtgtttttctgcgatcgagaccagcacttcgtttctgaacatgttgttaagtccctcagcgaacggggcccacgactgatgttgaactctctgctctttcataaaagctgcgctctctgtctgctggtagaacgggtgcgtttcgatctggttgacggcgggcacgatttcgttatgaacgatgaggtccataaggcggtcgggtaggaagttgctgacaccgatcgccttaatcttgccttcgcggtacaggtcttccatcgcacgccaagcaccgtagtaatcgccgaacggctggtgaataaggtacagatcgagatagtcgagttgcagcttcttcaaggatttggcaaatgcgagcttggctctctcgtagccggcatcctgaacccatagcttggtcgtgatgaacagctgctcacgcggtacgccgctgcgcttgatcgcacgaccgaccgcttcctcattcagataaccggcggcggtgtcgatcaggcggtaaccagccatcaacgcttcatatacggcgttctcgcattcttcaacatctggaacttggtagacaccaaagccgataatcggcattttcacaccattgtttaatgtcacggtttgcattctatttcctcccattgttcaaatgtaaagcaaacggccgcggaactgggaaatcgggcacctcagtgggattccgcttacggtcgacctgcattacaataaacctatcgccttcgtgttacacgaagtcaagccgtcttcaaaaaaatttacttttccaaggaggattccacatgtatacagtcaaagaagccgcccagataacgggactcaccgagcacgctgtacgcttttacacggataaaggcctagtaccaagcgtacagcgcaatcaaaacaacattcggatgttcgacgaagaatcgatcaactggttacatggcgtcaaatgtctcaaacaatccgggatgccgattggagtcattaaaacgtacgtcgatttctgtctcgaaggggattcgaccattccgcaacgctacacactcatgatggagcataagaaagcggcgctcgttaagctcgaagaagccaaacagcacgttgcccatttggaacaaaaaacggccctatatcaggccattctggaacaccgttctccagacacgaccaatcctggcaactgggataaaattcagcatatgcatagtgacgttttttactcgccttctgttcggaaggctagagatctacgtgaaacacaactactcaaagaaaatactcttttttaaactcctggttggcttaggatgaacaagatttacatcagtctagattgcactaacacagaggcgttagttcaatgaaaacagcgacagtctaggactttattttctccgtcctttgctgtcgctgtttcaatttctagagtcagtctaaacttattttatggaacctagacggtatgcaattcgaaaaagcaatgtgttgcttttttctaagtagactacaatgcgtcgttaggcaataggggcctccgcaattgtaatcatagttgcaatgaattgtatgcaagcatcttttgacaagttccgtacatataaatcgtggaatagcagcatattacaattgaccgctaactagaagggaactgtattgctgtggttgataagttaaaaaaatggctgtttaaacagccttcacgatccaaaaatggcaagagtcctaaaccagttaatgacgaaaaatcgaatgagttatccaaagagctcagtggtacgcttaaggacaacgtgaccatgctgaagcacgaaataggacatagcacggatttcattcttcgttgcttgaacgataaacagggtaatccggttctcgctgtagcttttcttcagggcctgattgatcagcaaattttaacgacactgctggaggagctcactgcaggtattcgaaatggggatctctctgatcgtaatgttgaaagttggttaatggatcgtattcctattggaggcatcacttgccttgaaaatgagcaagcacttatccatgccgttctttatggacaggtggctctccttgtcgaaggcagcaccaaggcctttgctgtttctatcagcgggggggctaaaagagcggttgaggagccaacatcgcagacagtaattcgcggccctaaagaggggtttacggaggatatatccaccaatatcgcactccttcggagaaggatcaaatcaactgaactccactttgattctcgaattatcggatcatatacgcagacaaaggtatcggtggcatatattcgaggcattgcagatccggaggtggttaaggaaatctccagacggttagactccatcaacactgacagtattctcgaaagtggatatatcgaggaatttattcaagatggggtatggacaccatttccaaccattcataacaccgagcgcccggattctgtagcaggtagcttgcttgaagggctggtagcgatattggttgatgggaccccatttgcgctgattgctcccgtaaccctttttcggtttatcgcatccagtgaggattactaccagcgatatgatttggcatcttttcttcggatcgttcggatggcatcctttttcttggcattgctattaccctcattctttattgcaacaactacgtttcatcaggaaatgctgcctacaacactgcttatcactctggctgcacagagagagaatacaccattgcccgccctgcttgaagcaatgctaatggagctgaccttcgaggttatccgcgaagcaggagtacgaatgccgcgtgctgtagggcctgcaatctctattgttggggctttggttcttggacaagctgccgttcaggcgggattggtttccgcagctatggtgattgtagtatcattcacggctatatgcaactttgtgctacctgcgatcaatatggcgggggctgttcgtttactcaggtttgtactcatgctgttagcgggcttatttgggttatacggcgttttggcgggcttggtccccatcctcgttcgattagtatctatgaattcgttcggcgttccttatatggtaccgatcgcacctttctataagagcaatatgaaagacctgtttgtgcgtgtaccttggtggaagatgaagaaacgaccggtaatgattggggattccaatccagtaaggcaggcaacggaacaggaatcatttgcagaacaggcaggggaacatggccgagatcccatggcgtaaggaggaaccggtatgtcccaattaggaaggttttttatggttctggtcgtgttattcagtttgacgggttgctggaatcgagtcgaactgaatgagctgtgggtaactgcggctacaggagtagatatgatggacgacggacagtggatgatgtcctatcaaattattgttccttccgccattgcaagtggaaccggaggaggatcgggaagctcttcccaacccgcatcccatgtattctctataaagtccaaaacctataaccaggccttatcgtacagcaatttggaaacatcaagacgaatctacatagcacataatcgtgttatatatatcggtaagagagcggctgagaagggaatggatcgtataatcgatttttatcttcgtaatacggaagcgagagaaatggtatctataattataacggatggactagcatccgatctaataaagaaattattgcctcctgaaaaacttcaaggcgccgccatggctgaattgatcgacaaagagagcgatagtttatcgttgtttccgaaagttagggtttatgatttcgtattgagcatgaactcggattccaaatccattggggtaccagtcgccgaattaatcggagagagagaccatgagaacgagaaggaagcagagagtctggatgttttaaaaaaaacctcgaccccgctcaagctggcattgactaaattaggggtgtttcaaaacggaaagcttaaaggatttctcaacaaggaagagagtctgggagtatcttatctgtcccaaaaggttaacaactccgaaatttcgttcccatgcagcgaacaactcggtagggaaatgtactcttctctaacagtaaattctgcagatgtaaaacttatacccagaaaaacgagttttcattacaccatgcaggttagagttaaaattaacggaactttaaatgaaagcacatgcactaaggatatttccaagacgaaaaccatacatgatatggaaaaggagattggaaaagaagtaaccagaacgataaatgagggctgggataaactccaggaactgggtgtggacgcaactggttttgctgaccggattcaccgaaggttcccaagggagtgggagacggtgaaagaagactgggagcaggagttcaaaaagatagaactggacattcgagtagatgcacggattcagcgtcctggactcctgcagaagcatatcggaagtcaaacctaacccattgtataaaggagcctaaacagtatgaataaaaccgtcaccagggtatccgggttagctatcgctttttccttgtttcaggttggcagtacaacattattcctattgggagctaaagccaagcaggatgcatggctagccatgctgataggtgcacttgcgggcttcgtcctgctaatcatgtatttatacatgcataaacttgatccacatcgagatttgtacgagctcctatgccattattggggaaaatggataggtagtctggggggacttttgttcatcggttactttgcttatgaagcttccaggaatgtcagggacatgggtgagctcggcgcattgacattgctgaacagaacccctaccgaagttattacgtttatagcgttaattgtctgtgccgatgtggtgtggtttggaccgagagtctggttccttctatgtcatatatttttgcttctgttggtgtttggttacggcattttactattacttactctttttactggacttattcacttagagtttttgtttcctgtattggagagcggtttaactcccgtattgaaggctgccattcccgagatcatatcttttcctttcggtcaaacggttctttttcttgtgctattcaagatcgtcacggataaacgtaagttaaagcgatcgatcatcattgtttactggttcactgctgtgttccttatcgttttgaatgaactatcagtccttgttctaggtccagattgggcagcatcaagcacctatcccttgtttgaggttactcaactaattgagctaccgaagatcgttgagagagctgatgtcctgtttacgatgattctatttattggactcggaatcaaaacggctggttttatgtttggtgccgtcatagggtttcaaacgataaccccctttagatataagcctgcgttactgttgctaagcatcatcatatactctcttacgtttctatctcctaggttaaccgaatttttgtggttcggtcttcatgtagccttggttcaagtctggcctatctttcaaattgctctgcctgtcctccttttcctgaccatgctaattcggaagaagaagagaagggcttatagttagcagctactgtagtcatgagcatgttgattttacgcaccggttgaaacttcttctacggaaggtcgtgtggcgaaaaacctgctaaaacaggatttcaaggcgcacaaacctaatcaaaattgggtcacagatataacgcaatatcgtgtaggggattgctgggtatatctgtctgcgattaaagataaatcaacaatgaaactgtagcccaccaactcagcaaacataacgacaacgaattgattgtatagacgttcgccaaagcctttgccaagcaaaaagacgtgaccggactggtcgttcacagcggctagggcttccagtacaattcggtgcggtgtcgatgatatatttctctataaatagatcataaaaatagccttctggtaaacccatagcctcagtaatgcgatctatctggttaacagacatagacttattccctgtcacaatagcacttactattcccctattcatgcctgctatatgcccgaattgcgttagactcatgccctcttgttttaagtatctgtctaattctgctcgtatcgtaggtgtatgcttcatgccatagccacccttcgcataaactttccatatttttttagaaacaaagaagattgtccagaatcacaaaaaagcgcgccctcaaaaaagcttggaagccgcgctgtgcttgagtttcatagaatgctggtgaagggaattgaacccccggcctacgcattacgagtgcgttgaaatagagttttgatgggttctacaaggcctctatagcctgtccaacaataaatagggttccgtcaggtattacagatatccgtatttcggtagaagatttggtagaagaaaataattgaggaaacaagtacaaggcagatgccttaatggtctcaagtccctccgtctcatctccagatccttcatagcagcatcctacggtcgcctgctgaaaactgtagactgaaccgcgacgttaagctaacgggcaggatagttcaaatacgtggtatcatgtggtgagtaattaatggagctcacttccatctgttaggctgtaaaaacaaacgcttgtgccgcctcaattatcactttttggtgactatatcacaaaaaagtgggtactgtttttcttgtaacttttcccccatactatcgttcataggaggttcatgaagcagacagagcatcctataccatataaatcattataaaaggagtgtaatagaatggggaaatttgacgggaaggtagcagttgtaaccggaggtacaagcggcatcggtctcgcgtcggcacaacagttcgtaaaagaaggggcttacgtttttatcacgggacgcagacaacgtgaactggatgaagcagtaaagcagatcggaaagaatgttacaggtgtccgaggtgacatatctaaatcggaagatctagatattttattcgaaacagttaagcgagaaaagggacacttggacattctctttgcaaatgccggactagggtcatttcttccattaggagaaattacagaagcacaatactacaagactttcgatgtcaacgtgaaaggaaccatctttacagtacaaaaggcattagctttgtttccaaataaaagaggttcgattattctaacgggatccactgctggctcgacggggatgccagcgtttagtatctatggtgcatccaaggcagcgatcagacagctcgtccgcagctggattcttgatatgagagggaccgaaattcgtataaacatccttagtccgggaacaatcgtaacgccggcgtacgatgagttatttggctctgaactagatcatttactggaacaggcaaaaaatgatattccgctcggcagagtggggcaggttgaagagatctccaatgctgtcatgttcctagcctctaatgaaagcagctatatgaacggcgttgaattattcgtagatggcggagtagctcaagtttaaccaggacataataattttcaaacgacaaagatttttaaatcaacttaaatgcgattgtattatcccctccatgtaacgttcaatttttccttcagtgatccttgaaggatcaagcgatacatgaaggggatattcttagatcgggagatggtgcattgatatgaaaacatttttctgtgaactggaagttacactagaggttatcggaggaaagtggaaggggcttgttctgtactatttaataaaaggacctaaacggacgggagagcttaagcgactcgttcataatatatcgcaaaagatgctgattcaaactcttcgggaactggaaacagacggattaattcgcagaaagatgtacaatcaggtaccgcctaaggtggaatattcaacgacggaactgggtcaatcacttgaacccattttgagatcgctttgtgattggggggggaattacgcagagcaatccttcgctccgggcgagattgagattttgtatctggattaactgtcgggggacaagagcatagtcccatttgaagtcgctattttagcggcttttttgtttgaagtatataagtttttgtcgtttatctgtgtatgtctgcaagaaattattttcttgactgtttagtctcgaaaaaatataatgatgatcaaaggaggatgaaattgggaagaaacaaagagtttgatacgacagaagtactgcataaagctatggaagtatttggacattacggctatgaagggaccacattgcctgagctgttaaaaggactcggtattgcccggcaaagtttatacgacacttatggtacaaaaagagacttgtttattcttgctcttaagcattatgttaatgagaagagtaatgcagccatgaagtacttagagacctctgaatctgcaaagcaggggatagcttatgtatttcatgaagcagcaaaggtattaatggacaaggatcgtcaaaaggaatgctttattattttttctgctattgatcagatgcctcatgacatggagatccgagcttttttattaaaagatttgaacacgctagaagaagccttttatacagctctagttcggggccaggagaatggagaaattcagagtgaccgagacccgcgagccttggcgcgttacttgaattttgcaagatactctttgacccaattggccaagatgacgagtgactccaatgttatggatgattacgtcacggtaagtttatctaccttggattaataatggagctgtatcatggcttcattattatttttcgaaattacagactgaatagtccgatattatttttttaattattccggactaaacagtctacaaacaggagagatgaatatgacaagtggatattttcttgaggcccaggcaatcgaaattctaaagggatttcagagtagcttagtaaagcaggattttgatcaatggttcgcgctatttagtgaagatgccgttgttgaatttccttatgctccagcgggttatactcaaaggctggttggtattaaagagattcgtaaatatgtttatgagctgttcaaacaagtgagaatcctctctttctcttctccacatctgttagtgactaatgataaaatggttgccgaatatacatgcgatgcagtaatgacaggaacagataaaccgtatcggcagcagtatatttccatattccatataaaagatggaaagataacgctttttaaggattattggaatccaatcgtcttacttgaagccgtacaagcttaggtttataaactgatatctaaaaggagataaaataaaatgatgaatcaacgaaatatacttattacaggcggaacaggaaagacaggaaaaagaattgtagaaaggctgaatcagcagggatattcctataaaattaccatgaggaatgccgaagccattacagcccctgagaaacaagtccatttcaactggtacgacagttcgacgtttctccctgctttgcatcatattgaacgagtgtatttggttgcgccagtgggggatccagaacccattaaagtaatgaaaccatttattaaaatggcgttggaacagggcgtacgtcggtttgtatttctcagcagcgcatcctttcctgaggaaggtccggtatttggtcctgttcatcaattattgaagaaattagcgccggaatggaccgtgctcaggccttcctatttcatgcaaaatttcaccgaaggtcagcatgcagcgaccatctcacaacaggatttgattattagcgcaacaggacaaggcaaagttggttttgtcgcagctgaagacatcgcagaagtcgcttttagagcacttattgatgaggatgcacataataccgagcatatcattacgggaccgaattctctttcatatgatgacgttagtcgaattattagtgaagtaacgggaagaaaggttatacaccaatccatatctgatgatgaattgacccgcagttggttagcagcagggataagtaaggattatgctgaaatcatgtccagactcgaccgtaaaattcgcgaggaaggagcggaagatctaagtacagatactgtaatgagggtaactggaaaagcacctgtctctttccaacaatttgcacagagacacgcaaacatctggatgaaggaattgaccaatactatgacattttagccaaactcaaacagcgtggattaattcgtaattggcgcacgctggcaccgggatctgcaaggtactgacacggtatttgttctttgcacgatacggattgatgcaagcggccaaaatgagagacaatccgcaggtgttattcaaatatttacactgctgaattcaaaggcctaatgaagtttagatttcaaccattttttcatggacctgacttcttcaaaaatcctttgagatggtacatcggagattagtgatatcgcagaaatagatagaaagttaattgaattcgtattgataaatgattaagctaacgggatacgttagttcaatgaaacagatgaagcagcgacagtctagggcatattttctcgtcctagcctaccgttgtttcttttattgtagttatcaaaactttattttctgcgaacatttaaaaagtggattcagagcaccttgaatgcacatctgtaaacaattttcatctaaaaggctatgcggaccttaaggttagcagagctttttgtccactctaaattcaaattgattccgtatgtaatacgctccggcaatcttgactgaatcaggcgaaaacttttctatagtgccaccataatctacaaccgacaccatatcctctctcaacgactgaacaacgtacactcttgcttgactcaatgcagctgcaaatagttcgatatccgacttcaacactctatatgtatggttcatgctgatcacctcaataattcattcgatgaatgatgttgtaatttaatgaaataatccccgccaaccataatccctattttcatcgttatcagtttggtgccttattgaagcgacaatttttctttcaagatctttttagtaaggcaggaaaaccaaaaaagacgttcccatgattatccgagaacgcccttagctttattttattcggatgtttgaagacacctcttaaataacagcattaaatttcttgcggttcgcccgttttttatttctcacggacacccccagttcgatttttaccgggcatattttacgggacttaggagatgagtatagctttcttttactgctccattttattgcatttctgtaaccttcttcactgcgaatatagagctggaaccgctgcttatagacgattcttttttttctaacaaccagacaaaaagttactcggacagggctgaagccaaacctgacggaaccattcctgccgtgcagagccagagggacccatctactttcaccggaaccgattgaaaaaacagaactgcctgtcagaatatttttatccttcatcctgtattcacctgaactgtcgctttcacacgatagattcccggtggcaaatcgccaaacaggtagagtcccccctgattcgtacgcgtaatctggatgatctgttccactcctgcggtcaaagtatagagtgccactagcgcattgggtatagcaacaccattcgcttggtccgtcacgataccacttacagtccctgtattggcatccggatcggctgtcagattaatatcaagggggacatactcaggactttgaattgttacagggacactttggttggacaaatatccgggtagaaccgcctgaatgaaataggtaccactcggaagctcagcaaacaaatactgccctgatgcgttggaagtcaccgttccgatcggagtaaccgtagtcccatctgtttggaatagactaaccaaagcattattcacgggttcattattggtaatattccttactataccaaacatggctcccgtcgttgcggagagatcgggttgtaaagtaatagatacttgtgttggtctgccttgtgtaactgttaatggaatacggacaggtgtcagatagcctggttcagatgcagtgattaaataagagcctactggaatgttaggtatgacaaatagcccctgggggttactgttaacatgctcatatggcaccccttgagaagtatatacctgcactgtagaaaaaggaaccggattcccattaggcaggaggattgttccctgcaccacaccaacggaggtgctgggcgaggcttgaagttctagattgacgctctcttctccgtgcccatccaaggtaactggagcacttggctgaaggttgaacaagtcggaaattggaataaccatgacctcctttcacaagtcttacaactcaatatatgcttgggagttcataatcgactggtcaaacaaccttactcatactttttttagcattagtaacatgatgaggggctgataatccttatagacaaccacccccatagtaacagccaatactgcgcttactattaatcctctgaaactcttcaattttcatccccctaaacgtaaaaacaccccaccagcacagctagcagggtcatttagacgtttttaggagttatactgagtgaaagacgtgtgtgatccaacagccttttcttaacaaaatcaaatccaaagtgatttagtgatgatcaccaacaagataaagagcactaatattgctcctgtagaagtccacgcaccaccaacagctggacctgcactgttaccgttacctgtaccgcaactatcacctgcatataattcctttacttgttgtacaccttaatatatgtataactacgttctatgaccgggtattcaggtaaatagaaaaaatccccgccgaccaattaaggttagcggggattttggggactgatgtttaagctcctccaatggtaacctgaggctggatactatggtggtttaaggcttgatccggcacagttataataaataacaaaaagctagccgcgataatcagcagtaccgtttttttcaacattagtcatccacaccttttcaataagatttaaaaaaccagctttggtttcaggaacagcatgatcccgaaaatgtaaaaatagccccatacaattaatgaaataagtctcattatttagtgtatgataacttaccgttgaatacatcaaatgtttaaaaccatcattgtaggagcctcgatgtaaataataataagctaactcgtaaccaaaccacgcgatatagtccggtatcacttgctgtgtatacatatcatcggatagaggatgttcagaaaacgaattaatctccgattcaaatcgtttgagtacatcgtctacatctatgctatattggtttgcggcaattataacattgagtagttttgatattttctcgttttcgttagtcgctgatgtggctacaatatattcaacataatcatgcagcacatttatatctcctgataaaagtttatatacgtaagtattaccttctgcccaacttttgaacaagctaatccagtgccgggtatcttcatcagtctccattacccaatctaaattagcgtaggtgtatgtatagtctagagcttgttgataatcgccttgggcttcacagacgctagcacacaacaggtcagcataggaaatgtatacaaacaatggacggcttagcttatcagcagagtcagtgtgttctcgactgttctgttgatgtttcagtgtatattggatttcggctttagccctcattttcttcgccatttcgtcaaccttgtcccatttacgcaaagacctgtatacgttcgctaaatcctttaaagcatcaagttggtctatttcatcaaggcgctcaacaaaaacttcaaaaatcgtagctgcactaagattacggctttgatcgtctccaacttgaatcgtgaatatacgatattgacagatggctaagcgctcagaatgttggtacttctccgtttcagctaccccctcatagagcagcaatgcagccgcatttcgtgcctgtgcgaataattcctctgcaatgtcaaatagtttgggcgaatagagtagattgtccatgatagctcccaccactctacggatcgcatccaacttgtccaactccgcacagcgaaacaaaaatggctcgattcgcctcatattcggaggatggtcgatgatgtagttttctatgaacaagtcataaaagtgaccttccggtaaacccatagcctcagtaattcgatccagttggttaacagacaaaggcttgtttcctgtcacgatagcacttactgctcccctattcatatccgcaatatgaccaaattgtgttaaactcaatccttcttgttgtaggtatctgtctaattctgctcgaatcgtaggtgtatgcttcatgccatagccacccttcgcatagaaattccagtattttataatcatttactatttttgtccagtaattaacagttgtcaatatcttttttgcgaatcatatagaaaatctgcgtttgtcataaacgcattcctataaacaaaaaaagcaccccactggctttagccagcagagtgtttcgtatttccaaacgcttgtgattattcctcattatctgtagttggactgtcagccgacttaccatccacataagcctcagccagaatgtaagcaatcactgcaccgaatgcacgacattactatcgtattttggacacaatcgtaaaagagcaccctgactttccgcggattcgtttctatgatctaagacacgctcataacagggaactcatgaacactgaaaaaaacactttactatactaaaggttagaagattgcccagaatcacacaaaagcgcgacctccaaaaagcttggaagccgtgctgtgcttgagtttcatagaatgctggtgaagggaattgaacccccggcctacgcattacgagtgcgttgctctacccctgagctacaccagcaggtcagtgtaactgacaacaaaaactattatactcttagtgacataaaaatcaatcacttacatcactttttcaactaggatttggatttagttcagtaacatttcctgtcgcggtgccagatagtttctctgcgacggaacggagcttttggtgactggaggaaggcttgtcacggcgatcatcaattttgaccgaggtggaaacacgcttagctccagacaggaatggcgcttcgtgcagcgcagcaatggcggtgaacacatcgtccaacgaaccttcaataatcgtactcatggaggtaagctcataggtaattcctttttgcgtcttcaacactttttgcatctgggcaacgtagtcgctcaggcttgtactccccgtcccaatcgggatcactgtcacttctgcaatagccatcgccaagttcctcctttaatttaaaatcgtcgcttctttaaaaatctaaaatttcagtccgatagagcgagcaacctgatttcacaaaaatagttcatatgtatgctgcttgtttctgtaggaaacactctatcattcattgtaccgttcaaactgcctcaattcaaatacagcccgcgacttctctgcatattttgattttccattccttttcctttacgtatggcttcgaatgttgctataatactccttgcacttatttgaaattttaagtttatatacacaatatgttgggttaaatattcataacacgtctaaatatagtgatgtagccgataaatcgtacgggaaccatcttttcccccttcattggcaggtgcatcgctatttctatgttattggattacatacagcccccaaatgctgtctgaccatcgcttttttcgccattatcttctcatcatgatcattttcatgcctattcccaagtatgattccaaatcaggaaagcgaggaattaatcctatgccacaactcgtaaccaaaccaaacaatcgccagttggcttttgatgaaatacgcatttccgtatatgccgaccgtgtactcagcgggctggacaagctggataaagatcgtctcattcgcggtgtaactagcaagctgcgccgggacgaagtcacgggggatgacatcagcaacgcgtttgcgatggctgcccttgaactggttagcaaggaagaaccggactggaaatttgccgctgcacgtgctttgctcacttccttgtataaaaaggcggccactcaccgccgttataaatcctatgcggacgagccttacggcgctttttatccactgatcactgatttggtccaaaaaggaatttaccgtcaagaactgctcgactactataccaaggagcagattgatgagttgggcgattccatattgccgaaaaatgatctgctgttcgattatatcgggctgttaacgctgtctgagcgctatttggccaatgattttgacggacgcgtaatggaattgccgcaggaacgctacatgatcattgcgatgtacctgatgcaccaagagcctgccgacaagcgtatggagctggtcaaggaagcatactgggcgatgagcaacatgtacatgacagccgctacaccaaccatgtccaatgccggaaaaaaggtggccggacagctctccagctgctttatcgacaccgtagacgactcgttggaaggcattttcgactccaatacggatgtagcccgtcttagcaaaatgggcggcggcatcggcgtatacctcggtaaggtacgggcgcgtggctccgatatccgtggacataaaaatacaagttccggcgtcattccgtggattcgccagttgaacaatacagctgttagcgtagaccaattgggtactcgcaaaggtgcaattgccgtatatctggacgtattccataaggacatcctcgcgtttcttgacctgaagctgaacaacggtgacgagcggatgcgtgcacatgacgtgttccatggcgtatgtctgcccgatctgttcatggagcgggtcgaagcacggggtgaatggaatctgttctgtccgcatgaagtgaagaaagtgatgggctggaaagatgacaacggtcgtccactgggcctggaagatttttatgatgaaaccttcggttcaggtaccttccgcgagaagtatgaggaggcgtcgcagcatcccattctctctcgtattacagtgcctgccatcgacatcatgaagcgcctgatgaagtcacaactggaaacaggtacaccgtacatgttctaccgtgatacggtaaaccgggcgaacccgaaccgcgcccatggtatggtatattcctccaacctgtgtacggaaattatgcaaaaccaatctgcaactgtagtagaaaaagaagaattggtcaccaaggacggacaaacacgcatcgttatttccaaaattcctggcgactttgtggtgtgcaacctgaattccatccatctggctcgtgcggttccggcaggtgtgctggatcgcctcgtaccgattcaggtacgtatgctggataatgttattgatatcaacaatattgaagtactgcaagcacaatatacgaacagccaatatcgcgctgtcggtctgggtacatttggactgcatcatctactcgcactggaaggtatccgttgggaatccgatgaagcggtaacctataacgatcatttgtatgaaaaaattaactacctggcagtcaaatccagcatggagctagcgaaagaaaaaggccgttatgccaaattcgagggttctgactggtctactgggcactatttcacttcccgtggctatacggatggtacacgtgaaggcaaatttgtcactacgtccgagtggagcgagcttgcagaagaagtcaaacaaaatggtgtccgcaacgcatggctgttcgccatcgcgcctaacggttccacgtctattattgcaggctctaccgccagcattgatccattgtatgagctgctttcctatgaagagaaaacaacttacaagattgctaaccctgcaccggatttgaacgaaaaaaccatctggtactacaagacggctttcttgctggatcaacacgcttcgatcaacatggcttctgcacgtcagcgtcatattgaccaaggccaaagctttaacctatatgtacgtcccgatattaaagcaactgaatttttagagctgcacatccatgcctggaaatcaggtatgaaatcgacctattatgtacgcagccgcgcactgacgattgaagaatgtgatagctgcgcatcctaaactaaaggagagaagctctcatgcagttacagaagatttttaacacggaagcgccaaatcgctctacccgcattattgaaggcgaaagctccggtattttgaattggaacgatattcggatgccgcatatgtacaaattgtataaagtgctgctgctgaaccactggattccagatgaaattccgatgtccaaggacgcgtcccagttccctgtgctggatgccgaagaacagcgcaccttcaaaattaacatcggcctgctggctgtactggattcgatgcaaacaatgtttgtcggggatgtaaaacgctattttaccgactcgtcactggaagctatttcagcgattatcgggcagcaggaagtggtgcataaccagtcctactcctacgttctgtcttctttggtgtcagatcaggaacagaaggaaatttttgaatattggaaaaacgatcctgtcctgctggagcgtaacacattcatctcggacatttatcaggagttccgcgatgagcagaacccacaaacctttttccaggcgatggtagccgatttgattttggaaggcattttcttttacagcacatttgctttcttctacaatttggcccgtgatcagaaaatgatggcaaccagccaaatgatctcgtatattcagcgtgatgaaaatcagcattgctacttcttcgccgaagtgttcaagcagctattgtccgatttccctgagctgaataccaaggaaaatacggactatgtctatcgtatgattgaccgagctgtggagctcgaaacgaattgggcgcattatacgctcaaagaggttcgcggcatcgacttgaacgagctgagcgattacatcaaatacatggcaaatatgcgcctgagactgcttggtatggacaaagcgtacgaaggcgtagatgtaaactgtatgccttggatcaaaccattctcagatgaagcgctgaatgcgacaaaaacggacttctttgaagcaaaatcacgcaattatggcaaggtcggagatgacaacggatttgacgatttgtaagtcataagatacagccttagcacggtacttaccgggctaaggcttttttcatgagaatttacgcaaatacgcaaaaaaatcatgaaacatctaaataactattcatattttcctatttgtacacgatatatatgaaggtgaaaaaaacatagtaaggagcatattatgaaaagcagcgttaaaaaaagaataggattacaatccaaactctacttcatcttgctcattcctttaatagtgattggcgtcattgttctgtggacgaccaatcaatctatccagaatgcttctctatcaaccatgcagctaaacaatgaaacgctggcaaagaacacggcccagctattggacaaatccgcagtcaagagcttaaatactgattcatctgagcaaagcagcgagtataaacaacttcggaacgagttaaatacgctcaggctgcaaactggaatcctgtacatctatatgtacaaccgtgtgggcaatgagtggaaaattacggtggatggagccgcatgggacgacaaagactacagtccattcggaacccctgtaagttttacccttaaagaaacggaagagaaattgaaacaaggggaaacagtgactacagatattacaacggaccctgagtggggaacgatgttttcctcctttactcccattaaggatacagatggaaccatcattggttatttgggaatcgatagatccctgtcctctgtgactgaagtatacgaacataccttgcccgaggcctaccgattagttattcctgttatctccatcattctgatcatctccattgcggctatgatgctggtaacccggcggatactgcgtcaggtgagatttattaaaaatacactggagcaagtagccgacggcaaccttacggttacatcgtcgcaagtaacatatgatcagttaggcgaaattagcaaattgacgaacaaaatggtggaagccatgtcgaatatgattgtggatattcaaagcagttctagcacactccagcatgcatcagagaatatcgtcgtgacaacggaggggacactccaccaaactgaggaactgtcccgcacactccagcaaattgccgatgtctctattaaccaagcggatcaagcagtggaatcggttcaacaatctgaccgattaggacaaacgctggatgaagtcggaagccatgtgcaacaatttacggatacggcccatcatctcaatgaggttcgtaatcaggtaaccagtgagcatgaactgctattagagaaaggacgagaaagcgccctgcgtatcaagcagatgcagcgtatgtcacacgcattaaccgaaaaatcgcgcgaggcggctaacatcggtcagcaggtacagggcatcgtaaagcagacgcagattttgtcctttaatgcatctattgaagcctcacgtgcaggcgaagctggcaagggtttttctgtagttgctcatgaaatgggacaacttgctcagcaatctgccatatcgattcgggaaatcgatgaaatcttaagaagctttgttgagcaaattgagcaaatgggtgatcaatttgatgaaaacataaagaccgtcaatgaacaagaaacccaaatttcagtatgtctacagtctgttgacaaagtcacccaggtttcacaggaagttcaggagttagccgcacatctatctcaattgacggcagaaatgcaagaggtacgtcacagcgtagatcaacatttaaatcacacagccagcgcggcacagcagactgccggaatgacagaagatgtatcagcaagcgccgagaagcaggccctagcggtaaaagaactatccgaagtagcccgcaatctcacgacactatcaaacaatctgcagcgtcatgccgaccagttccaggtaaaaaacgctgaatagtgaatattatgttggattcgattcaactagacgaaaagaagtaaactaaaatggagcattcgctaacgtagcgaatgctccattattatgttttgaaagccgagcagggttcacctttatccgagtaggtgcatacatataacctagaagtgtgatttcaagcaacccagaatcatacacgttcttatgatggaggtagcgccgctgttttcacctgtttcgtataagaaggataacctcccgtatgctggagcatttcgatttcacgcaaaatacgcggcaagtcagcgaccgagttcatcacgatgtgggctcctgctcttttcaaaccatatacactctgtctgcgtcgttcctcagccactctgtcgtccgcttcatggctggtcgtttgagctgcggtcgtcacgctttcgttatggttcaaaacaccaatcgtccatacaccggcgttccgtccttcttgcatatcggctgctgtatcccctactttcacaatatcgctcagcggaaatacctgcaagcgatgtgcaatttcatagatcatccacggataaggtctcccctgcgaaacttcacaaggggcaaccatacaatccagcgtatagggggattgtgcaggcgtaaatacgtgactgagcatctccatcggacaggatgcagtggcacctgactgaatgcgacgatcctgcaactcctgcagcgccctgtctataccgatagcaggctcagccccttggatcaaggagcggagaacagggacaagctcaagataaatatgctcaatatccactctgccaggatgcgcaccaaagcactccagccattttttccgaacctctgaaagtcccagcacatttgcaatatgatcccggatcggcattcctcgcccatgagatacctgttcttcagttacctgtatacctttccatctgaaaatgtcacgcattccctgggttaagcctcgtcctccggggtctaacaatgtactttcgagattaaaaataaccgcctgtatcatgcaatccccgcctttccgtaccacggctatccgcaatctttattttgcttaggaacatgatacacagctaacgtaaactgaaatgtcgtaaacggtaagcggattgtaattgaaaataaattccttgattggttatgaataccgagtgtgataagaggaggagtcgcaacatgagacagccctggaatgaatttaattccaaaatgccttggcggatggagcttggttgttatgcgctgaataaactggcctgtggaggattggtttttggtctcttatggatctactgctatctgacagaggaaataacagggattcctctgactatagcaggcaatagtggtgaactgaccgcgcagctgtgggcctatggttttgcccttcctgccgctcttgccgctgatgcgctacgcgatcttttaccctggcttcgcaagcccgagcagctcaccctatacctcgctgcaggattcagtgtctttctcctactaggttctttgatgtcgcctgccggaacgggcattttatggagcaacggcatagcaggtgcagggattacactgctgtattatggaggaaggcactggctgaaccgtgaatatggattacagatcatgctggccttcctcctgccactgctgctatggcctatagggcttcaataatgtcgccagcgatcacagaggcaggatgctggcgatgacgtgcggctgtttctccagccgcaccatgcagatacacgccaaacgctgctgcctgggaagcattcaagccctgagccagcaaacctgcgatgatgcctgttagcacatcgcccgcaccgcctgtcgccatcccagcatggcctgtggtattgacgtaggccgttccgtcgggacaagcgatgaccgtgcgcgctcctttgagcaccagcgtgaccccacgtgtccgggcgtactcccgggcatgggtgatgcggtcacgctgcacctctgctgtcggtatgcccagcagacgagccatttcaccggggtgcggcgtcagtacgaccgccgcacttctcggcttccaagcctccagctcaggccccgccgaggcgaggatgttcaaggcgtccgcatcaagcacgagcggaccgccgtattcctcccacaggcggcgcagccagcaggtgtcccctgcaaagcggccgaggccggggccgacggccagtacatcacgtgcctgcgcgagctgtagcagctcgtctgcggagtcggcattccattcgccgtctccacctgctgctgcggcagcgagcatcagttccggcgcggcgccaatgacgcgcggcaacaacgcctcgggcaccgcccacgtgacaaggccgctgccgatgcgcagggcggcacgtgcggccagcaagcccgcgccgctcatgcgcaggctcccggccgcgacgagaacatgaccgtaggtgcccttgtgcccgtccggcacgcggctgcgacttacatctacgtccagcgcagcgcgcagcgtgtcacgggtcaagagccgcagctgcacgccgcactcacgggcaaggccgggtggaataccgatgtagcgtaccaccacatcgcctgcggtcccggcgcccggatattggacgagcccacgcttcaagtaagcgaggcatacggtgacgcgcgcacgaatgcacggctcgtgcagcgcacccgtgtcggcgtcgaggccgctaggcacgtctaccgacacgagcggcgcgccgctggcattggcctcgcggatcagcgaggcgtagggttcgcgcggcgggccttgcgtgcccgtgcccagcagggcatcgacgatgccggaggcgccgcgcaggtcgaggatatcccggccatagaggatcaccgggatatccagagccgcgatgatatcgcgttgcgcagccgcttcaccgcgtagcgtgtctggcggctcgacgtacacaacggtgacgcgtagccctgcatcggtcagatgacgggctgccaccagtccgtcaccaccgttgttgcctttgcctacgaggatataccagtgttctcgttcccgtaagtcatgtcgtccttgactccacgtctctgtccgtataacaccgccatgtcccggtatatcccccggccctgtgtgtgtaacctcttctgtccactgcgaccccaacacttcagcacgatcatttccacgtgttagatcagcagtgcctactgagaagccgccgccattgctcttcccacttctttcggcacatagcttcaacacctcgtaagctaccgcgcgcccggcattttccatcaaggtaaggaccggaatacccagcttgtcaattgtatagcgatccaattctcgcatttcttcggcggtcaccatatacatgcttttcgcctcccgtatagctatccctgcttattaatatccaaccgtaaaacgggaattgacaaactccccttctactaactcatcaatcagggctaccgcataatcttcgaccgagatacggctatggcctaattcgtcaaccaccaaatgatccaaaccaatacggaactgtcctgtacgttttcccaattcaattattccggcaggactacaataggtccagtctacatccgcagcgcggtacagctccagtgcatctgcatgggcagccgccagtggcttcacttcctccggaaactcggcggtatccatgaggcgttcaccgttttctgttttcagacttcccgctccgccaacgacaagtatgcgctccgcgccggaacgccgagttccttccagcaaagaacgagtcgcttcgagcagttcttcctcttctccaaacttgggaccgtatgcgctaatgatagcatcgtgccctttggccacgtccgtaacggaattcggatttaaaatatctgcttgaaccaccgtcaaatattcactttgctccgtcacacgttgcgggtcgcgcaccgccgccgtcacttcatacttacgcttgattgcttcctttactaacgcttgaccaatggttcctgttgctccgaaaataataactttcatataaatgtgccctcttcctgtctataatttacttactgttatttatccgttttatatccagcctaaacccgtacagcatgtcagcttacagtccccccggctgtcgccagtacatcccttccgacctcggactgaccaattggaagccgaattgcgcatacaagcggtcggccggcttatccgcgatcagtgtcacaaggctgcccgtacggttgattcgatgtctcatgatgttctgttgcaatttctacatttttatccatgctgaatctcctcctgcttgtaatcttgtctattttaccaaaaaacacttcatatatcctggtcaaagggatacaagcccttgaaatgcctgtatggtctgtgcaatagtgtagaaagaacaatggaaggagggattgcgggtgtccccgacggacttcgcggcgttagccgcatatatctcacccggtctgattgccttcctgctggcgttgtctttgctggtatggctgtatgttcacagtgcagcccagcttcgaaattcacgtcagcagcggctggaagaattacaggaatcgctgcgtatttatggacgattagctggttgtctccaaaccgctacccagaacgggttcaataacagcgaaaagcagtaccagaacggactcatccacgctcttcaggaagccaaagctgctccctatttgacccctcaccttcaagagcaggttcaagcatcccttcgggagtgtgatacattccgcagagaattgcttctcaaatcactggagcgtgaaatgaacaaactcatcgaggaacggcgtcttgttctgctggaatctcatgctccgggctggggaacagcattgtggaagctattgcgcccagcagctggtccgttggcgctggcaggaatcgtctggttggtcacaaggctggttatggaactgatagcctccagccatgtcgatgttagtctgcccgatactgcacaatctgcctcatggctcatagggtgtgcatggatgaggttcgtttccggcttgatcgctctactgtatgtgtaccgactgatgaccctgcgcagacaaaatgatctggacgtgacggcatcccattttccaacaagcctgttgtgcttagtgatcgccgctgtcgctctgtttcaatggatcggaccggaagcatctccctacatactggctgttcagcttgtgctgttcttgattggcttccgacttacccgcggccgctcgcgcagtgatcgtccttatgttggtcatcccggcttgatcaaggcagattcttctcaacatcaggatttacacgcagcagataaagataaaacggctgactcttctttggcagaagaacatatccggtcctaaacaccaatagcacaggattctattcccgtatccaccctgcaaatcacataccatcacaggacatcccaacaacaaagaaagagattatggggtgtcctgttttttgaacaatttttggctttttgaggggttaggcttgtgccagtgatcaaggaaagggtatattgtttatataaatgtaaatcatatcgttttttatgtatgaatattgaaaaaaatccatatatgttaaactaccatcaatttatgatgtgcgttagaattggaggaactatgcaactggacatttctgaaaaatcacttcccgtttatgaagcgctggccagtgaggttcggctaaacatgattgttctgcttgcggagaagcctatgaatatacgtgagctggcggaagcgttgggtctcagcagtgcgattatgacgatgcatgttaagaaactggagagagcgtccattatttcgaccaaaatgctgcctgggcgaggcggagtacagaaagtgtgctcactggctacagacaaaattgaaatcgccatgccacgctaccagcaggatgtacgacaattccatcagacggagatttctgtgggacactttacagattttgaaatacaggcgacctgcggactggctaccgtcgaaaagatcattggtgaattcgatgagcctcgttcgttcttggaccctgagcgcttcaattccaaaattctatggttcagccaaggatatatggattataaggtgccgaatttcctactgtccagccaaaaagctgaggaactggaaatttcgatggaactatcatccgaggccccttttaccaatgataattggccttcagatatcacttttttcctaaatgatgtgaatttgggtacatggaccagcccaggggatttcggggataaccggggtaaatacacacctgcatggtggcctgattttatcaatcaatatggtctccttaaaagacttcgcgttacctctgaaggtacctttatggatggcaagcagatatccgacgtaactttaagccaagtactgattgatcagaagcaatggaaattccgtattgccatattggatgatgcccagcatgttggaggggttactctgttcggtaccggatttggtaactacaatcaggacatcctgttccgtttgtactacaaacatgcagaaaatcataccaaaacagtaacggtagaagctggcgatactagcaaataacttttagttcacttcaaaacctgaacacggcgttttgcccatacctctcatgggaagcaaagcgccgtgttttattttttcatccacttatatcgtactcttatgccaggtgctatgcgattagcgtacaggttcaatacatacaggtgaaggaacctctagcacatatcccgttcgggtcagccgtccatcctcactatggatggcaaaggatacgatgttgtttccatcctgattcgctactaccagataaccggacaagatgttgaagttacgcggtgtgctgcccaaggtttccacccattccaccgtcttcagcttgccgctgtccagatcgacatggtatagcacgatgctgtcatgaccgcggtttgacacatacaaaaagcgtccacagggcgtaatccgaatatcggctgctgtattttctacatctataatgccttctggcagtgtggacaggctttgcatcaatgtaagctcaccattacgttcgttataactaaacacagcgactgtattgttcaactcattggcgacaaaagcatatggacgcgaaggatgaaaaaccagatgacgcggtccagaaccaggtggcaaatctgtctcacgatgggtcaccagttttccatcctctgtcaaacggtataccacaatctgatccagtcccagatcacataccagggcatactgtcctgaagggtctggaataatcgaatgcggatgtgccgcatcctggcggtcctgacgaatacctgagccggtatgctgaacttgccccgacatgtctcctaatcctccagcttctgtcgtagggaacacaacggcattgccgcctgaatagttggaagccagcacatatcgtccatcggatgttacggaaacatagcaagtatgcgctccctccgtcccttttcgatccaaagaatgtaattcccccgtctgggcatttagctgatacgcatacagctcgccttcttctgtttcactggcagcatacagcttcgtcccatccgggtgtagcgcgagaaaagaaggcctctcaatcccttccacacctccaaccatgcgtagatcaccattgttcacatgcaaagcacatacatatattcctctttcctgacgagacgcataagttcctgtataaaataactgctcatttcgctcttccatcagctctcatctccttctagctgttttttttacatattatctagctctaagctctactatttgtcttgttgtaaactcatcatgcattattacccaagattctgttgtttcattaacgtttcgcgatatatgcaaaaaaatagcctccttcggcgccaactgtggttcataagaacgtcacagttcactccaaaagagactaagtttacgaaaaatacaatattaaaccgctgtgttttgcgtatctctgctattccattttacagccagccccaaactaagaatgagaatgactgccccaaaaatgtatggcaaattgatatgcacctcgaacaatgtacccgcaagcgcaggtcctagaatattaccaatactcatataagcattgttcatgccggctgcaactccctgctcatcccccgccattttggataaagcagtattaatggctggccgtagcaacgacgtagcggtaaagaagatgagcgataccccgagtacataataaaagttgccggagagcagcataagcacaagggaaatcgctgaaaacagaaaggaaccgataatgacacctttttcgccaaaacgattcaacatcgggctaatgaccacagcttgaatcacggttccgaccagtgctcctaccgtaataatgatagcaatatcacgctcattgtaatgaaacttgcccgtcacgaagaaaggaaacatcgtttcaaaatgcgtcagtccaaaggttaacgtgaatatcataatcagcagcataaagtaaggcttgcggaaagaaagggcaaactgtttaatcacattgtcccgtttgaccttgacattccgaaacttcaactgtttctccagcgacaaggtttcgggcagcataatcaaggaaatcagtgcagctacgcccgatacggccgccgaaacatataagggcgtacgaattgagatatctgctagcaagccgcccacacctggaccgatcacaaagccaagagacatggcggcacccaacaaccccattcctctaccgcgattgtggaccgttgtaatgtcagcaatataggccatcatcggaggaatcataaaagctgcccctgcacctcccagcaaacgggagatatacagcatcgtcaacgattccccaatcgcaaacaatacagaagacgccgtcatgattaccaaaccgataataatcatttttttacgtccgtatttatcggaccattctcccgctagcggcgaaaacaggaattgggttaagccaaacacggcaaccaaataaccacccgtttcaccactgcctcccaaagagctcataaacttgggaaggatcggaataatgaggccaattcccagcatggcaataaacatattaatcatcaaaatgaccagcggtcccattttcaactgttgtgaatctgacatgtagcgttttgtcctcctcaggttctttatttcgtatacgaaaatcttattttgcaaccattccagcaaaactctccattatattaatagagtgtgggacaaataacaatcataaaatacttccgataaccctgaatctttcctttggcaaacagcaaaaaggaacaacctgaataaacgatgttgtccctctcacaacgaacgaccagggtgaatttctggaacggtctggcggtccctacgatccctgttgtggatcttcgaatagctcctttatcatcttttccttgttattcagaaattgtttcgtgatgataaaatgatcagtttcctccagcgtcggggtgtcgatcccttcatgtgtcagatgatacaagatggaatctggataagccatcaaaataggggaatgagtagaaatgataaactgtgagccttgctgcaccagctcgtgaatccgtgcaagcatggccatctggcgcaaaggcgataatgcagcttccggttcatccaaaatatataatccttgtcctctaaaccgatgcacaaaggcagcaaaaaaagactcgccatgcgactgctcatgcagcgatttacccccataggaatctcgaatcggtcgccctcctccttctcgatccagctcgtcgatgtgagtcgccacattatagtagctctccgcccggaaaaagaagccatcccttggcttttccacccctctcaccagccggatatgctcatacagtgaggaatgcgtggcttgtgtagaaaaattgaaatttttagtaccgccctctggattaaatccccacgcgaccgcgattgcctccataagcgtcgatttacctacgccattttctccaataatataggtgacggaaggatggaatttcagttcgttccactggtgcagggcttttaagttaaacggatattggctctcgtcagcatctggaggccaaatcagctccaggcgacgtatgaaaagattgcggtcccatatactcatgtccagttcagctccattgccaagcaattcactaggttttccatcattatattggaattatttacagcaatcaattggaaatcccatttcgtaacccttctgttgttattcaagcgattattgtaggtataatgtatagtaatgttcattgggcatgaattctaattactttatttcgtgtatatctcattcttttcaagcaggtgaatctatgaagtcaaatcacaaacctatccaatcctttaaagtcgtacagttcgtgatgaccatctacaggcagcgattgacacgtattctgctaccgttggctgtactggcttttattatatgggaggccggacgagaactaaaggactttaatctggcccgtatgtttcatgagctgcggcgaatggatgccacgtttctcatcgaaattggcttgttctcactggctgccgtggcggctatgagcgcctacgattacgtaatcaggcatcatttcaagcttcaggtcaagcctgggacgacatttcgctacgcctggatctctaataccttcaataatgtttttggttttgcgggctttacaggagcgggacttcgcaccgtactgtataaaaaaagcggtgtgccgttaggtgtcatcacctctgccgtcgtgtttctttcgccggtcgtcattaccggactatctttgctggcttggggggccattgtccatctgtatccggtacaacctgtgctggatgctcatccttggcttcattgggcgctgtggggaatggcattgtacctgccgctatttttgatcatgcagcgctccaaacggtactccacatggttcaacaagggagaaggacagctttcctggtccactatctccgcttccattagtgcttctctgctggaatggctgctggctggccttacctttgcatggatcggctcgcacttgctccatgaacttccgatccatgctgtgttcggcatttatgtgatagccgcgattgccgggttgatcagtcttgcacccggaggggtaggggcattcgacatcattgccctgctcggactgcaaatggcgggagccaactcagatcgggcactggctgtgctgctggtctttcgcgtcttttattacatcatcccgtggctcatcggcttggtattagccgcgctggaaatgattccacgtaacgagcgcctgaatcagctagctgagacgggttgggattactcccttaatgcctggcagaaggtatggggctggcctggtcaattccggtttttggccgatctaggggtatgggcgcttggtaagctggtactcatctccggcgtggtgcttcttttgtcggcagctacgcccggtctgttatatcgacttcgttttgctgagcatttgctcagcctgcccgtcatgcgcttgtcgcatgaaatctcggtcatcatcgggattatgcttgttgtcctgtcccacggaatctctctgcgtattcgcagagcattgcggctgacattagtactgctgctgacaggagctattttcaccttcactaaaggtctggattttgaagaagccttattcctgctgtttgtggcgttaatgctatggatctcacgttcgcggttttatcgggtcagtgctccgctgaatcggcacaacattttaatatggggtggattatctctactcgtaaccggggcttattttatcattggggcaggctccaacactccttttatgcgccatttgcatgccaaggtccatctagacttttttatgaaccgcagcgattacggagttaccgccgtgtttagtctgattttggcatgggtattcctaacggtgtatttctttcttcgacctcagcgtagcatcgccaatctacccgacgagcaagagctggataagctaaaagaatttttggaacggcagggtggtaatctcgtatctcatatgctttttttgggcgataaatatctgtattggaccaaaaatgaacaggtcgtcattccctatgctcgtagccgggacaaactgattgtattaggtgaccccctcggtccaaaagaacgtgtaagtgaagccattcaggaattccaacggttcgcagatcggtatgcgttaacggctgtattttatcaggcctcgccggagtatttgtccatctatcacgagaacggctatcgctttttcaaactgggcgaggaagcactggtaccgctggaatcatttacactgacgggcaaaagcaatcaggcgctacgcagcgccaaaaaccgctttgaccgcgaaggctactcgttcgaaatcatccaaccgcctctagaggcgtcactgattgaagaaatgcggcatgtttcgaatatttggctggacgggcgcaaggagaagggatattccctcggctggttcaaagaaccttaccttcagttggctccaattgcattgctaaaggactctgaagggaaggtcatcgctttcgctacgatggcccctgcctacgatcatggacggacggtctccattgacctgatgcgccacttgcctgacacgccaaatggcacgatggattatttattcacacgggttattgagtgggccaaggagagtggatatacgacatttaatctgggaatggcaccgctgtcccaggtaggacaaagcgaaaaggcattacgcgaggaaaagctggctcgacttgttttccaatatgggggacatttttacggttttcaggggcttcggcgctttaaggataagttcaagccccaatgggagccgcgctatctggcctatccggcttctgtctttctaccgatcctgacgctggagctggtttatctcgtgtccaaacgatcggactaaacaaagggctgacaacaggaattttaatagcctaacacaacgtaaaaaagggtgttcccaaccacgaacggttgcaggaacaccctttttattcacaaatgttcttagaagctgccttttacaacaacttcagacaatggaaaacgtcctgatggacgtgctggcacttgtgccttacctacgctaataagcatagttggcaggtaacgtgctggaatattgaattgctcgatcaattgtgctggaatgaaaccgcccattgcgcaagtgtcgtagcccaaagatttagcagccagcataatattttgtgctgcaaaagcagagttcaggatggctgcatcgcgagctacttgcggattttggtatgcgccgttgatttgacctaccaatgcgtcacggatttccgctggcagtgcgcctgcttctaccgcttgatcataaatgacggtgttgcggttcgcttccaaatcacccaatacggcaatcgtaacggaactttccgctacttgaccctgattgtaggcgataggtagcaatttttgtttgtccgcttcgctttcgatgacaaggaatttccagtgttgaaggttccaagcggaaggagcttctatcgccgcagtcaaaatagcctccaaatcttcctctggcaatttaaaatccttaacatagctctttaccgcgtgtctttcactaatagtagatagagtttcattttttggactgctcgacattctaggcacactcctaatttcttaatatatatctaacttgaatcctcattaacttcccaaactactgcaattataaaaatgatagtgaatgatgtcaatatgtttaagtatgaccctgcactcaaaatacagtacaatacggattaagacatacatatcggcagatgcctgccgatgggacaagacacgggtgagttcattttgttctcatttgaattaaaaaaggagcgttactatgattggatcttttaaaaaaacggatattgctttgtttgccgcctgggttgtagcttgtgtggcaactttgggcagtctgtatctcagcgagattttggggtatgagccttgtaagctgtgctggtttcagcgcattctgatgtatcccctgacccttctgctcgggatcgcctattttcgaggggattcggggatacgccgttatgtcatgccgttggctatcattggaggcgcgatttcagcctatcattttatcattcagcgcatccatgcagccgccaaagcagctgtgcaaacttcaacttcctgcggcagagtatcctgtgaacaggattacctgaactggttcgattttattaccattccttttctcgcactgattgcctttatccttattattgcagccatgggttacatcatgcgtcaggagaaaaaatcagctcaaggagaggtacaagcaaaggaactcgcataagtatgaaagagacctaattataggacccgttaccaccaagaggcgtataatccgcttgccagaggaaagactgtaactaaatatatccattgcatatgtggtataatgtaaaaggtttgcagtctgtccaataacgcttatattccttatagagggggccagtccatgtttcatattagcaccccattgctgcaatatggcgcaaccttcggtatgatcgtaatcgctatttcggctattttcatccgtatgaagacaggtcatcgcccgattaatgccaaaaaaatcatcattcctccgctcggcatgagcaccggttttatgatgtttgtggtgccagaagtacgggttccctggctttgggcgctgggcgcttttctggtcggctggtttattttttcttacccgttgatccgcagcaccaaatttgaatcgcaagaagggctggttttcgtccaacgctcacgtaccttcttttttatcctgatcagcctgctgatcgtccgattgctgctgcatgaatttattcagcattacattaccattccgcagacagcagggctatttttcatcctagccttcggaaccttgttacactggcggcttcgtatgtatttccaatatcgtcagttcgttccgaacgagacggaagttcgcatctgacaaacgggtttttaacatgcatgctcgcatgttgctgtatagaccaaaaagacacgttctcccaacaggagccgtgtcttttttggtcttttagtctatcaggtctacattatgcattccgggaaaaaggagctactcgattgcgtccctctgtcttcgcagtgtacagcatcagatctgcctgctcgatcagctcttcatgctcactctggcgttcggggagccagatgaatatgcccagactgactgtcattcaacccgttagtctgtatgctcccgaggggtgcctgcttttattgctgggtcaaaatgatcggaccatctgctgtaatggccagcgtatgctcgtattgagcagacaagccgccgtccaacgtgcgtgcggtccagccgtccgcatcaattttactgcggtatgtgcctgtgttgagcattggctcaattgtaatgaccataccctcttttaagcgtggtccacgatgcggaggtccataatgaggaacttgcggttgctcatgcatatcttccccgatgccatgcccaatgaattcgcgtacgaccgagaagccttccgcttccgcgtaggtttgtatcgcatgggaaatatctccgatccggttaccgataacggcttgctcaatccctttatacagcgattccttggtaacatccagcagcttttgcgcctgctcagacacattacccaccgcatacgaccaagcggaatctgccagccagccattcaggttcacaaccatgtcgatcgtcacgatgtccccgtccttcaacggtgtcttattcggaaagccgtggcaaatcacatcgttaggtgagccacaagttgcaaactgatagccgttatagcccttttgctccggtgttgcgccatgcttcttcataaaggattccgcaaaggcgtcaatttccagtgtcgtaatgcctggcttgatcattttggcaatttcccggtggcaagcagccaaaatgtctccagcttttttcatattttcaatttgttctttggttttaatgataatcattaaacggtctccttcttttccgtgttcgttccacttttcactgtttcttttttctgcttctattgtaacgctaaaagcagcgaaatggaaccgatgtcaactgacaccgtttacaaggatcttaaacggggtatataatattccataacttgtataccagtatgcaaaattatttccaagataggagtatcctatgaaatatccaacaacctggttacagggcgcatcgcttggggaaaggattgcttgtgaacttcggcttcagattatacggggtattcagacgccaggcactgttctatctgagaatcagattgctgccgattttggtaccagtcgttctccggtgcgtgaagccttgaaggcgctctcgagcgaaggactgatccgtttagagcgcatgggggcggttgtcgttggcatgacacccagtgatatggaggagctattcgatgtgcgaatgctgattgagcattttgttgtacaaaggtatgtacatagtgataatgccacattggtgactgttttgaatcagatgattgacaaaatggaagtcgctctcaagtacagggatgtcgttgaattttctcttcaggattttaattttcatgaggctctggttctggaagcaggccatacccgtattcttcatacctggaatggtatgagacagctaatcctgacggtcatgttagctgcgacagaacaacgatttgcgtctaacatcgaagaatcacaagtcacgattcacaaacatcgaacctttgcaaacgctttaagtcaagggaatgctcaggagttatcgggatttattgaggatcattaccgagatacccgcaacgcggttaacgacagcgtcttatctccctacagaaagacatcgtcctagccgcaacatgcgtgacaaagagccgatgtaccgcgcttcatgcgtttcttgctggcgcggttctcttttacattaaagttgtcgacaagtatacatttagctacacatatataaataaggaggcattacttcatgaacacattactcggcttgagtcataacgcgtccctgctcatatgggcgctagttaccgtcattcttttgattttgctgattgccaaattcaaatggaatcccttcgtttcactgctgctttcgtcggtatttctcggactggttaacgggatgccgggacatgaagttactgcctccatcaccaaagggctcggcagtacgctcggctccatcgccatcgtgatcggtttaggcaccatgctcggtaaaatgatggcagaatccggcggtgccgaacgcatcgcgaccacactgatggatcgttttggtgaaaaacgcgttcattgggcgatgatgattgtaggctttatcgtgggtattcccgtattttttgaggttggtattattttattaattcctattctgttcacggttgcccgtaaaatgaatatgtctctgctgaaaatcggtattccgatgctggcaggactatcgacggtacacggccttttgccaccccacccggctccgatgatcgcgtttgaagcctttaacgccaatattggacgcacgataggatatgcactcatcgtgggcattccatccgccattattgcaggcccggtcttcggcgcttggattggcaaaagaatcatggtcagaccttccgagaggctggacgagcagttcagaaatacgacgggacggtcgctgcctcctttttggattactctgttcaccattttattacctgttattctaatgcttagcggatcagtcgctgaaatcgtagacccgaccaatacacatccgctcactgtatttttcaaattcattggtgatgaggttatggcattgctgattgcggccgtgttttcttttttctcgctaggctatgcacgtggtctaaagaaagaggatttgtcccgttttaccagtgaatgtctggcaccaacagcctctattatcttaattatcgggagcggcggtgcatttaaaacggtattgatcgacagcggtgtaggtcaggccattgcagcggtcgctacaggagcccatatgaatgtgattgtatttgcttttctggtcgctgcgctcattcgtatagccactggatcagcgacagtcgcgatgacgacaggctccggtattgtcgcacctgtactggcacttacacccggcgcgaatgtcgaactggtcgtccttgctacaggagcagggtcgctgatcttgtctcatgtgaatgacgccggtttttggatgattaaagagtttttcaatatgacggttccgcagactctaaaatcatggaccgttatggaaaccatcctctccctggtcgctttcggtttgattatgctgctgagtgtgttaatttaacgataatgagctaataacggtaagtgaaggggagattgaatatgacagacacccgatatatgatcggcgtcgatatcggtacgaccagtaccaaagcggtacttttcgaagaaaacggcaatattgccgcccagcaccatgtgggctatccgctgcatacacctgagccggatgcggcagaacaggacccggaagatattttcaaagctgtcgtgacgacggtgcaagaggtcatgaaacaaagcggagtgtcagccgagcatgtgctgtttgtctccttcagttcggccatgcacagtgtactagcggtggataagaacggcaagccgctgaccgcctccatcacttgggcagataaccgtagcgccaaatgggccgaagcgctcaaacatgaatacaacggacatgatatttatttacgcaccggaacgcccatccaccccatgtcaccgctaacgaaactaatgtggattacacgtgatttaccggatgttgcgacccagacgtataaatttatttccattaaggagtacatctttgcccggttattccaccaatatgtcgtggatcactcgatcgcctctgcaaccggacttatgaatttgcagcagctagactgggacgaggaagcgctgcaccttgcaggtgtgacgaaggagcagctatccgagctggtgcccacaacgcatgtgctcaaagggctggatgagacctatgcgcatgacatgggcctactgaagacgactccttttgtgatcggggccagcgatggtgtcttgtccaacctcggtgtgaatgcgatcaaacctggagttgtcgctgttaccatcggcaccagcggagccatccgtaccgtagttaataagccgctcacggatgccaaagggcgctttttctgttacgccttgacggaaaagctgtgggtcatcggcggcccggtaaacaacggaggtatagtcttccgctggatccgggatgaatttgcagcctccgaggtggaaacggccaagcgactgggacttgatccatatcatgtgctgacccaaattgcggaacaggtacgtcctggctccgacggtctgctctttcttccgtacttatccggtgaacgtgcgcccctgtgggacccgaatgctcgtggctccttcttcggtctgtccctgcgtcacaaaaaagagcatatgatccgcgccgctctagagggtgtgctgttcaatttgtataccgtcatgctcgccatggaagaagtcatcgacagaccgtcagtcattcacgccactggtggatttgcacgctcggagctatggagacagctcatggcggatattttcgatcaggaggtcattatccccgaaagtctggaaagctcatgtctgggcgcagctattctgggcttgtacgcactgggacggattgattcgctggatgctgtgtccggtatgatcggcaccactcaccagcacaaacctgtagcagaacacgtggatatttatcgcgatttactgccgatttatatccgcatttcacgtaaattcgaagaagaattcaaggatattgcggaatttcaggccaagtccctacaatcctaaattagtgaaacctgttctaacgctgctgcgtattaccgttttataaaaacctgtctatgtcagttgggcagggtaagaaggaggattagacgatgctcaaacaattactgcaccgcctgctacattccacctctcattctcataagcggcgatacagcagctcagaccgttattatgaacgtgaacgtaaacgtcattcttcttcagacggttacaagaatagccacaatggacaccgctattacaaagataaacgccgtcattactccagttcttagccaaacaacaagaagtagcgacggaatagagcgtaacacaagaagcatgccacaggctcctcaaaccctataaagcgaagaccctacttatctcaagggccttcgctttattgttgtgcgcccttcgttatgcagggcaacatctgtgcattttacaggaaatcggccaagaccgaaattacagaaacagggttttagagatgatcaccagcaaaataaacagaaccagaatcgctcctacagaggtccatgctcctacgccgcaacccataccgcctactccacacatatgactcatttacaacactcccttcgctcatttacaggatcattgtatgtagacatggtcaaatgcgtaaggggggcattcccccatttttgcggcgaatgcctgtttatttttagggacgttatgggttaacctcaagcagcagcaatgcttcctccagctcttgcataaactgtcggctattctcataacgtggccgaatctgaaaaagacgctccagcatgtgacgcacaggtgaactcagcttcaattcttcctgccagcttgctggcggttgatccggttgaggctcgtaactgctatatagcataaaaagcattaaatgtccgacatcgtacaaatcgctgtagacggcgacatcttgtcgctcaggtgcacgcttttccagcatggattcggtaaatacatcctcctgtcgctctcccaacgccagagcaagaccaaagtcgatcaggtaaggcttcccctcatggtgaagcacattgggaatacggatatcccgatggatatagccccgttcatgcacatgcagaactcgctccattaactccaaaatgtagacaatgcattcctgttccgtaaaggaacgctcctgttcaaatataagctcctccaacgtcatgccggagatgtattccataaccacaactattccgttcgaatgttcgacaatttcgagcagcttcggaatataggggtgttccatctgccgcataatatgagcctcgcgctgcaatagctgaactgccttcgcccgtttgctcggtctgggcattttcactgccacctcttgtccgctgtgccgatccagacagaggtaggttagaccatagctccccatgcctaaaagcgaacgaacatcataacgtccgctcagtaaatcgccaggctgtttcggatagtccatccatgattcatatgcgttccgcaaccaagcaaacatacttatatcctttcctctacaagccacagcaacgttccttatgcggcttgttctcgtattcttgtattccgttattataccatccacgataaaagaccatcagaaccgggaaggtctgatggtctttatcagggaagatgctggttatgcctctctgcgtctgcgcggtgtcagaccaagccaggacaacaacgaaccgcgcgatttgcgttgcctgccctggtaggtacgcaaattagtaattagctgccggtctcgttcctcgtcaaccttttctttcatccagcgtttttgatcctccagttgattagacaggctgatattcttttccaccaaacggctatgctctgcttccagctcctccaaacggctccgcatttccgacaatgcagtttgcaccatgtcctgcatctgcgccagttcttgcggctctacggactcccgcgtttgtacggatgcaggtgcttgctccaatctatactcaatagttggttccaaagtctggaactcttcctgcgcctgtaactgcataggttcctctgacagttcctgagcattcatttcatcctgtaactctgtcagttctaccgtagcagctgcttgcgcctgtatgaccgtctcttccctgccctcagccgccgccattatttcttcccaggttgcggttagtgactcagcatccgagatgggtggcaagcggaattcttcatcctccatttgaaagggagcggtcactctctcaagcaccacctgaaccgcctgctccatcgtcatatgctgctcacgcaacgccctccgcatcaccttcaagcactcaacatcctcagcactgaacatcctcgattgattcgcggaacgctgaaacacatacccctgctcctccagcgccgctgcatatttacgaagggtactcgccccgattcccaactgttttgctgcttccgtcgtcgatttgctttcttccatttaatcattacctccccggatggtatggaaagaaataagcttgtatatgtagaattcgcgaaatccattggaaaccctttggcaaaaatgttctaatattgcagactgctaagaacctttgtcataacggaatatttgtagatatacaagaaacgacattgcaaagcatacttccgttcaagtatgtccttgaaactctttaaagaacgtcacataaatgtcatacttttattattttcatggcactattccttccatcaacatagtttatgttataatttgcacagaatttaccttaaatataaattgaaacatgctctcctatcttccagtaaaagtattgataattcacgttcattctatgattaatcctaaagaaacctctattcacagtttatttataatttcccggaatggaggcaaaaaaatggatattttcaaaagatcagcaatatgttatgttatgtaacgtaaaatgtatttcaggcataatttgtagcatattaacgttcgctggaacgaggaggcaacatagatgaaggggaaggcaaggaaagtagctattgtcggcgcgggaatggtcggttcgagctgtgcctactcaatggttaatcagtccatttgtgatgagatcatgatgattgaccgcacgtatgatcgggctttggcccatgcactggatctgtcccattgtatggattttacgtccacacgtaccaaggtgcgtgccggcacgtatgcagactgcacggatatggacgttgtgattataacggctggtgccaaccctaaaccggggcaagaccgcctatctgtgctggacaacgcagtgcttattaccagagagattgtaacagcgattatggagggtggcttcgacggtatattcgtcattgccgctaatcctgtcgacattgtaacgtatatggtacaaagtatatccggtctgccgcgcaacaaggtgatcggcacgggcacctccattgactcatcccgacttaagacgttgctttccgaagtgttttccatagatccgcgtagcgtgcaagggtatgctcttggggaacatggtgaatcccaattcgttgcctggtcacacgtcacgattggcggcaagccgctcttgcacattttgcgtcagcataaggaacgattcagccacgtcgatctggacgacattgcccgtaaaactcgggatgcaggctgggagatcttcacccgcaaaggggccacttattttggtattgccaatgcgctggcgtacattacccgttccattttaaatgatgatggtaaaattatagcggtctctgctgtattggacggcgagtacgggcacagcgatgtctgcacgggcgttccggcgattatcggcagcagaggaattcaagaggtcatcgagctagagctaagtccggaagaacaagcgaagttcgacgcctcttgccaccttatcagcaataatatccgtgccatttcaggcttagtgtaaaccaatagcacagtaaaaaactccttaccctcattgaggataaggagtttttgcagtccccgtatttcgccctatatctctttataacgaaatacggtcagtcccgccaacgtaaatacgacaaagctacctattataaccgtcaacagtgtgtcagttggcaccatgaacgccccgaagttgtctcttccactcggcatcatcgccaataaaggctgtgtccatggatagtacggaccgtaggtttgagaattggcgaccagaatattcggcacggtgaagacgaaattcaacgcaagcggtgcggcaaagctggaccacaagaaggacaccatcaactgcaacgcagccagcggcaggcaggctacccagcctgcgagcaaactttgagcgatcacggcccaagggattggtccgttcatgtcctgcacagctccaacacccagcagcgctcctccaaacagtaactgagtcaatccgaccaaggccataatgatggtcaacttggccgcatacagactggtgcgggacaatggcaatgacatgagttgcttccaaccgccgcccccatgctcgaatcggcagactagagatccaaatacggcggtcagcatcggcatgaacagcatggcatgtaatgtaagcatggcagtcaacagcaacagccagttccctcccggattcgccagcaagccaatcaagacggcaatcgccgggctgacgagcgcaagcagccaaacgggcgatttggccattttcatacgttcaacagaaagcagccgtatatatcctccgaacattacgccacatcctttcggctaaaatgggccgctgtcagcagactgaggagtatgcccgttccgcacccgacggacgcaaacatccatgcttgaggtgcaacccatgcgaattgcggccaggccaacggaaaccattcggacagctgtgaagcaaacaagctgccgatgcctaacgtaatgcccagtgttacaggcagcgcctgattatggaacgtgaccgttaaccacaacaataatacgagcataggcagcgtgccgcccaagggccaaaacccgagtcgtagcagttcccctacgggtgcaggctctcccccaaagccaagaatcattcccaacacccaagtcccgaccgtcaggagtagacaggacacgcacagcatcccgatcgctagcgtcagcttggccatataaacactaaatttggaaataggcaaagccagcagctgcttccaagagttagacgaatgttccacattcgccagcatggaagcgaccatcgtagctcctaataccagcgcaagggggacaaaaatagcaatgttatccatcaagctttcccataagcgccccttgtatcgcggaatcagatagtcatagcggagtccaaagttcagtccctgcatcgctaccagccctaggggaccaagaaacaccaagaaccagattccctttctgcgtgctttgagcagatccgccgtgagcgctcgcagcatcataaggaagcccctcctttgcccactacctgcatgaacatatcctccagcgatttgcggcgttcctccacacggtatacggcatgcgtattttcgaccaatcttctgaccaacagcgcaacagccgcatcattcatgttctcgaaatccagcgccgatccgtccttcactgaatggtagccctgctcacgcgcaatcaactgggctgcttccggttccgacactacgatccgaatcccgcctgcagattcctgacggagattgtgaatcgtgttttgaaagaccaactctccttcacggataatacccacggtattcgccatatgctctacctcgctcaacagatggctggataccagtacggtgatcccccgttgctcgggcatcgcctgaatcaatgtgcgcatttcctgaataccctccgggtccaaaccattcgtaggctcatccaaaatgagtacttcgggattcccaagcagggctgctgcaatacccagtctctgcttcatgcccagcgagtagcctttgactggacgtttggcatgcttggtcagtcggacgacctctaacacttccgcaatgttttgcttgggtacattcaaaatacggcgaatggcctccagattttcaattgcgttcaaatgaccataatacgaaggatactccaccaatgagccgactttacgcaaaatatcgagcttatgtctgcgaatatctttgccgaatatacggatcgttcctcgagttgggcgaataagtccaagcagcatgcggattgttgtcgttttccccgctccattcggacccagaaatccgtaaatatctcctcgagctattttcaggtccagctgattaaccgccgcgcggcctttgtatattttgctgagactgttcgtttcaataatgtattcgttcaagttcctcacctcgacacctatcgtaacgtgccaagtttaaagccaagggaactctgagtttaagttttgtttaaaaaacggattcgggtcccggctgatgaactgataatctccctctccaaattcatttcgcgagccagcagttctgtaatcgccaaaccaatccctgcgcctttttcactggactgttgctccataccgggccctttatctgtgataatcaatgcctctgtcccattatctttctgtacttgaacaccgatatatcggcctgaggcagcatggcgaactacattttgaaagagattgtccagcagacggcggaagccttgctcatcgacattccacaccatactatgctcgggcaggtcgatatccacttcaaaaccctccttttcccacaccggataccagctggctacacactcccgcactagccgcaggatatcacgcggtgtgttattcatagtgtattttccactagctagcagattataggtgagcagattgtcgatcagactcccaaggtcttttagcttgttttccatcagtgtaatcgactgtttccctctgctgctcagattttcactatctagtgtatacagatggctacgcacgaccgtaagcggcgtccgaatatcgtgtgacagatccgcgaccagtctcttccgcagctcttcctcttgacgctcacgtcctcgactttctgccaactgctcaaccatctgattaaatgcttcttccagcttgccgatttcatccgggcgtccagtggtaacaagaataggcaagccatcctctcctcgctgcgacatggcggcctgaagctgcaacagtctacgccgaatgcctccaaaaaacagaagagatacgaatataaaagcgcccagaaccaatacgataaaaaagagatagtacatgaacatgctactatctgtaggtggctgttcaaagaacgaacggggcacttttaacaccatatagccctgattcacatcattcttgcccccaccaataaaggctactaccgtaaacggcccctcatagcttgcttgcttcataaaagctatagcctgcgcagcgttccattgttttggcatgttaggttgtgtcggtaactccaaccttgttttacctgcggtatccacccaaaatatttgtgagttagggaacatatcttgttgtattttgcgcagatgggctgagatttgctctggtgtggctcccttcaaagctacagcttcgcgatgccaactattttcggtatgggtagtagagggatagtaagcgtttttaggcttgagctccgccccccaattcaataacacgctatatatcaaggctgtagcaggcaacacaatgggcaacagcatcatagcaaccacaataatgaccagataacggaacaacagtgaactgcgaaaccgacctccctgacccggcctagagctggggtgcagcctcctccaatttttgcgcgtcctgctcattatgctttcacccgatatcctacaccacggatcgtctcaatgatgcggggtgccgcaggatcgatctccagcttttcgcgaaggtgtcggatatggaccattaaagttttgtctccgtcgatatatggatctccccacaccgcttcatacatttgctctttcgtcataatttggcccaaatgccgcagcaaataagcaaaaatgtgatattgcttgcctgtcagtgtaatttcctccccggtatcacggttcacaatacggttatcaggggagaacacagagagatgccccagttgtaaagattcttcgggcacggttcccgatcggcgcagcaaaatctctatacgtgctatgagctcgtccgggtgaaagggtttggttacataatcgtcggcgaaatccagtccttgcagcttatcgtcaatggatgtacgggcagacaacatgagaatgggaagctccgggtactctttcttgagccgcttccccatggtgaatccatccagaccgggtaacatcacatccaaaatcacgagttggcacgtacgggctgcttccacagccccatccccgctgcgaagccaggttacagcgtaattccgctcttccaaatactgatgcgtccaagcaccaatatcctggtcatcttcgatgtatagcacatttgttttcataatagacacctacttatcgtttttcttttatgtaatgggcattatagcatttatggtacataacccacttaaaaaggttaataactaccttatacgacatacgcttcacattttcaaatttgattgctcgtaaaaaaggaggactacccgatgctgctggaagcgatataccatcacccgaaacgtaattgggcttttggttacaatgatgaaacgatatttctacggctacgtgcgaagaaaaatgacctaaataccgttcatgctctcaccggagataaatacgattgggaccgcacccgacagcttgtcccgatgtccaaattcgctaccgatagcaggtttgattactatgaatgcagcgtaaaacctactcaccgtcggctgaaatatggatttttgctagaagacggtgaggaacgtatttggatgaacgaggacgacttcaccacccaggaaccccaaaatgcagatacactgttccaatatccgtttttgaacccgattgatattctgaagccacctgcatgggtgaaggatgctgtattttatcagattttcccggaacgttttgcgaacggtgacccctccatcagcccagaaggtgcagagacatggggcggaacaccacaaagagacaattttttcggtggtgatcttcaggggattctggatcacctggatcacctgaacgagctagggattaacgccatatatatgactcctgtgttcaaggcgacgaccaatcataaatacgatacagaggattatatggaggtggacccccattttggggacaaaaagacattaaaaaaactggtcgatgcctgccacgaccgaggaattcgggtgctgcttgatgcggtgttcaaccattcagggcgtacgtttaaaccgttcgttgacgtgcaagaaaaaggcgaagcctcgccttacaaggactggttccatgtacatagctttcccctggaagtggtggatggcacaccgacgtacgatacattcgggctggaaccgatgatgcccaagctgaacaccgaacatcctgaggtgaaaaagtacctgctggatgtagcaaagcattggatcgaagaaatcggcatcgatggttggcggttggatgtggcagacgaggtggatcacgccttttggcgggaattccgcactacggtcaagcaggccaatccagatgcgtacattttgggtgaaatgtggaatgaatcatctgagtggcttcagggggatcagttcgatgcgacgatgaattatccgttcacctacgcggtgaatgattttttcgtcaaaaaagtgaccgatgctcaaagctttgccttcgccatcggaagacagctggcccgctatccacagcaagcatccgaggttgccttcaatctgctggatagccacgacacaccgcgcctgctgacactgtgcggggatgacaagcggctgatgcgactggccgccctgttccagtttacgtacatgggcgcaccctgcatctattacggcgatgagatcggcctggatggagatgccgatccaggctgccgcaagtgtatggagtgggacaccgacaaacaggaccgcgagttgttcgacttttaccgcgagctgattgcgcttcgtaaggggcacccggtcctccgtgatcagggaagcatcacctttttggaggcacagccagagggcacctcacttgcctacgagcgccgcagcgaggaagaagtactgctcgtgctgctcaaccgttccgatgaggatcacgtttttgaactggacattcccaagcaggaatggcaattagcctttggggaaagccagtggtccgttagagagaaggggctgcttgccaagcttccaccctacggatacgctgtactgaaggcagcgcctgctcagtcagtaaaacctgcttaagaggacgatgtcaagacgggaagcaaggcatccgcctctataggcggatactgatgaaagtaactgccgaatacggtaaaaaaagcgagaccaccgggaacaagatagttaacttgttcccggtggtctttttacgttgaatatgagcttctattgtcgattatttgtttttaacatctgttcttactaccccaacatccgaagcattgatcgaaatggggttaccgccttgtcctgtctgagctgaagaaggtgctacctgagccagtacagcagtttacgcaggtagcgtctgtgttttcaattgcatgtacaactggtgcgtcacctgctgcggctcaatacccaactcatcttccagtattctgatgaagctttcataatgcttttgcgcagcggtataatcgcccagttgggcgtaggctgtcagcagcagactgcagatatcgtctgagtacggctcccgttgctgtaggctgagtaagcgctgaacagactgccgggtacgacctgagcgaagctcttctcgcgccagctcagaagcacatgccagatacatattgcgcagcttctccctttttgcatatgcccacgggtaatcgtgctcctccagatagttgccacggtatagtgccaacaggctctcaatacgcggcttaccgccgctaccggatgcagcccattcggatattccccgctcgaatagctccacatctgtaatccagccattgcggttcaagcggtagcgatccagattatattccagcttcgtatcttgcatccgttctttcaacgccttgcggatttggtaaatggacgtgtgcaggtgaacaacagccttgtccaaatgatattcaggccacagcgcatccagcagttgttctttgctcacccattccccttcatggtgtaataaaaaggaaaatagctcctgcgactttaatgtgcgccatttgaatggtttcgcacctacagcttcctgtccatcctccaaaatttcaagtttttgaaaacaacgtaccttgggggattgctctgctgaagctcccaaactagaagaacggggatcagccagcgtggctgcaatccgatctaacgttttggatagccgccgggcatgaacgggctttaacaagtaatccagtgcttgcagctcgaacgcttcaatagcatattccgagtacgcggtcacaaagacgatatgaatatgggaatccagctgttgaatccactcggcggcctctagaccattcatctctggcattccgatatctataaaaacaatatccgcacgttctgccgccagatgatccagccccgcttgtgcagacgtatatttgcccattaccgttaaccgtccgtccgcctccagcaaccgttccaagtaggttaatgccgacctctcatcatcaatcaaaatcgccttcatttgtgtccgtactcccttcctgctgcaacatccatcatgatgctctatttacacgctatgcgcctttatccttacgatttttaatttcttatattttatatatcgtatcattgcgggcgtgactttagcttttccgacaaatgtactgtactttttttattcatcggtattccggggcgaggtcgtttccggcacacggaagcttaccgtcgtcccttgcataggattactttcaattcgcaatccttctccatacatatggataagacggcgatggatattacgcagtcccacgctggaagatacatgatcctccgacagcagctgttccagtcgctcggacggaatccctacgccgtcatcggtcacgctgaccacaaaatcggttccatcctcctgcacaaccactcgcacggttccacctgttgcccgttgcatcacaccatgccgtatcgcattttccacgatgggctgaatgcttaatggcgggatgagcgaccggatgttccttcctacctctacggtcacctgcaaacgttcttcaaatcgtgctttttccagtgccacatacgattctaccaattccaactccttggataatggcaccgtattctccctgttctgaaaatcaaaactgccccgcaaatactgactcagctccatgagtagctccgctgctttgtccgggtctacggctacagtcgaaacaatgacattcaaggcattgtacagaaaatgcggcttgatttgtgcctgtaaaaaggccatttccgaacgcaccgcttcctccgccgaatgacgcatgttcaacagcgtacgcacacgcgcctttaattcctcagcatcaacaggcttacgcagaaaatcattagctcccgccataaaacctgcgcggatatccccgggcaggtcgcgtgccgtcagcagcaacaccggtagctcggacagggaataccgttcccgtatccgtcggcacagctcaataccggacatttccggcatcatccaatccgtaatgactaggtcaaatcgggaacggccattcagcatgtgaagtgcctcctcagcatgatccaccgccaccacgctacaacctgtggtatataatagctcctccagcacccgaagattaaccgcatcatcatctacagccagcactttgtaaggaacagtctgaacttgctccagtgcatcttcttcatgcggaatcacattccgacccgacgtcacaccaggctgcaatataaccgcagacgaaacatctttttgagcttcatgtgccaacgttccggtctgcgctaagggcagtgtaaaataaaaggtcgaacccttgcccaatctagattctacccggatatgaccaccatgcagctccaccagacgacggactatgcctaatccaagccctgttccactgtatccttcatcctcagcattcgcccctcggttaaagggttcaaatatatgcgaaagatgctcctgggcaataccgggcccggtatccttcacactgatttccatttcacggttccccgctttggcagagataacgatttcgccttcctccgtaaatttcaccgcattccccaacaaattgtacaaaatctgaatcagccgatcctcatccgcatctaccttgggcaacgaattgggcaattctttgacaaattgaatctttttcttacccactgtatgacccaatacctccaacacggacttcacagctgcctgtacattgacaggccgacgatttaaggctaatctgccatttttcaaattagaaaaatccagaatatcgttaattaaatacgaaagtctgcgtcctatattcgcaatcaagaccaagttgtgcttttgcggctcattgaattgtgtcccgtagcggtctagcatggattgagcgatattaattactccatgcagaggagtgcgcagttcatgtgacgtattggccagaaattcatcttttaacccatccagtgttagcaaccgtcgtgacaggttctcaacctccataaacgaatgtacaaaacgtttggccagcaggagcgtttgagccaatacgaatatgagcatttcataggctgtcaccccacgcacatctccccagcccagaatatacacaaaattagtcactacaatcataagaatgctcataatactaatgactagcagtgcagcgtcatccgtccgttgaagaagcccacgaatcaagatcagtaatacatatcccacactgactacaccaaaaagaagaataaatgcttcaaaggatgagagtaccaatgtaggcagaaatagccccatacccagcatcagtgcggttgtaatattatagaggcgcagcacgatccgattcataacaatctgcgtcgaaagatgaacatagcggatcagaaaatagtagaacagcgttgacgagaacgactgtattttcagtatccattcataaggtaagtccggtattccccaagccagcagcttttctccatgtgtcagaatataaaataaagccgcgatacaaaagcatcctaagtaaagcaatgccttctcctttttacgtaaaaggtatagcatgataaaaaatacggtaggaataaaaaatcctgctatcagtatggtgtcctctgccattgcaacttcccggctatgcgtaatactctcgtaatccccaaataacagtggataaatgattccaccggaggagtagctataattagccacatgcacggtaatatcagccgaatgtccatctatcgctgcaaatccaacatagggaacattgccctgcttgcccttgtcggcagaaacagagggaataccacttgctcccacgttttctccgtcaatccatacttgactggcgctgcgaatgttttgcatatagatgccgtacagattttccgctttttcaggcaacagcacacggatatgataggttccatatccggtcgcctgtcccttaggcatccactgattccatttaccaggcacatccacaatcttggcagaagaactcgtttccagcctcaactctgaagaactctgatgattttcccaatccttatcttgttgcatttcatgaaaggatgaaggttgcacaagctgattggggtaaaatttccactcccctcccagctgtatagggccttccttttcagggtcccaattacgcaaatcaataacaccgttgtgtgctttccaatgactgtttccagataaaacacctgacactaacggatacaccggcaacgcaaccgcaagcagaagtataataaaaaataaaaccccctgttttttcataaatcccccgctcttttcaatatcgtctatcttttagtatcggttattctaaccagctgtattagaagcgctgcccatgcaaaaagggacgcccgccgcagacaaaaatctgtgcggaatcgtccccttttatatacccttgtacttcctgcatttcccttattaaggaatcatgccttcatcattaccaccgccaggaatcgagcctgaatcgtctccgctgctatcgcttggtggtgttgctccaccgctgctgtcgccgcttcctattccgctgctatcgctcggtggtgttgctccaccgctgctgtcgccgcttcctgttccgctgctatcgcttggcggcgttgctcctccgctgctgtcgccgcttcctgttccgctgctatcgcttggtggtgttgctccaccgctgctgtcactgcttcctgttccgctgctttgttgctggctggctataaaatctttatactcctgaatcgcatcttccagattcatataatttttcttgatttccggcataggataatactggtccagacgattgtatgcatccactactctgtgaaagtagaccgtcataggatctgtaccatttactgtaagcagattgttcgcaatgttcttgagctcattgatatcaagatcagttacgatccatttggattggtagttcgaaagtgctgtaatcaaatctgtgttagcctgatctacctgaagctgtgtaatatccggagtattaagcacaaggcttgcctgattaatttgcccttgaagttcttcgttatcttgttgggtataatgacggccgaacgtctgaacttcattattagctatacttatgttgaaatttaagaacatggtatccactgctatgggtgcagcatactggctctgtacctgttgcaactcctcgtatacaggaaccacgtcttgcaattcaaagctaggcaaacctaagaagatggaggcatgctctgaagcagaagacaaggcttgctgggcttcagcgcttaatgagcctgaattttgcaccaaaattccattgatcgatgcctgcatttcaatgatttcgtgtcttaattgtagtcttttctcgttatatttttcaatatagttccctttagcctgacttaattgattataagagatcaccaattgctcctcaggagtaaacggcatcatgagtgcaaagttggcttgttctgttagttgctctaaagggagcatttccgtattcaaataattacgagcgatagggtcagacagcagttttagatgaacgtcatgaaccagctgttgcagtttttcccgagttgtagcaggcactggtgcagtgaattccgcaagcctttgactcagctccatgttcaagttcaatacatccagctgcgtcatagcggtgtgcatcttctctgtatattcctgaatgaggttgcccagtccggcattttgagcgctactctgatcgtagataacctgcgcttcttgtaaagtatttttaagcactgagaagtccactgtttgcagtaccaagaatgattctgtggtagcttctattttttgtgtccattcgtccaactgctccgttgtagttaatggattcacatatacgcttaatccttccctcactaaggacttataacgcgctttatctgtgttcaaattctccacacgatccgttacatcgagaaaatgcagataggcatctctcagttttactgatgcattgtagacttcaattactcgacgcaggcttactacttcccgatccactatattttggggcgcattcccttctaacacattattgccaaattgaattgcttgacttaatgaatcatcccaaagaggtgggaattcgtcgctaaccattcgattttgctcaagggtagtcgaagctacctgaatcagtctaactaattcctgtgttccaatcaccggttctgtggctgaatctgtgtacacagaaacttcctgtttcaatgtgctgagcgcttgatctacctctgcctgtgtagctgtagtattgttgagtaccagcgtagcctgatggattgctgccgacaggctttccttcgccgtagccgggtagagtgcctgatccggtccaccctcacctgtacgatccagcagatctttggctgcatggacttctgcctccagctgactgcggtctacgttgacaatatcactgttgtgttttttcttatctttgctctctgtttccgtaacaactgatccagtagaggacgagttcgtcgtgccattcacgagactaacagcttctttcatcgcatcatagttaatgataacatcctgcggctgtttttgttccggcaggttaagctggttgattgtagctcccttagccagcgtaataaaaggaacgcccacatattgtgatgcatccagcaaaccaatactgccgctaaccaacagcttgcccagtccctgttgcaacgaaacgcggctaatcgcggcatttccctcggtcacgatcgatgcatcatttttcagcgtcaggttgtcgatcttcgtcgtcccggttgctgtcagcttggcatccttggagccaagctccacaccagaccatgccgtattttccaaaatggccgatacaggctgggtccctgtgcctttgatttccaatacgcctgtggaggacatgttcttcaaggttaccgagccattgacgatcaggcgtccttcaaaagatacacccttaccgtcaaaaacgccgccgtctgcgttaatttccagcttatttacacctgtcagtgtacgcaaattacggttaaggtcgaattttgccccttttaatacagctttgttattttcaccaaacaaaccttgcaaagatccttccaactgatacgggatatttccgattcgaacggtattgccctctgatttcacttctcctaccggatgatccagcaggctgacgaatacttccgcaccactctcccggttcaatggatttttcaaatccgttgtagaagcatcctctgataacagaccataagagcgggcaacttgaactgcattttgctgtgcattcgctgtgccggcatcctgtaagtccattgcacgtacgagcgatacgatcagttcttccttggtaatggcatcccccggacggaacagttccccgttacctgtcatatacccggctgcacgtacagcctcaatatagggagcgccccatgcatctgacgatacatccataaaagaagtctgcgactggttgttaacttccaactggaacagactgcacaaaattttagccgcttctgcacgggtcaaatttttttgtgccataaaatcgccctgattaccgcctgtcatcaaacccaaggtgcgagcttgtgttacaaatccagtttcgctttgcgtatctgctgtcgctgcataagcagtctggacgccgcccacccaaggcagagatacgattgaacctgaagcaatacccaataccatcgcagatgcaatccatttatttcgatttacaagtttcaacattttcactcctagacactatttattggcatatatcctgttatatcaaaggctttagtcatgttaagttctacgatttatgcaaccaaggaactatgctaagagaagtatacgaaaccccactgaaccgattctgaacaattagacctacacgaatcattccagagcaaaattgcttgacttggagtgaactccaaatgtaataatatccggtgtaagtagctggagtagactacatttgaagaaaacaatatctaggaaagcgaggtataatcaaatggactatgtgaaacttggaaataccggcttggatgtatcccggctttgccttgggtgtatgggctttggggttgcagaacggtggattcacccatggattctagatgaagagcgcagtcgtcccattataaaaaatgccctggagctaggtattaatttttttgataccgcgaatgtatattcagatggaactagtgaagaaattgttggacgggctttaaaggattatgcgaatcgagatgaaattgtcctcgcgacaaaggttcatttccgtatgcatcaaggcccgaatggtgcgggactttcccgaaaggctatcatgagtgaaatagataagagccttaagcgactggggacagattatgtggatctgtaccaaatccatcgctgggattacaatacccctattgaagagacgatggaagcattacatgatgttgtgaaggccgggaaggcaagatatattggtgcttctgctatgtacgcatggcagtttctaaaggcgttacatgtcgctgaaaagaatggatggacccgatttgtatcaatgcagaatcatttaaatctcttatatcgtgaagaggagagagagatgctgccgctttgtaaggaagaaaaaatcggtgtgattccatacagcccgcttgcaggtggaagattgacgcgtgatgtgcaggaaacaacacatcgttccgaaaccgatcaggttgcgaaatctaaatacgatgcgactgccgataccgatcgattgatcgtggagcaggttgcggccatcgcagaaaaacgtggagttcctcgcgttcaaatcgcacttgcctggttgctacagaaagaaccggtaacagctcccattatcggtgctacgaaaacgtctcatctcgaagatgcagtagctgctctttcgattacgttaacacctgaagaaattgcattgctggaagagccgtatgttcctcatccggttgttggcgctcagtaaatatggatgaaatgacagtttcgaaataagaaacgacaagaacgccctatccatttacatagggcgtttcttgatcagaaatcaggaggtgaagtctgcatgttgatcgcagaagtaagcaaaaaatttgaactatctcaggatacactccgctattatgaacgcatcggacttattccgcgtgtgaaccgtaataaaagtggcatcagggattacacggaagaagattgcagatgggttgaatatattaaatgtatgcgaggcgtaggacttcccattgaaattttgattgagtatgttaggttattccagcaaggtgatgaaacgatgaatgctagaaaagagctcctaatagagcagcgcaagcagctcattgcaaaaatggaagatatggaaaatgtgttggaacgcatggattataaaattacaagctatgaacagacaataggtgaaaaagaaaaacatctaatttaacccctgcgtgctttgcgggagagcagattccccaaggactgaacaccttgtacaaacaagactagaatgatgacggtaatcagcataaccagcgtatcaaaacgttgatagccatatgcgatcgccagatcgccaattccgcctccgccgaccgcaccagccatagcagtagcaccaatcagaccaatggctgctgtcgttaacgacaaaatcagagaactgaatgcctcaggaagcaaaaagtatcgaatgacctggaacggggtcgcccccatcgcatctgctgcctccaatatccccggattcacctccaacagcgagttttcgaccagccttccgatatatggcgcaatatatataatcaaggggacaattgccgcgctggtcccaatggatgtattcacaatcagacgggttaacggaatgatcgcaatcagcaagataataaacggtaaggaacgaacaatgttaatgattggattcaaaatattgtgcagccatttgttctccagaattccgcctggacgggtgacgacgagtaaaataccgatagggataccgatcagggcgccaatgaataatgatatgctgaccatgagcacggattcatacaaagcttcccacagttgatcccaggtgatcgtagttcctgtaatcatcatagactctctacctcctgaatatggactcctttgctcttgagaaaatcaacagcctgctgaacggcatgctgtccaccgcgcagttgaatcgtcatatagccaatcgtcgtttcttgaatctccgtcatgttggcaaacaaaatgttcacgtggatatcatgctgccgaatcaattcatgaaccaccggatcagaagcaacctgccctataaattccagcttgtatattcgctgtgattcttgctgttcgaacgtttgcagcacactctcgggtaccgtatcgtgaatgaccgtgcgtacaaagctctgcgtcgttgggtgctgcggctgcccgaatacctccagaacattgccctgctcgatgatttcccccttttccattacggctaccttgttgcaaatccgctgaatcaccgacatctcatgggtgatgatcaaaatagtgatcttgtattccttattgattttgcgaagcaagtcgagaattgactgtgtggtctgcggatcaagtgccgaggttgcctcatcacagagcaaaatggacgggttgctcgcaagcgcccgtgcaatccccacacgctgcttttgtccgccggaaagctcgctggggtagctatttgccttgtccgacaatcctatgaacgccaaaagctcttttacacgcctctctatttcccgtttgttgcgcttaagcagcaccaacggaattgcaatgttgtcgaacactgtctttgattccagcagattaaaatgctgaaaaatcattccgatcttcttccttaccttccgcagcccagaggttgaataggtatttaactgttccccctcaacaagaacctctccgctggttactttctccagacgattgaccaaacggatcagcgtacttttccctgcgccactgaatccgataaatccgaaaatatctcctttatccactttgatatttatattttttaacgcttcaatacttagaccttttctcacataggttttggatacattcctaagttcaatcatgagtcctaactccttccgttctcacaagtatgtaagatgttctaagctgattgcttttctttggcataaacgatcgaactaaatccgagtattctagtaagttttataaagtatactacttcgatttaatattcatgtcaatatgtgttttgagtctggttagttcacgtccttgcataaatcagcatgatattgcaaatggtatgaaatatgccgaagcatacacaccttgcccgaacgggacggaagcggaggaagatagatgaagcgaatatttaccttgtggctatgcattgcagttatagggatgttgacagttgcggcagaacccgcatgggctactcagactgttgacggacagccttatcattttgggttcaaaaaaagtaagggaggggagctgccttccatcgcacaagaaggctttatgcaactaatcgaaagacaaggtggcatctttctgggggatacgactaaaaaagaactatttctcactttcgacaacggctatgagaatgggtatactcccaaagtgctggatgtattgaaggccaaaaaggttcccgccgccttttttgtgacagggcattttgtaaaagaccagcctgatttgatgcgacgcatggccagtgagggtcatattatcggaaaccattcatggagccatcctgatatgagcaccatttcttcgacagagatccggtctgaactagatcgggtacgaaatgcatcggcagagctaaccgggcaaaaagaaatgaaatacgtccggccgcctcgcggcatttttagtgaaaaagcattggcttcctgtcgagaagccggatatacgagcgtgttctggtctgtggcttacaaggattgggacacaaatatacagcaaggaacggactatgcctatcgtcaagtcattggtcagctccaccctggtgcggtcattctgctccactccgtatccaaggacaatgccgaggcgcttggttccatcatcgacgaggctcgcaagcaagggtatgaatttaaaagtctagacgaccttaaggtgaagcattatcactaaatagtaattgaattcaatgagtcgatacgttatcagcccgatccacaactgcccatggcagccagtgtgagtcgggttttttagtttacgaccaaggaaggtaatggatataacgatatggatgggctggctgccttcgcgactgaatcgatccctaatgagggggaaaatcaagaagaccggattatcgccaaaatacgtgagttggctgaaacagttaccatttagccaaacgccaaggaagggaaggtctctctatgagccttcccttccttttaccattctaaagatagtaacgcctattgcatggttagcttatacaccctggcttcataagggcgcagcttcaaggcatgcagttgttccccttgaaccggcttgtagttggacagcagcagctccgccttagcgacaggaaagtcctcctcgggccagtggtacaccggatcacggtcaaagaaattcaaaatgaccagcaaacgctcttctcccagcatacgagtgaatacatacagctccgtatccagcggcaacagcagcttgtattcgccatagactatgacctcatgttgtttacgcagagcaatcaacttgcgataatagtggaaaatcgagtctggattacttctttctgcctctgcattaatgtgtgtgtagttatcgttaatcttcatccacggctctccatcggtaaatccggctgagggtccagcattccattgcatgggagtacgcgcattatcccgacttttccgccagatctctgccataatctgttcctcagactcaccgatcttccgttgttgctcataataattcaacgtttccacatcccggtaatcatcaatggacgggaatgcaatattcgtcatcccaatttcctcaccctgataaatataaggcgtaccctctagcatgtgtgtgaaggttgccagcattttggccgactccacacgatattgtccatcattcgcaaatcgcgagagggcccgcggctgatcatgattgttcagataattggcattccatccttcctcatgaagcactgtctgccagctgctcattatttttttcagctccaccagtgtccacggcttggatttccatttttctgtccccagcccttgggcatcaataaacatgtgttcaaactggaaaaccatattcagctcatgccgctggtcccctacataatcaagcgcctgttccggtcctaaaccagacgtttcgccaactgtcattaagggataacgttccagtaatttttcattcagcatccgtagaagcacatgtacctgttctagattggaaaagagctgataggcacgtaccaaggttcgtttgtcaggattatcagcatccggcagcccttcggctttgacaatatgggcaatggcgtcaaaacggaagccatcaactccctttttcagccaccattccaccatgcggtagagctcgcccaccatctcttcattttcccagttcagatccggctgatgctcggaatacagatgcatgtaatattcgtctgtaagcttgtcatatttccacactgaaccggaaaaatacgattcccagttgttcggatatccgccatttttgcctgttcgccatatgtagtagtcccgcttcggattatccttggacgaacgtgactccgtaaaccacggatgctcatccgatgtatggtttaataccaaatccatcatgattttgatgcctcgttcatgcgcctggtgaagcagttcgtcaaaatcctccattgttccaaactcatccataatggcataataatcactaatatcatatccgttatcgtgattgggcgatttatataccggacaaatccagactacatcaatacccagctcacacaaataatccagcctggacaaaatacctcgtaagtcccctttaccgtctccgtcagaatcctgaaaactgatcgggtaaatctgatatacaacggcttccttccaccatatttttctaggcatgtttccctcctgtagcttctctgtacatccaatagcttatgctcttaacatacacgcaatacctgtctgcgaatcgttggtgaaggggaacaagagtcttgtaagcttgcttccgcgcattagcagagccgctataacctacggagatttattttaaaaaaatattttgcaaaacaggttgtaaaagtggatctggcgttacctatatttatgaactgaccatatacatgtactcaaagcggtgccacttttgaataaaaggaggaattgacatgaaccatcgacccaaggagccaaaggatctgattgtggaaactgctgtgatcccgcccaacatccatgtggacgtggagtcagccactgaggggggaacccgccgcctgatgcttagcgataatccggagacgcttacccatgtgacggtacctaccgagcaagccaccctgtggcatgacgtggtacgcacgacaacccgaacggtcaaacatcgcattttcgggtggcattataacaaaatcggcagcgctgttaaactgggcatcaccgtagagaacagaagcgcttctaaactagcagtacgtcatattgaacgtgcccttaagattgtgcctgaggacggcaactggattatagatgtcgggcagtctattgccaaaagctgtttggcgggtacgatggaacgtctgaagccagcagaccatcataaattcggaaaaggcactgccctgctggaggaatttgagttacctgaaggatcgctggccggattcatctatgacctcacagtagaatttgctgaaggccatggtacgctggattatgtgattcgcaccgtgatcagcaaggatacgcagaccgatctgcgtcagattcatatggatgcgcttcctcccgtacctccaccccaggcgcatccacgaggggtgtggtccttttccgaaacgaatgcgcggatgccagagtacgtggtggggcagagcgccaactatcgggcgtgtgccaccaaaaagctgaacggcgagactcctgccgatctgctgtttaccggggcacgcagcgagctggggcctgcgctagataatcgcggacaattcggaaccatatacaacgcgaccattcccatcgttaatgacagtgacgaggtacgtatcgtacgaatctacgccaatccacgtgggggcgcgttcgccggatctgtacgtgtggatgattgtgtatatggtattcctctgctacgagataataccaaggtatgccgattggctgatatcagcgtccctcccggcagatccagctataatctgagcttcatggtcgccggcagtgcaactacgccgctaggtctgtacgtcattacactatagctatgctcacgatgactggataagcgaacgtggagccaaaattttcacaggatatggtctgctctatagtaaatggagctgtcccaaagctggttttaaattttattggacagtcacgcttcgtcattagtacaaaaaagcgcgagtgcaagggttattccccctatagctcgcgctttttggttcatgctcacctatttgagcggatttggtcaaacgaaggcacgtagtcctcatcgccgccatacccggcatcggcgatgaccatacccggttacccggtttgtgtcagaataaatatcgctctatttgaaccgctggacctgcctcgaaggcataatggtcaactctggaatattgacatgctccggctgctctagtgcataaagggcagcttctgcgacatcatcgggatgcagcggcaaaacgctcgaagcaaacgcccgaatttcctgctcgggatatccggccacctgcgaaaattccgtcgccaccgccccggggtgaatcgcagttacacgaattccttgcgtactggtctccaaacgcaatgcagaggctatagcgctaacgccgtacttggtagcgctgtatagtcctcctccggcaaccacttccttcgctgcaatagaggagacaatgacaacatcccccttggcctgttccctcattggctgaagtccgtacttcagtgtcagaacaagaccgtgcacattcgtcttgtaaagctcctcccacctttccagttccacttctgccagcgggcttcgatacccgaagccagcattggcaacgataatgtcaagccgtccccagcgttcaagaatggcgcggaccgcctgctgtacgtcttcagctttttggatatcggcaggtattgccataacctcgtacaattcctcttggtgcaagtcgcgaaccaattcatctaatcgttcctgacggcgtgccaatacagctacatacgcgcctcgctttgccagttttttggcaatcgatgccccaatgccgctgcttgcgcctgttaccaaagctactttcccggccaggctttccttcgctttccaggataaactcaactcatccaatatcatgttataccctccccaagcttatttggttaaaagcacgcgatgaacaccctggctgcctccaggagctgtacctatatataaatatccgtcatggttcacagccgtggttaccccataaagcgagccttcaggatcatgccagcttccgatgagtttaccctgcggattaagctccacagcaagcccatgcttcacaggtgcgcttgcaccgctgagcagcgattgaggcaatttggccatcattccagccagccacgggcttccatgcatctgatctacaaagggaatacgtgttgtgaagagaccgacccagaaatggccttgatcatcacgcgtaatgttatccggaaaaccggcaagattatccacaaaaatatccgaagtccccttcttcggccctttgagccagtatcgggtcaattggtagtgatacgactctgccacaagcacaaaatcttcgtccgcagacaaggcaaccccgttcgcaaaataaaggccttccaacagaactgtcgtctgcttggtcaccggatcatatttcagcaaacgtccatgtggcttgttctcggcgatttctttgaagactacactgccataattggaggtgtcagaaaaataaatggtaccatctttagcaatatccagctcgttggccaaatagatcggtgtgccgtcgacttgattggccaacaccgtcacgtttccggaaggatttaccgacagcaaccccttcttaacatccgtaacgatcagatttccacttgcgtcaaacataagtccattgggcgttccttgggtatctgcatatagctgagccttttgcggattacccttagtatcaaaggcaaccttataaattttcccgtcggagtctcccgtatataaatttccttccttgtcaaaggtgataaattccggaaacttaggggcatctgtaacaagctctgcggagctgagtttgttgttttgttgccatggacccgcttgttcaaaagagggggccgaaggtgcaaaccattttgcaggctggacaggggaagggatgagcataaaaataaccactcccagaaggactaccgtcagcagcgatactccggttctgcgtacccatttacgcggtttcttattctttcttccttgagaatctttgacagataaatcagctttactgggcattagattgcctcctatgtgatgtgaataatatttcagcatttgcataattcgattccccacgctcgaaagtacaatatatagacgaactaaaccgtttcgatctatatattgctgatttgaaatcgctcttgggatttatgcaaaatgctcatttatatttgaacgacgattttaccgaaatactgttttccttcagccaaaagtgcaaaggcttcgtcgattcggctgagcgggaatacccggtcaatgacaggatgtaaacgatggcgggaaatggcacgattcatattttcgaaatgttcccggttaccgacttggctgccgcgaatcgtcgcagccttctgcaaaatgctggtgacatcgaactcaggaatagtcaagcccgataagaagccgaccatgttcacagtccctccggtacgaagtgcattgatggattgcgccattgttgccgccccccctacatccaggacatggtcgactccgccgtctgtcagctccagagccactttatcccactcaggcacttccgaatagttgattgtcttccatgcgccgagatcctttgcccgttccagcttgtcattgctactcgatgtgataattacccttgctcccgccatcagagagaattgaagcccaaagatggaaacaccgcctgttccttgcaagagcaccgtatcccccgctcgcagcccgccggattccatcagcatgctccatgcggttaatgctgcaatcggcaaggtggaagcctcctcccaagaaaggtgatccggaatggcgacgaccccttcttcatgcagaacgatatattcagacgccactccactgagcgggcctcccagactgtcctttaagacctctgctctcgtgctcccgccaatgaatttctgttgtaaatttgccgctaccctttgtccaatctgaaattttgtcaccccttcgcccacagctacaatttcacccgctccatcagataacggaatgaagggaaattgaatgccgattggcattactccgttaatgattaccaaatcccggtaattcagagacgctgcccttatgcggatcagaacttccaaccgtcctggcaccggtatgtcaagttccgtcaaggttaactcttcaaagccaaaaccatttttcagttgcactgctttcattttggttatcctccctgtaatgttaaactttttacctagtatggatacatcgtattacgaaagaaacactgtttcctatgtaatacactgtatccaattgtcttcaaaacgtcaatctttactttaaaaataaaaatggtcgtaaactgttccaggcttttaacgttccttaccaagtaaaattcgagactgggtggcttcgcttgtacagaacttgctcagatgggcaagcatgaccaaaaaacgcgagttgcaaagggtgagataacctttgcaactcgcgtttttttacgttaatggtgatataagcactgtccaatagaattggaatttgcttatgccacagccttatttaagctccaacttttataaactacgtctacttaaatttgttcctgacttatattacgctactaagcatgaaattggagggcggaccaagctccggcttgccaaacaaataaccctgagccagtgatacacctgcttcacaacaaaattcaaaatcctccatctgctctacgccttcagccaacacttggcctccaaaaagaaaagccgattctacaatccctgtaatttgccgcttctgatcaatgttactatgacagccgtcaattatactgcggtcaattttaacataatccggctgaaggcaattcataagctctgttgtagaataacctgcccccacatcgtccagggctaccgaaactcctcgattgcgatattgatcaaagatatgatgcaaaaaattaaggtcgtctatctcttccgtttctacgacctcaaatacaaaatccttcgtattcatggataaccgatcaatcgtctcaaaggtgtgattcaagcaataagccggattataaatgctcgaagggagaaagttaataaaacgtttaattcccgtcggaaggcatgttgcacttttttcaatagcggaaatacgagccgagcgatccagatgagcatgcaaaccagcttcacgggcgatctcaaacagttggaaaggctgaaaaggtctctgcgcatgtgacggacgcagtaaaaactcaaacccgataatatccagcttatggtcaacaataggttgcatatggctggaaaaactttgatccttaatgatattcacgatatccggatgttgcagtctggcttgcaattgactaaataaaagccactcctcatatccttcgacatggtgcaggccggtcaccacaacttgcatatggttcaagtattcctgcggcagacgagccagtttgttaaccagctgttccagctccgagcggctatcataacgaaactctatgccaccctcacgctcatgttcctgcttcatttgttccgatagcttacccaaaccatctaatgctggagtaagcgacaccctggaatgcctaattctgagcaatccttgatccttaataggtaatatgatgctgcaattactgcatgtcataatggtcctcctcggaacaattttccggttttttcaccattatatcacaaataactagagcaaaagtactatataactacgtgtttttacaaaaaactagcttattcttaacgacaacttaggacttaagtatatattcgacaaaaacagaaaactttttgtactcatgataaattcgggtgctgttgtttttggcatcaaaaaaagcagcaaatctcttggttaaagagacttgctgcttcattctgatattgattgaaaactaaagctcgaagttatttggacgcctttggcttcgttgttttagctggtttaacagtcgcgggtttggtcgttttaacagctggctttgctgttgctttcgcgggagccacagcttcctttacaggagtcgttgctgcactaggcttagcgccagcttttaagctgtatttggcaaagccgtctgccgcgctgctcaagaatgaaatttgttgatttcctgccaacacgtctttggcatcaggagaggactcgaaagtaacctttgcctgaccaaaaggagcaatagaccagttgccatccgccgatggattaatcgttccgttcgtacggatatagtcaacaatgacctggcgactttcatccggtgctgccatcacaattcgtttgccatctgggttggccagtttggatgaggaagcacgatagttattggtggctacgataaatttctgcgcaggatcaatagcttttccattgtattgcagatccttgatacgatgagctgaagaatcaataatagttcccttggcatcatatcgtgcaggctgagttacatcaatctggtaattcacaccgtcaatgacatcaaaattgtaggttgggaaatctttgttgatcagcgattgctcctcagtttgctttggatcaatgcggttgaactgacctgcagaccactccagccattcctgaatttcagcaccggtcacttctacagcatgaaccgtgttcggatacacatacaggtcggatacgtttttaatcgctaccgtaccttcaggaatattggtgtaatactcggctccgtttcgaccgccggccttgaatggagcgcctgccgacaatatcggaagtttttcgtattcagttcctttaagatggttttgaacataccatttctgtgcattcgtcacgatttgaatggaagggtcgtcctgcactaatgcaaaatagctggtaatcgatgcagtcgttgttccaacaggttgacgaatataatccagcgttcctttatgctcttccttgatcgaatctgtcagtttgtagtcaggagtaaactgcacagcctggtttgtggtactcacaaccggacgcacttcagactgagaattcgttacgtgccactcatcttttttcttttccaggctcaggtcaataattcccagatccttgccccatgaagaagcttccacggccggcacgccattaatggttcccttatccagatctacgccgctcatttctttaaaatcagggccagggaaagatttatgagcatgcccaaacagaatagcgttaattccgtccacctggcttaaatatttaacggcattctccatcattggcgtttgtggcacatcctcataacccgtatgcgcaagcacgacaataatgtcagcaccttctgttttcatttgaggaataaactttttcgccgtttctacaatatccttcgtaacgaccttatcctttaaattggctgcatcccactgcataatttgaggtgtgaccaggccgatgacacccactctgagcgcatgctcttcacctttctcatccgttaccgttttatcaagaattcgataaggggtaaaataatttttagtagcttgcccccccttatcaacataaacgttcgcatttacgtaaggaaaatcggctcccttgagcgatttctccagaaagtcgaggccgtagttgaattcgtggttgcccactgtcgccgcatcatagcccatcaagttcatcatcttgtagaccggatggacaccgccctctttctcgaaggttttatttctagccatataatcgcctaatggattgccctgcagcaaatcaccgttatcgaacagcatgctgtttcttgtttcactacgcgcctgttggatcaaactggctgtgctaatcaggccatattcgttggtttctttgtccgaatagtaatcgtagttcatcagggatgcatgaatatccgttgtttccatgatccgcaaattcactgtagcgctatcgcgagaattgctagctgcccaggttggagcggctgaaaacaccagcatgctacaagctacaacggttgctgtaaaccctttaaaccaatttttacgaaataacaaaatatacccctcctcattaaggtgtatgcctcatatacatacttctgcacatatatgtaagccttgaacccaccatttctattttaatccaacgccacgcaaaagagtagtcatttacttaaattatttatgaaaaaataattaattttctcaaaaataaaaaaccagcaaacctcctaaaaaactcggagattcactggtttatccatttatattctcattatttattccagacttggcgctccgtttgctgacccacatactcaatgcgagtcggattcacgtccagaatgacataatcgggatcatccggtccggaaaaccattccttcaaggaatcgttccacacttgtttgcgtagcccctcatcagctgtaatctggacagtagcctccacttctacgacttcctttgtaccgccaacttcataacccagcagcagataagcattcggattatcctttagctcatccactttatgcgttttgcgatctgtcgccagatgaatgttcattccatcgttaaaaagggccatatagcgtactttcggtttgccaccctctaccgtacctaacgagcaaaatttgttgttatccaaagccttcacaatggcttgttctagttggctacgatccaatgtttccgttttacccacagtacaacaactccttttcacgaattagaattctttacggccatgccattgggcaccagcccatctgaacctacctgcgcagctgttctgaaaataacatgacccgatcagatcggattgatgcatgctcattttcagatcaaagctcacagtaaaagtgtaccctgtcgttcggcaaatgaaccgtcacctcttcctccatgctggacagacccgcattcaaggcatataatcgtcgtagtaaacccgaataaatgaacccattaaaccatacaatgccaggggtgctggaatcggccggctgagagtgtgtcccaagacactgacccttacaacctgatctgggtaatgccagcgtaggaatgcttaagcaagatgtgccttttttacataggaccatcccttactttggtatatacaagcgcaagcgtcccggaacctcggggcgctttttttgttgaagattaagttgttggaaagatcgcgtccggcagatgttatttttatgaaaatggggaacataagctgtctgattggacggataacgggtaattaaaggagagaacacaacgatgaagcgcatgaaaatattaagcctgggactgatcagtctgtggctcatggccctgaccctgaccgcttgcggtggaagtccctccacatcccaagaagcggctcccgctaccaacactcaaacgtctactccggcaaaggagctcaaagatgttaaagtcgtactcgactggacacccaatacgaatcatacgggactctatgttgccaaggacaaaggattttacgaaaaagcgggtttgaatgtccaaattattcaacctggttcaggcggagccgatcaaatggttgcctctaatgctgcaccttttggtatcagctaccaagaaggcgtcacacaggctcgtacgcaaggcgtgccgcttgtatccatcgctgcggtgattcagcataatacctcaggcttcgcagccccggtagatcgcggaattaagagcccgaaagattttgaaggtaaaaaatacggcggttgggggtctcccgtagaagaagcggtcatgaaatccatcatggattcagacaaaggcgatgtgagcaaagtgaagatcgtcaacatgggcaatgcagactattttacagccgtgaagcgggatatcgactttgcctggattttctacgcatggaccggaatcgaagcccaacttcgaggtgagccattggatatgctgtatgtaaaagattattccaaaagcctcgattactatacacctgtaattgtgagcaacgaacagacaataaaaaatgatccagaactggtcaaagcgttcatggacgcttccgcacaaggctatgaatacactatcgcccatccagaagaagccgcggacatcttaagcaaagctgtaccggagctggataaaaaactggtacttgccagccaaaaatggctaagcccgcgttatcaggacgatgccgcgcaatggggtgtgcaaaaagcggaggtatggcaaaactattcggactggatgtacgaacgcaagctgctcagcaagcctttggaagtggataaagccttcacaaacgacttcttgcccaagcgctgatcatttgttaaaacgctaaataagactgaactagagaagtgaacgaagtgccactacgcagccggatggtgcttcccatcgctgttgtacctagatttcttttatgaatatccagaggttgaaatctgggtacaatggcgaacgctaacgcttgtacagcaccattccgcccacttcgttcttttgcttgttttgcttttataaaaatgctacacaacctagctttaaaaataaggtgctttttaaggcggttggcagcgtagcggttcatttgaatctggagaagcgcagcgatcgtaagatcaaatgaaacgcgaagcggtctccccgccttaaaccaccctattttctcaaaacaactccacaataaaggacaggtgaattttcatggctaacacactgctcagtattcaagtaatccctaaaactcctaataacgaggactcttacccgtatgtagataaggcgattgaggtcattcagcgctccggcgtcaagtatcaggtgaacccattggatacgaccatggagggcgagctcgacgagttgctgaaagtggttaaagaaatgcacgaggctttgacggaagcgggtagtcccagcgtcatttcacagatcaaaatcgcacataacccacaaggcatcagcatgaacaagctgaccgagaaatatcgcccatgaatccgaaaggcaagaacgcgtcctggtggaaaagcgtatggccgccccttgtggcggtcctcttctttttagcggcttggcaaggagcggtttcctatttacatattgaatcctggctgctgccagctccatccctaatcgtacaagagggcatggcgcaatcggcgttgcttggcacccatacatgggctacaattcgtctgacacttgcgggattcgctatagggacagctacgggactgctgatcgccatcgttcttcatacgattccttttctcaaatctgctctatacccgctcttgatccttagccaaaacattccgattatcgccctcggtccgttgctcatggtatggtttggttttggcgtgctgcccaagcttatggtcattactttagtatgcttttttcccgtggctgtagcggccatggacgggctgactcgaacagaccgtacgatgatgaactatatgcggatgtcgggtgcaagccgcatgtctatttttatgaagctggagctgccacattccctgccgcaagtcttttctggcgttaaaattgctgctacctatagtgtgatgggcgcgatcattgccgaatggatcggagctagtgaaggaattggatattatatgctgctgcaaaaatcggcctatcgcacggacctcatttttgcagccatcggcattattgtcgcactcagcttactcatgtttgtggttattttactactggagaaatggttggttcgctggaaacccgatcgagagtagcttcctccttgaattaaatacagcaaagaaaggacgtagcgcgtatgagtctgcatccgattgacttatcatcacacaacgtggctaatgaacaacgagccggggaacaacagagtccttcaactgctcctcctgctttggaattggacgggatcagccttgccttccgtgaaaagcgaagcttactgcccgtactgcaggatgtatccctcacagtcaagccgggagaattcgtttccctcatcggtccgtcaggcagcggcaaaagcacgctatttcacatcatcggtgggctactcaaaccccagcagggacgtatccgtatgcacggacgggacatgactggtgaacgtggtcatatcagctatatgccgcagcagcccgccctttttccgtggcgtaccacgctggacaacgtactgcttgggcaggaaaatgctccacgtaaaagtacagcagtcccccctgagtacgccagtgaacgcgagcgtcgcaaagaagccttgcaatggctcgagcaagttggactaggcaaattcgccaaggcgtacccacatacgctgtctggtggaatgcaacagcgcgcagcctttctacgagcactactcagcccgcaggaattaatgctgctggatgagccgttcagcgcactcgatgcgctgacacgtgcagacatgcagcaatggttattacgtatgtgggaaaagaaccgccgttctgtgctgtttattacccacagcattgaagaagcactgctgctctccgaccgcatctatgtgctgtcggcgcgacctgcttcggtggtgcatgtcgtagatgtcccttttccccgcccgcgtagggaagaaatcaccctcgatccgctctttattgaatggaagcggaccatgaccagctggatgcgcgaggaaaagtacaaactggacggcgacatggacaatgctcagagcgtccacaagaatatcccggaagatggattgaatcgacatgagtgacgtaaaagttcgatgtgcattgaaatggaacagccaaacaaagccaggcttggatttgaccgcaattgagcccgctccattgatcgacgcgcatattcatgtagacagctacccgcctgaacaacaggagttattgctcgcttcacttgccgatagcagcgtccaagccgtgatagccgtgtcgatgcatctgggctccagccgagccaatatacagttagccaagcgttaccccgagctggtacgaccagcctttggctttcatcccgaacaagctcttccaccgcaagctgagcttgacctcttattcgactggatggacgaacatatacagcagatggtcgccgtgggtgaagtcggcttgccctattacaatcggctggaagcctcacagagcggttcaccttttgacctcgctccctacatagcgctgctggagcgttttatccagtttgcaagcaagcataacaagcccattgtcctgcacgccgtttatgaggacgcagatatcgcctgtgaccttctggaacgtcacagcgtcacgcaggcgcattttcactggtttaaaggctctgccgccacaaccgaacgtatggcgcggaacggctattatgtctccttcacaccggatctcctgtacgaagaagagatccgcagtttggcaagacagtatccgtctgatcagatcatggcagagacagacggtccctggcggttcgaggggccttttaccggacaacagacacatccacggatgactgccgacgtcattcgcgcgtatagtaagctgacccatcaagatgaatctgccgtccgtcaattattttatgaaaatacgagacgcttttactcactatctgattgataaagtcatatcagctatttactgaagattacaaccacaacatgcaaccaaagcaaagaacctccttatttacgcgggacttcatcatgcgtaaataaggaggttcttgtattttgcagagtttttgtcgctactcagcttttattgctttaagaaacccttctgttccaaaaatggcttcaactgcaaacgtgctggctcggtcagtctcgcggccatttgctcagaccatggcgtagagcgttgaccgcccgtacgctccttcaaatattcggctgatgtgtggtcgtatacctctacagctttcatcgtctgatttttgtcgtagccgttcatatgcaaaacaccggacagcggaagacgtgggcgcaagcccgtttcctgatctggtacaccaatacacataccgaacactggatacaccagctctggcaaccctagcaactcagagacctctgctattttagtacgaatgccgccaatgtagacgatgcccaggcccagtgattcagcggctaccgctgcattttgtgcagctaacgcggcatcaatggtcgcaaccgtataattttcgacggacccttcataggaaggctgacctggctggtggtggagtgtgacctgcttcaaacggtacagatctgcgcaccataccagaaacgcggggcattgctcaacataagcctgccctcctgccaactcggccagttttgtttttaaagaaggctcggtaacggcaataacggtatatgcctgcacattactggacgaggaagccatttggccagctgccacaatagctgcgagctgctcgtcggtaacggcggcgtctgacttgaactttcgcacagaccggtgattcatcaacaaggaaatcgtatcattcatgactgcttcactcctaatccataatttaagctctttatctacttctagctgtgagtatacgaagaagttcttgcatgcttgcatggcactcctacaaatattatgaaactttcgcgaatgataagcaacctgacgtgatgagggttaacagtatggtttaaaaaaacaaacgcaacaaaaagcaagcacgcagaaaaccaattgtgcgtacttgctctatactctgataataactttatctcgctacagatgtccggcagcacgctatcctgctggtgcatccatacattttacagcttcacccgttggagacgcagtgcattcagcacaaccgaaacagagctaaatgccatggctgctcccgccaaccatggagcaaggaagcccaaagcggcaatcggaataccgatcacgttataaccgagcgcccaaaacagattttgtcgtatgtttgtcatagtccggcggctcatttcgatcgcgtcaggaatgctgttcaggttgccgcgcatgagggtaatatccgccgcctccatagccacatccgttcccgtgcccatcgccatcccaatattagcagtagccagcgcaggcgcatcgttaataccatccccaaccatagctacgatcatgccttgttcctgaagccgtttcacttcctcagcctttccttcaggtagcacctccgccagcactcgttcaattccggcctcggcggcaacagcccgcgcagtccgttcattgtcacccgtaatcatgatgacttcaatgttcatcgcccgcagacgggcaacggcctcccgtgacgtttctttaatcgtgtccgctacagccaccagtccggcataggaaccgtccacagcgaccagcatcgcggttttccctgcgttttccaactcattcatatactgctcggctgagtcatctattgggatgccttccctgctcatcaatcggcgtgtacccgccaatacctgcttaccttccacatgcgccttcacaccataacccggaatattttcaaaatctgtcggtcctaccagctcaattcctcgatctgcaatcccctttacaatggcttccgccagcggatgctccgagcttttttctgctgcaccgagcaaccgcagcaaatcgttttcagccaagccgcttgcaccaaccataacatctgtcagctctggcttgccgttcgtaactgttcctgtcttatccaataccactgcgttgactgaacgggtcatttccaaatgctcgccacccttgaacaaaataccgtattcagcggcacgtcccgatcctgccataatggacgttggagtagccaagccgagcgcacaaggacaagctatgacgagaactgcaatcattttctccagtgagcctgcaaaatcagtcggcgtcacaaggaaaaaccagacgataaaggctaacacagcaatagcaacaacaatggggacaaaaataccggaaatctgatccgcaatccgctgaatcggggccttagagttttgtgcatcttccacgaccttaataatccgggacaacgccgtatctccacccacacgctccgcctgaatacgtagtaccccgtttttattaagcgtcgcccctgtaactgcggaacctgcttctttttcaaccggaagactctcaccacttaacatggattcgtccactgcggaacgtccgtccacgaccacaccatcgacaggaattttctcgccgggtcgtacaataaagatatccttcacacgtacctgttcgatcggtatatcaagctcttgtccatcacgtactacacgtgccgtcgtcgcctgtaggctcatcaggctcttgatcgcctcggacgaacgccctttggctaccgcttcgaaccatttacccactaaaataagcgtaattagtactgcacttgtctcgtaatacagctctggcatggtcatgacaggcattcccgccatcccctccatgacatcagacggacgcagcgtaaggtacaagctgtaaaaataagccgcagacgtacccagtgcaactaacacatccatattcgaactcccgttgcgaagcgctttgtacgcgcccacataaaactgccaaccaatgacgaactgaatcggcgttgtcagcattagttggaaccatggattcaagaacagttccggcacataaatccatgacgtaaaggaaaaatgagccaccatcgcccacaacaacggaaacgatagcactgcggacacaatccacttccattttttacgatggatatccttactgcgcacatccgcgatattgtcctcagcgctctgcgggatcgctccgtagcctagctgttcaatcttgctcaccagatcaccaaccgcaatactccccgcggcatattccacatgagctgtttccatcgccaagtttaccgtggcacctgttacaccaggcatccgattcaatcccttttcaatccgggttgcacaggccgcacaagtcatgcccgtcacattcagattggcttcttcacttacagttccaaacccaagagaagcaattttatcgcgaaactcagggatctccacctgcttgggatcataggatatcgacgcctgctccaaagccaaattcacattagcctgtgccacaccatctattcgatttaaacctttctcaatacggcttgcgcatgcggcacaggacatccccgtaatatgaagcgttgtctgcttgtcaccgtcggttgcacggttttccatggtaaccctcctcttataccccggtggggtatatcatatccaaaaagaaaaagcttctaatatggaagcttctccttcgaaacaagtctttcacacataaaatatcttcaacttaaacaacatcatagccttggtcttcaatggctattttcagagcttcaacgttcagcttggactcgtcatattctacattcacttgtttcgtttcgaggctgaccttgccggtagcgccaactttctccaaagccccttctactgctttcacgcaatgattgcagctcatgccttctacgttcaatgtaacttgtgccatttcttttcctcctcagggatacttccgtacccataatgtgtatgaatactactcttaacgaattagctttttgaccgtaaccagcagctcgtcaatcacttcctgctctcctgcctgcatgcgctcaatgacacagcttttcatatgcccttccagcagcagcttaccgacaccattcagtgcggactggacagccgcaatctggttcagtacatcgtcacagtaggtatccttctcaatcaagcccttaattccgcgaacctgaccttcaatacggttcaaacgggatacgaggctgttcttgaactctgccgaatgatgactttttctaactgtcttttccccgtctgttccacagtgattctcatggacttcagtgtgggaaacaggttgctcctcagccatacatcagcctcctgtgtggtgtatatatgcatttgttatacccctatcataatatacccccacggggtatgtcaaccttccagaaaaatgtcactttttcgtctcaatttttgccactgtctctactcaagcgaattaaactgatcaaaataaggttgaagcaacttcatatgttcctcgtaatcttctctttctctttcagacaaacgatctggatacagtaccccattctcgccagttatacgtgggatatacttgaaaatctccgtgaacagtacacgaaactttacaaattcatcctcagtcagaacctttttcgcatagtccagctcgacctgtaaatcgatgcctgcgtgggcctttacatctaatgtgcccgtaatggcagaatcaccgccatcttttttaccatcgtccgtttgggttagcacttttccctgattcaacttgtcataatacagctccagcttggcagatatatgatcgtattcacgctgttcctctgcgcttaagcgctccttgtggagtgcgccgttttcatccgtcattttcagattataggcgccgagttctctcaataaccccataaaaacagtgaactcctctttcgttaaatgcccctgcgcctgctgcaacttggattctactctattatattcctctggcgatcctcccatttcaattagcttttcctgtgaaccatacattgtatccgccaaataagtgtaagtagcaaaagcacctgttggaatcagtaataacactacgagaagagttatcacaatataccttttcataggtttagatcctcctttttcaagccgttcaatttgacccataatgttttcttttaattcagccggagccaatatgtggtcatcatcctgctgcatcaccctacgtagttcttgctcaagcttcatggatcttctccacctttccgattagaaaatgttcctgctgctctttcaatcgaagcttttgcaaagccgcgtgaattcgtgatttcaccgtgcctaatggtatctctaaaatgttggagatttcctcttgggaatattcctgcaaatagtgcaacacaatcacctgtttaagcttgaatgaaagctgcttaacagcatataacaacgcatgatttgataccttgttcacaatttcttcagaaaaatcatgagatgtatgaagttcgagcctctttgctctgcttgtgattcgtagcctcatccattgttttctccggtaagtccggatctgacgcataacgactcccattagccaaggctgaaaaggacgtctttcgtcaaattgctcaagtgatttatatacatgaatataaatttcctgcaccacatcatcagcatccactttctcttccaacagaaaatgcaccgttctatagactgtatgaattgtttgatcatacagttctctgtaagcctcacgactgccagccagcgtctccgtaacaagagcaatcatcaaatcattctttgtcaaatttgcccgcctccttgcgttatccaatcctgatctccccctttctttcatctcacatctatatattggaaggaaaccgaaatatcgttcgattctgtctcagcatcaggaaaatagtctccgcataatcattctttagcaggactactcttttggtaatatattgatataatattaaagttgcaattcccacttggcttgtatatatacaaacgagcaataataacaaatcatacgtcgaaggagcttattagaagtcaatgaaaataaagattacacccttgttacggcttatccaaggcctgttgtggtttaaaatccttgtaatcattatcgcaggatgtgtatttatttcagcccaaccgacaggtggggagtcgcggttaatccatatggcctcccgcacgctatccatcacacatccacttgaaggttctaccgctcatatggtcggatttgtattcggaaaattgctctttcgattacttcctacaataatgatcctgctgtttattgcgacaaaaaagtataaacttacccttactttactgctcttcgtatccatttttggtttaaacatcaacggaatagaccctttctttcccgttcatatctgcatgcttatttccattctggttcacaaaccatctcgtatgtacttaaaacagacacctctgcccgcaaaggaagccgaagatatctcgattgcaaaacggtaaaaaactcccatggactgaaatggttcacgtatcagtccatgggagttttttagttcaagttcgccttatttcaagccttagcgcgtgcttccttagcaagtacgacaaagcttaatagcgcaccaacctcagctatagctataacgaccgccatcggtacgggggttgttccactccccaagcctactagcggtgaagcgatggaacccagcaatagaggcaacaaaccaagcatggcggacgcactgcctgcggagcgctgctgactctgcattgccaatgaagtcgtcgttgtacttacaatccctacgcaggaaacgacaaaaaacagaggaactaaaacagcaaacaattggcctccggtaaaggctacagtaagcaagctgattccggctacagccgcaattaccagacccgacaagagtaactgtcgttcgctgaagcgacccacgagtctacccgtcaactgcgaaaacagtacaatccccaaaccattcactgcaaaaatgatgctatacgtctgaggggaaaccccgaaaatatcctgaagcacgaatggtgagccagcgatatacgcgaacatcgctcctgtaatcagcgcctgtgagagggcatagcccataaagcgtcgatcggcaaacagatgaccgagtgttcccagcgtctgcttcaagccaccggacgagcggcggttagttgccaacgtttctggcaaacccaacacgacggcaattagcatagccacgccgactacacaaagcaccatgaatacaccacgccaggaaacaaagttcaatatgacaccgcccagtactggtgcagcaatgggggctacgccgttcaccagcatgagcagtgagaaaaagcgtgtcaactctttgcccgagtaaagatcacgggctacagctctggaaatcacgatcccggccgatccggtaagcccttgaataaagcgaagtgcaatgagcataccgatattcggcgcaaacacgcataacagcgaagcagcagcgtacagaatgagcgagatcaccagcggtcctctgcgaccccttacgtcgctaagcggaccagcaacgatctggccaacggccagtcctaacagacaggcggtcaaactaagctgcgccagcgaagtggtcgtatgcaaattgtcggctaatgtaggcagcgacggcaaatacatatctatggacaacggcccaaaagcactcaatgcacccaggacaaaggcgatccataatattcgcgatttggtcatatctgccgcaaccataacagtattggataaccggttcataataataatcatccttttcacaaaatataaataatttcttcaatacatcatgatatcactcatttcgtctagcttcgaataattacacgctaatccgcaattttttttcaaaactgctatatatcaggcaggaatttaccaatttcaggtcgaattatacggtaaccaaaacaaaaatttgtggaatctggagaatgataatggtctatgatggagtgctactgggtctcattgtaggtctgttcagaggaggctggcggcaaggtctgatccgtttcagtcaaattcgccttatagccggctggatgttccctgtgctgctgctggtacaattcattattttttatgcccaggaaaagtgggcttggctggcagccattaacgggtatctatttatgggagtctacgtggttggattgatatttctctggttgaacagacatcataagggattcaagcttattataatcggcgtattgatgaattttatcgttatggcggtgaatggcggcaggatgccggtctcgttgagcgcttcggaggtgctgggtccctattatacagatatgcttaaatccggaagtgtcatctcgaaacattacatgatggatgcgagcacgcgtctatcattgcttggtgacattattcctctctccaagccctatccccgcacgcaggtaattagtattggagatgttgtcatgaacttcgggatgttcctgtttatccaaagcattatggtcgtgaagagaactaaggataagcagcaagaaaccaatccccaccacgcctagtgcgcaccttattccaaggaagggagggaaccctatgaaaaacttgaaatactcccgtgtgattatcaatgctattatcgtggcttctgtcataattgctttgacttccggttacaaaatcgggggctagtcaccgataagaaaaaaaggaagcacaggctcaacaaaacaggctggattccggcctgttttttcatgtgaaattttcgattacaaaattgtaaattatcccattcacccctggtagctttgacatcaagatacgacaaggcaggagaagaaatgatgagtataataaaaaagctgcaagaacgggttaccgcgacgggaatatacgtattttgcatatgtatggtaggcatgatcgtcctcttgtatacgaaccaatggtcctttttgcactatacgacaacagagtgggtcacgatctattccctattgggagccgttctgattctggagcattttacattccagctcccccccgccagtaacaagcagtctatggattcctccgtgtatctggcttgtatttttgtgcatggcaccgaaattactattctaattttgctgttaaatgtaatcatcgctatgttccggcacacagagttgtcctggtggaaacataccgtcaatttttccatttacgctctttccatttccctgtcttcaacagtatttgagctaagcggcggaacgcagggggctttaaaccaagatcattttgtttcctacctgctggccttgatttgctactttgcggtgaataccatcacactgggcatctacttttatatcgcatacaaagggtccttcaatgagcttaaacaggcttttttggctgaatctctgctcgtatacttatgtacactcattctgtctttggtattgactacactgatttatgacaatggcattttaggacttttgctgttccttgggctaagtatgctcctgtctcacgcattcaagcaaatgttcacgctgtatcgggaaatcgaagaaaaggcgaacatggatcgcagaacagggctatacaatcacagctactttgaaaatacacttgaagctgaattaaatatatccagatccgagaatactcctctcagtctggctctgattgatatagatgatttcaaaaaatacaatgatcatttcggtcacctcaaaggcgatcagctactgggatttctcggtgaatttcttaaaaaggagacctccggcacccacatcaccgtatcccgctatggtggagaagaattcaccctgctgatgcccgatcataccgctgaacaagcatacgaaatagttaatactattcgaaaaagattaaatgattctcgttatgagggtgttgaaatttttccacacggctgtctgtccttctccgcaggcattgcacaaagtcgcattgacatctacgacaaatcacagctggtcgatctggcggataaagccctgtactacgccaagaaacagggaaaaaacatcgttcatacgcatggaagtttaaatgaagtggagcgcgaggtcgatctggggcaggatattcgtgatcttgaacagcagcttaatttgttcttgtacaaggatattaacactttcaagcattccaaacgggtattcagatatgcagcagacatgagcgatgtgcttcagctcggaccagaggataagcggcgtttcatactaggtgccctcattcatgacattggtaaactggagattccctggaatatcctcaataaaaaagagaagctgtccgctgaggaatggcagatggtgcaagcgcatgtcatgtgggggaaacgaattgtcgaagccaacgaacgattcatagatttggttccttttgtggagctgcatcatgaacgttatgacggaggaggctatccgtttggctttaagggcgagcaaattccacgtttatgtcggatgctgacgatcatcgactcttttgatgcgatgacaactgagcgcccctatcaacccaccaaaacgttcgaggaggccattgaagaactacgtgcttgctcgggtagccaattcgatcccaaactaacggctacttttatccattatattcaacataagcaacctgctttcacggatttcatggaaacagggctctaattccttcattggctcttcctctttgcccctagcgtggttgaagtcgtcctgaattcaaccacgctaggggttttcatatgattggcattttgtatagtgcttattatttcaaatttcatataaatgtcataattcgctccatctattcacgctatatgcactatgattaaggtaggaatgggtttgtccgtataaaatgttacaaatggggatatcctcgcttcaagtaatcgagagaaggtgacttcacaggcatgttgtacctgtccagaccagcccgtgtggcttgtcttttattgctgtgtctcccccttctaatcctgtttcctcactcttcgtgggctcatgcatttgtcattgaatccagtccgaccgaaaatcaggttttggacaagtcgccttctcaggtgaccatcaccttcaatgaagatttgcaatctgccttcatgtcgatcaaagtgaccgacgaaacaggcaagcgggtcgacacaggaaaagcacaactcaacccgaatcataaagccaccatggaaatccaattgattccaggggtgaaaaatggaatttactccgtcaattggagagctttatccgcagacggacatccggttaatggagtcattccatttcaagtaggcagcggttccaatgcgcctacccatcaagctgccgcatctgaaggctcagggacatcacgaatcgacttaatcgctgtccgttggtttctttacataggactatcgctgctttttggagcgatttgtttccggctgttcatcttaccgagcataagccaagacaagaatcgaagtgaacagcatcagcaaaatcagcgtccctttgacacattgccccgctggactaagctgctatggagcggctacggcataacgtctgccgccattctgatcagcctgccacttcaggcttcatgggatgccggggtttccatcagggagggcttctcactccctattctgggagaagctctccagtttactggagccgggcaaatttggtttatccagatgattctcgtgctgctcctaagcgtaacgctgatttacgcgctggattacagcatttcgaatcgccagcgccgtctttggggctacagctcagctctcctaacgctatgcctcatgctgtccaaagcctttgtcggtcatccggcagcggctacccatccagctccggccattgcggcggactttgtccatctcgcggcagcagctttttggatcggctcacttgccgtcatggtcgtgtgcctgcctgttgccggagcggagttgcccgtatccgagcgggcaactctgcggcaagccgccctgcgccgctttgccggctggggcattgctatggtggcagcgctacttgccaccggtatatatggagccgtgctgtacattccggccccctccatgttgctgaacacgtcctatggactcgttctgctcggcaaggcagcgctgctgctagtcatgcttgcctttgcggccagccagttccgcagcgcaaggcaagcggcgcccagcaagcgagccgcccggggattgcgtgccgaggtgtccgtcggcctgctcgtgatgctgttgactgcggtgctcactcacctgtcacccggccaggcacctgctgttccgtttgaggagactcgcactacgggcggatacaacgttacgctgtcagtcagtcccaatgctgtgggcagcaatgaatttaaggtatccgttcaggatagcaagggtgctgccatttcaggaatccagcaggttacattaacgctcactccagcagaccctgaccaagatcaacaggaatttgttctgcccgtgaagcagcaacagccattccacagtcaggaattgatgacctccgaaggaacatgggcggtaaaagtacatgctctgacggcatcactcgatgcggttgatgctgaattcaccctgcatgtaggcggtaaaaaataattattttatgtttaaaaggagcgaattgaatatgaatacaacgattcaaacagcaaaatccatattttccaggtttgcgacctctgtgggtctaattgcggcgggtgccttactttttgcaggtatggccagtgcacatgtgacagtcaagccttctgtttcacaacctaatgcgtgggaaacgtacacattgaaagtacccgtggaaaaaaacattccaaccaccaaagtcgccttgaaaattccgaaagaggtcgttttcaaacaatacgagcctgtaccggattggaaagtagccaccgaaaaagacagctctggcaaaataaccaccgtgacctggacgactgaaaaagacggtattcaagcgggtcagtatcagcgtttcagctttgtagcgcaaaatgcagaccagaataccgcagcagcctgggacgccttccaatattacagtgacggaagtatcgtggaatggacaggcgacgaaggaagtaacaatcctcattccattaccgaaatcacggcagatgccacatccgcaactcctgcccctgccgcagacagcggacacgattcagcgggcacggcagcaggccatacgagcacagatgcggctaaagatagcagcagccccgcacctgcttcgaacaatgctgtagaagctacacctgccgcttctgctccagccagctctgctacacaaaagacagcactcgtcctctcgatcattgcagtcgttcttggtgccgcagctgtcggcattgcactcaagcgccgcaagtaatctgggttacgtataaagttaagatcgttttaaaagaaaaagccgacacctattttagaggccactgaaaaagtaaatttaataagaaccgtcgaaaaaacgagcctctagaatcgcttctaaggctcgtttcgtgttcagggaatcatatttgaccccctaaagttttggttattttaaaaatccgatagtttttcagcggcctcctattttaaggggtcagctttttttgccatttttctgtctagaagagtgtagccaatccacactctcttctacttattcgctataacacaaacatcttttaacattagatgccgtatttcactactataataactccttgatcgtcaatcagataaaatttagcacactaaattatttttttgaatattatccattttaaattgagctaagatttggttttgttaacgcgaataaatcctgttttacattaaacctcatggtattataaccgtatttattaaatttgtatcgaatataacgtgatacttcttcctcatgtgttgaaataataatctgcttatctctaaattcattacgaagcaattcagttaacgaagccatgttgatctcatccatagtttgcactggatcgtcaatcaaaagcattcctaatttcttattcccatagactttgtttaaggcaagcgtaaaagcaataactaaagcggatagttggccagaactaaaataattcactacatcatggtcattgacattatctgatacaaactttagactcttcgcttcaccagaactattctctttaataaagatgccgagacctttctgatagtattgtattattttcccactataaataaaaaacgggatttctatatctttcataatttcattccaatgcctttttatagaagagttataaacttctactattttatttatttcctcaattcgtgccgttaatttattatacttttgaacttgtgtgtcaatttttttattcaaatcatctatagtttctgagcgctttgagtaatataaaatatcaatatatgttttcttttcaacaatcatttctggagatattttttttacatcctgaacattctcattaaatatttccttatatattgacttaaacctattataagtatctctgtcaggtatattttgtgatgtatctatgtgtttatacatttgaattgcagaagccagttgatcaatcaatacctccatgtcagctatagcagtagtatctttcaaaatataaggctctaggttgaaaccgatagtctcacaccacttattacaggaattaatttttccctttgactccatgctattatttaatagactgaaaaatgtaggatctactactcccttcaagttcagttgctcatctatactgaaaataattggttcaatgtacattgaaaaaatagtattgatctgttccaccaaacgagtcgtggcattatcataatactcagaaaaagcatctcccttacgttttacttcttctaataagtaatccaattcgacccaattatacccacaaagtggacattctactcccaatgcatgttcatgctttatctgtattaaatgatattgttttaatagtgtttctctagtctcattcatctgcctaacaattgaagaaagtgaattcgcttctttcttagtattgataattcctgatatacgagtttttagatcatctatatcaaattgatggcctacatctgtaagtaaagattcaaaattaacgtcttctgggttttgggtgaatttttccttgcttagttttgttaacactttacgaagccgttcttccttatagtatttggctttagtctcctcaaatttatccaaaaagaaagtggcagtaataactccctccaacaaactccggttctgacaaacagcatctatttctacattatgcttcgtttctaaaaagtgatcgaattggtttacaaacctcatgagttcatcgagttcttgtatatattcatctttcgtctctctaacccttagaattggattctcctcatcccataatttggttggagataaatttgggaataactgagcataggggatttgagaggagttattactctcagtattcacctctttttgcagagtccctagtgacttcattagaagttctttatcttttttaattctcgttacttctttagacaaaatatttttaatttctagaatagattgcttttgattctcctccttttttgtatcaaataattgtcctatttcattcatacgctctttagatgtttttttaagaaagaacgtgttctcctcttgttgaatatagtaaaaaagactgtaaaatctggaaaaatccttcatatcaaacatctcatcaacttgtatttgactcaccggcctccacaactgtttatcgttatgaaactgattagaaacatacgttttaaaccgcgagaaatcatccggtcgatagctttcctttccgctgttctcgggaatcatttttattagtgtaaaacttttttcactttcatctgtaaattccagtttgatcagacactgttttgatgaatccttgcgtagtaaatcttctgagtaagcctctctcttatcgtcatttttaattctatatagcttacctgtaagtactagctcaaacacatcaaacattgttgttttaccaaaaccatttggaccatctaacactatcagatcctgtccttcgcaatccaattccctctcccatttagcaatatgcttaaagttctcaacatacattcgctttaatctataattactattcataactttctcccatcgcccaaataagagttttcttaattcgttcctcgtcaactaattccatctcattaatttcattaataaattgtaatatatcatttcttacttccagtaacctcttatcgttcaatacattctcaatttcttcagccaatcgttcgatgtcctcattaaagttagagaaatgcagaaagggcaacttaatgaataatttagcaacaaggctgtatttgctttctttgaacggatcatttttaaattcataaaactctttgcggtcattaaggatgctgtaaagttcgttacctacagcaatatctgcctttaaagtatctacttcggctgtcgtataaggcaaaaccagttttttaaaatgatagggatcttcctctatttcaaatatcaaatgatttaaattctcattaatcgcttccccattatggtgtagacataagaggagggatacgtttttatccattcgccgatcatatccgtcctctaaccttttcaattctctaaaataagtatcgaattcatttgtcaactcttctaatagtactgtttcttctttaaataaaataataaaataagttgcacgattattattagtacttaccgcaaaaaaaccctcctgattttgaagaaattccgggactattatcttaaactcattatcctcaaaaatagaagctatcagtttcttcatgactccagctccttcttggccatttggtacgtaagcattttaacgtttttgattttggtaattttactataatctttattttcttcatctatatcatatgatttagtatgtttatcagcagcctcttttaaagagctcattggtatgcgtaaagaaatcatgacatctacctcatgcaagtcatctatatctgaattatttaatatcctttttgcaatagatgacatttcactctcgtccaacgtttcatcatcatctaaagttggaaattcaaatatagcggtaggtaagtatacaatatgatccttattagaatttagcttctgaaagacaaaatctccatcgtgtacttcggcatttattttataaaaaattcgtagcaaaggattctctattccttgatcaggaatcaatttacgaaacgccattaagttgagttgattagcctgtacatgtggtgtccactttttacaaagtttaacgaacgatttatcatccaatgattgaattgaaagtaatactctgctaagtttttgatactcatccttattcgaatcatgttcattcttatagagatactcttcacaatgtcgatggaaaacttcacggaggtaatgacaataaaaatcctctgatgattcctcaaaattgtctacgagaatttcatacaatgtttcaaatggaattactttattagaattatcacctttttgaatagctatatgtctttcattaacatgctcatccaccttagctagcaaatagagaaacgctctatcaatgtgtaatggagttcttgagatttttcttaagctatagaattttttcatctgccctttaatctgttctgtaatactattaagcgggcagtaatcatctccagagtcatatacatacttctttaaaatcccaaatgccttattgtaattcccccgtttattgacctcattataataatcaagtgtcgtgaagtttttagtacacttggatgatgtaggtgctcctaagccaattaagtcgctttccatagttgtttcacttggaattttctcagttgtatgtagaaaactttttttaatagtagtatccatagttgttttgcctagtaaagtccatagtgcattcttatacgcgccaatattattagctttatatgttttaacctgatgaatagattcgcagataccaccatttttaattgagaaatcctcagtccattcgatttccaaggcatatgtctggcacgtactagaatctaaattattcttgtttaaaatatccaacgctacgtacacagcggctttaccctgatagctgtagccattccaactgctcgttgcttcatgagtcattgtttttattgtttccatttttttgcctccattctcatattatccaattaatctcatttgagtaagcattttttataagtcattatccatgtactaattccaaaataataaaactttcttttcttcccaagctctcaaaacaaaaataggcctgaaggattattaaaataaagaataagacaaaagtaataataccattgcccccccaataaatatgtcgatttgtgtcgttaaaaacaatttcaaaaaaaatgaaacaatatttcaaaatattttatataaaaggcttaatcttttacgtcctattcaatatgtgttattttttagggttcttcaatctctaaagcgactttaaacatttcagtaatcatgttatctttactactcaatgaggcccacatcgtcactttacctattaaagctattaacttgacagtatcgataaatcctctattcaacagacatctgacatcactacaacgaggaagcataaatccatgtgaattaatcttctatcctcgtgaaactatgaaatcataagtcactaaacttagtaattattattcgctacatactaaagaggctagacggatattcccatctaacctctcaagagtagttgtatttcctaggtactactgtgatattattcttaggacaaatccttatagtttaaatttcaccgtgttgtgctggttggtaactagatcctttatcttgaaattgtataggtgcgaccactactgctactagcataaaactggttaccaataaggttaaaaatattttacgcttcatcttcccccacctctttaatcaattttctgtacgcttccttcgtctcagttagtgcatactcttgataagactcatagagccttacacatttaattatatacgatttgttattgattaatgtagatttttccaaacaacttaataaaaaagtaaagccatcaaaaaatcttcctttggtcaaataataaactgataatcccattgaaaaatgtataatgcgttccgttatgaaccgctgagtataaaaactttcgattttttgttcctctaaataagatgaaatttctaccttgaattggttcaaaatatcatttacatcaaaatgataccgatttgccgcctcaactataatatcaagcgcaggaagtaactcgtcttttcttgaagaaacataagttacataatcagctagaacgcttgtatctcctgcaaggagtttattcaagtaggtgtttattattgcccattctttaaattgttccttccatttcaaggtaatctcatccgtatcctttatccaacttaaatcggcataaacaattgtgtactggagagcctgctcaaaatctttgctcgcttcacaaacttcagctcgaattaagtaagaaaatgcccagtaaacaaatggaggatagaacggtttccttgcttgttcgctctttttatgatgctgttgattaattttgtattgtatttcagctttatttcccagtattatggcaaatgcattcattttagcccatttccgcagagaacgatatgtattcaccaaggctcttaatgcatcaagctggtctatctcatctaaccgttcaatgtaaggctcgaattgaacggctgcatcatagtttttctcttgatcgtctccaacacgaattgtaaacaatcgatactggcaaattgcgaatctatccgaatgttgattcttctcacttactgctacattttcgtacagaaacgccgccgcttcattgtaaccttctttgtacaccttttcagcaacttcaaagagagatggcagatatctaggattatctaatagcaaaaatacaactcgctgcaaacaatctagtcgccctagttcaatacatctgtatagaaatgggctgattttcttccagttgagtggaaaatcttcaatacactcttcaatgtaacgttcgtaaaaataatcaggtgatacattcatccctacagtaatgcagtctagttggtggacagagagaggacgattccctgtcacaataccactaactgtacctgtattcagatcaatagtgtgaccaaactcggtcatggttaagccttttcttttcaaataagtttgaacttctgcccgtatcgtaggtgtgatttccatggataaaccaccctttcaacataaactcatcatttttatgcatagttaaataaattatgtaattgagaaacaagtagtaaaatatatttattttatcggtcatgattataccatcttttggaacaaaatcatatacatctcagatatttacttaagataccttttgggatagtttacaacgatttcttgattaacggcatcttcatttcacattcacctttctatcatttttttggtaaaatggtagaaccctcacgattctaacatgatagcattgcaatctattgagcataggagatcataggatgaaaatcgtaaataaggctctgttatctagtgctatttttctgagtaccgcagcgggcttctatagccccttggcacaagcagagaccggtaagatcagcatcatgctggacggatatccattaccgttccccgtacaacctgccatgatgaacggcacgaccatggttccctttcgcgctatttctgaggctcttggcattacagtgaaatgggatcaagccagccaaagcatcaccgctaccaaagcgcaaggctctgctaccaagcaggtggttctaaagatgggtagccgcaatgccacagtggacggacaaacggttcaactaacagccgctccgcaaaccgtgcacggtagcaccatgattccgctgggctttttcgggcagcagtttggagccacggtgaactggaaccagggaacacggacggtctccattacatcgccacgtgaagctatgtatacagtaggcttctatgcgctgtcttcctttgaccaaaaatccaaaataccggattttaacgcagttgccttcggctggagtcgaattgatacgaacggacaatttacgacaaacggcaaggaatacaaatggcctcaagccgctggaaccgtaacgccggagtccattgtgcaggaggcagacagccaggggacttccccttacctgatggtctattccggagatggcaatcacgagctgaccaaagttttggaaaatgcgcagcttcaagaacagaccatttcccaaatcgtcagcaccgccaccgacaaacaatttaaaggcgttacgctagacctggaaggattgggctggagcggcgataaagctaaagcgcgttcagactacaacgcctttattaaaaagctatcggccaaagcgcatcaagccgggctcaagctcaccgtcgtgctgcatccgctgaacagctcttactctggctatgactacaaaacgctgggcaatctggcggacgatctgatcatcatggcctatgattacggacagaaggctactcctgagcctttggaaaaagtggatgaagccatacaactggccttgaaggaaacctcgcgggacaagctcattttgggaatttcgatgggtagcgaaaaagacagcaccgttaacgccaagatcggtttagccaaacgttatgacctcaaaggaatcgctatatggcgcttgggcatcattggagaaacagcctgggcacagatgaacgaagccatcgagtttaaataagtgtatattttatctaaataaccctgaccttattccgcccgctaatgatttcttatgcgtcttctatgaaatcatttggcgggctttcttcattccccttaacagaagtgcttgcctgatttggaagttgtcgtcacaggctcgcaaccctgttctccatagaagatcccccagtctctcataaaatccagcaacggccttaacgtatctcctaacggggtaagcgagtattccacacgcggtgggttctcattataaatttcacggtgcacaatgccatctcgctccaattcgcgcaactgcaaggttagcatccgctgtgtaatattaggcaaggtccgtcgaatttcgttatagcgccgcggtcctgtggtcaaatgatacaagatgactcccttccatttgccgcctataaccccgacggttttcgctaccggacatccaaaattaacgctaactgcatgttccatctcctgtgccatgtataccccttctttctgtagaatgtgtaaaccaatagccccagacgtatgacaaggaacaaatatgtgcgtacttgttccctgcaaaaactttctatatgataactatatattcgatatcagctctcattatagtagcagaaaacccatagagtaccaactaaacctatacccaaaggagtacattttatgtctaatacatcagctaaaaaacaggaaattctggacgcctttctgttcaggcacgccacgaaagaattcgatcccaatcgcatcataccggaagaggattttcagttcattctcgaaaccggacgactttctccaagctccgtcggttttgaaccatggcagtttgtagttgtacaaaaccaggcattgagagaaaagctggctgcagtttccagcggcggtcaaaagcagattcctgcggctagccacgtcgtcctgattttggcacgcaaggatgttcgttatgattctccttacgtggagtatatgtataaagaggttaaaggtatgtctgaggaggactttgcctcactgccaggccgctataagattttccagggtgaaagtcaacgtctgctggaaaacgaacgtacgttatttgactgggcttccaagcaaacctacattgccttaggcaatatgatgacagcagcggctcagatcggtattgattcctgtccaattgagggctttaactacgatcaggtgcatgccattttggaggaagaaggactgctggagaacgggctgctcgatatttcagtcattgccgccttcggttatcgtgctcatgaacccaagcgggaaaaatccagacaaccactggaaaaggtcacacgctggattctgtaaatattcgtccaatactgttagtcaatctttaagtttggcactgcctaacaggcgggcttgcgatcattcatcttaacgatgacccattgcagcccgcctgtttatttaaattttttttattctacaactttttgcttatagccgtagtcaagttatcctatataataagatgtatctgcctaaaaaggagtacagtacacgtggaaagatcagagatattgacaaggattgttattgtcgatgatgaagagttggctttggattatatgaagcgtctgcttggcgagttacaaggcatacatattgcaggagcttttacgaatccattcgtggctaaggattatattctacttgatgatatagatatagcttttttggatgtaagactcccagggatcagcggaattgaattagccaatcaaattttggagcacaaaccccatattcagatcgtttttgttacggcttacgataagtacgctattcaagccttcgagcttaacgcactggactatctgctcaaaccggtcacgacagaacgtctcatcaaaaccatgaatcgcattctgaagcgtgacgatcaagcctccatgcctgagaatcagccttcagttcttcagttacaggtttttcaatatgtcgtcttcacgtacccgaatcagcaacccactgttattcagtggagaactaaaaagactcaggagttgtttttgtacttgctccaaaatcatgaccaatgggttcgcaaatcagccttgattgaattactatggccagaatatgaggaagataaggcctactctcttttatatacagccgcttattacattagaaaagcgatagcgccgtatcattcctttttagagatttccaatactaatggcggttatattttgcatacacaaaacgttctgttagatacagaaagatgggagtcccttctggcatccgctcccctgatgaacaaggaatccattccctattatgtaaaaatgatggaaatttataaaggggactatttacaggaatatgatttttggtgggttgaaagtgaacgccaaagactgcataaaatgtggttatccatatcattaaaaatggcagagtggtatagagggaactcccagcctgaagaggcgatctctatttatgagggcatctgtagtcgtcacccccaagaagaggaagcctactggggattaatgaagacctgcgctgagatgaataaaaataacttagtgatcaaatggtatgatttattatcatccgccttatgggaagaacttcatgagaagcccaatgaacaaattacaaattggtttaaagagtggcaaatggctcatgcctaattttttacgactgggagtaattctccggaacccgtagagtccccattagaaccgtcacttacttcgcctcgttctgtataggacctacgggacagagatattaagtttcctgtctttgtgccttgggaacatggaagcctaccgttgtaccctggttgggaagactgctaatatacagccctttaccgtatacttgcttcaaacgtcgatccgtatttcgcaatccaatcccgctatcctgttcttgctgagggcctagcacatgattcagctcctcttgactcatgcccacaccatcatcaataatcgctatttctgtgccatcctcccgctgctgaatacgaatgcacaatgtgcctccatgtatccgattcatgataccatgcctaattgcattttctgcaagtggctgaatcgataacggtggcaataacacggatatctgttcgtctacttcccatacaatatctagtctactcccaaagcgttccttctctatataaagataagattttaggagagcaagctcatattccagtgatacgactctatcaagattttgagggttaaagcttgatcttaaatatttaccgaactcttcaataagtttcaccattctggtgtgatccacatgacttaaggatgcaatggtattcaaggtgttaaacaaaaaatgaggtttaatttgtgcctgtaaccatgcagcctccatccaaagcctctcccttgcggactttttaacatcagtcaaggcacggacccttgatttcaattccatggaatccacaggcttcataatgtaatcgttggcccctgcaagaaatcccgtatataagtcctcctgctgactacgtgctgtcaacagcaacacaggcagctccgaaatgctaaagtattccctcacacgccgagttaactcataccccgacatttggggcatcatgacatcggctataattaaatcccattcccgatgatccagcctatgcaaggcaccctgggcactggttacagttacaaggtcgtaaggctccgaggcgagaatgccctctaacacccttaaattaaccggatcatcatctactgcgagtatagcagatcgtgcagagcctgccgcaacctgcatcacagctgcattctgtagagctataaaatcagtacctgcttcttcatccatacacacctgctcgttatcgcgtgattcgtctggggtaggtgagggatcaagcggtagtgtgaaagaaaaggttgagccttgaccaagctcagagcttacactcaaagatcctccatgaagctccaccaattgtttgctaatactcaaccctagtccaagcccatccccaataaccgtcaaatgagaatttccttgttcatatggacgaaatattcgcttttgcgtctcctcatccatcccaacgccagtgtcacgcacctgaatactggccatttcgccttggatgtgtgcgtgaacggaaatggtcccctcagcagtatgtttaacagcattgtgaaggagattgaacaggatttggattactcggttttcatccgctaatacatttggaaaatcagcagggatgtttactaccatgtttagaggtttcccatctgtcatgaattgaagcatatccaacacacccgaggctacggccttgggcttcaagcttcttttttccagaataatatccttttcacgcagacgtgtaacatccagcaaatcattcaataataaggacatacggcggccgaccgtaacgagcaattgcatgtttctcctgttgggttcatctaggacgccgccctgattctccagcacggtctgtgctatattgatcatcccatgcagaggatttcgcagctcatgagaggtgttggccaaaaattcatttttcacctgatcagcgcgctgcaatctggccgacagccttctcagttcagcattcgtattaaaaaaccgtttgaaccaataggatgcaaatgccacaaaagccaacacaatatcccaagggtaataggggagatcattcgttttgaaaatgccccacagcatgctggatgcgatgctaatggatgctagcaacagaaaaacagcctctttttgccctctgaatgttctaagaaaagcaagggagggaactgtagcacatagagtaatagctgggaatgcgataatagccataagaaatgcataaaggctggatgtaggtgcaagtaacaccagaaccgcaaaaccacagtggcctataaaaacaatctgaatgattcgggatcgaatcaacagagactgcgctagcttcagtacacacatgcctattccaatataggaaagggtagttatttttaacgaaagacctagatttatggggaaccattccaataaaagcttgtcatcgtctgtcaggatggataataccgtgcagattacaattcccgcaaaatacagaagcgccttcttttgtggattcataaaaaatataacgactatatataacccgtgaagcagcaaaataatacataccataatttgcattgagatcgtgaagttggttcggctattcacagcatccgcgcttccaaaaatgataggcttcataattcctccactagcagaaaaatcaaaattggatacttggatgacaatctcaatggcctggctgttcgcatcaaacatagcagagaatggaacagttgatcctatatgctgttcgaccttgctagagacctgaccactatgactaattaaacggccgttcacaaatatgttggatgccgtactgatcttcccgatccgaagtccgtataaagtgtccaacgatctgtcactcaaaataagcagccgataggttccaatgccatatgccttatgatccacaggagataccgactcactccataagcctggtacctgaatggactgacgctgcttctgcataagtaaggatttcagttccgcaggagaagataaagttccaggataaaattcccactccccatttaatggtagggtctttatctcctgtaaattcaagcccctcagatccagaattcccgccttggcccggggataatcctgattgtggtaataatcaaaccacaacaaacgcaagccgataatcacgatcaggaatgacagcgtaattaaaagaaagttccgcttattcatccactggtgatccggcaccaaacatcagcgtatcgttgctggtctctcatctgaaccagcagcattggatggtgaccaatcctcatagtttcacaaccttgtctacataaatttcatttatcgttctttagcacagattgcccttgctactcaagcaacatacgaaccgcagtaaggacaattccaatcagaaagcctgtaagcgcaccgttaatccgaatccactgtaaatcctgccccagtttatcctccattaaggcaatcagtgaagcatcatccattctatttacattttctcggactagattaccaatttggctatggtttgcttccactactccggtaacacctgctacgatccacgagttgatcttgtccagcagctgcgtatttctccataaatcagacagcatttgatccagtaagggtacaatgtatgtcgttacataatcggcatcctccatataatccagcagatagcggcgcagctcttcgagcttctcggatatagctgcatcaccttcccaagaatcaataaaggtgtttttccaatgattcagcccttccctgaccgtatctttggctgccaggcggatcagctgcgtgttgataccttccaagacggcctgacgacgcggatgtccttcatcttgaagctccgctacgcggtccagcaaaaagtgacgaatcatctcgcccatacgctcctcattcaaatagccaaggaaggcgttcagggcaaactgcataagcccgctgacctgcaagccactaacagcctgcatccccagagtgccaagagcaaccccggtgtctgaccgcagtagccaggactccgtctgctccagcgcataatccaacgcccgttggtcatacttccgctcgccagcttgccgggcgagtgcctctagcaatggccctatatcgaattcagtcgcctgtcgcttaatcccggttgtgatgaccggggccagctctgccagtggaagcgaacgaacaagttgcttgacaaggacatctatgaaagtgaccgcttcgggcgtacgtattcctttttccacatttttcagtaccagctcagccagtctaatctcggcaattttagatgcaatactttctttatgaagcaaattgttctcgaccgtgttaaccaaggcatcggtcagcttgccccgatttttggggagaagcgctgtatgtggaatcggaatgcccagcggatgacggaataacgcggttacggcaaaccagtctgccaatcctccaacaagtccggcttcaaaagatccagccaaaagacgggcccagccaaattgttgaaaaggtaacgtagcagcaaagcctgctcccatcatcacaagtgaccaagctgctgcggtttttgtgtttttcgtttttcccatcctgtagtcctccaaactgactgtaaaatttgtttcattacttctgtagtaccatcatatcattgcctgtacagataccaaaggtcactgtactctcttgcgaacaaattgcatgatattcaaaattttcacattttcttaaattaagttcgcataaccacacttatccatacattttcgtgaacaaaatctccacaataaagctataactattttctagcaaaatgagccctttgaatcattttgtcgaaatatggtcccatttttcccgataccgaaaggatatataactcagaaagtggaattgcaagactatggtatattcattgaagaaactaattttccccagcctcatccttttcaaataggtactttatgttatatttgttatatattgttcagtccctaatcgctacatgaattactttaatgtgataaaataacctttgtaaatagggactccggttctaaaaggatattcgtaaaacaaactacaattatcttactaaaattgtttttttgtaaaggaattggatatgacaacaaaccaaaaaaatgcccagtatgtctggagtgaagatccagttgcaattatatgtacaccctcttctttcgctaaaaaatccctcttctatatacaggaaataggctatttcaaaacagatgcttatgtaatggaacgacaaaagctcacctcttttttgctccttttcaccctgtctggaaggggggaattgcaatatcgagacaaggattatatattgaaacctcatgatatgctttttattaattgtgaagaatatgtacagtacaaaacttcctgtcagaagacatgggagtttattagtgtgaatctacatggcaatcttattgaccatttctatgaacaattcgataaacacaataagcccgtaatctcactaaaggattcaagtgcagtattggacaagctgtacaccttattacaggtacagccagaaagaagcttatcctctgaactgctctcatccaggctaatcgttgacttgttaacgattattttgcagtacccctacaccaatcccaacgcgaattcagatggaaccgcagaggtgcgcaaggtaaagcaatatctggatcaatcctattgtgaacggatcacgctggattcacttgcagacatgttcgctctaaacaagttcaacctggctaaaaactttaaaaaacagattggcttttcccctattgagtatcttattaatgttcgtatcacggctgctcaaggctggcttaaaactagtgatgtagctattgtagacatcgcacaatatgtgggcattcccaacacaagtcattttatcaatctgttcaaagagcacattggagaaacgcctcattcctatcgcaaaaaatggggaaaccgtataaaataggtcttatgtataatctgcaagcttgttttgtcgataaatagcgaaaatttgagatttaaacttgcctaatagagtacctaactgatagaataaatatacaagctattcaggataaatggcaaacttgtcgaaagacaaggacgcaaagctacagggccttctgtatgatggcagccagctaccggttgaagtggctttttgtcgtgcttttttttcgaaaactttatacgaaatggcaaacctgtcgaaaggcagggacgcaaagctatagggccttctatttatgatggcagcctggccaccgaaaggaagttttttatggggaaaatgatattttccacacttctcctatttttcatgctatccgcaatactcttaaattcgacaatttacgctgctgatagtgttgtatggttggatcaaaacaatgtaaatcatgggacggtcagtgtgcgttactccgttaaacctaacattaaaaccaagattttggttacaaaagatgcgcaaaaatactcttataatctgacacccggaaagtccgaagaagtattccctctccagatgggtaatgggaactatagcatcagtattttggaacagcttaatggtaatcaatataaagtgataggacaagatacgatcgagttaaagctaaacgatagcaaagcggtatacctcaattccgttcaaaatattaactggagcggtactaatcaagcgattcaaaaagcccatgaattaacccaaggcgcaacaacggatcgtgagaagcttcaaaaaatttatgattacgtcattagtcatatcaagtacgactccaatcaggccttcgccttaacgactgactatctaccgcaaattgatcgtacgttaagctcgcaaaaagatatttgctatggttatgcttcactgatggctgctatgttacgaagtgtagatgtaccaaccaagctggttatgggcaaatcttcctacgtggacacttaccatgcttggaacgaggtctacatcgacaatcaatgggtggtcgtagacactacagtagatgcagcactgtataagggtaaacaaaaattcgaaatgatcaaagatccctccaaatacattaaaacaaagcaatattaatatcaatgtttttattaatattattttaaaaaattaaaaaatgaagaaatagaactacatttctttagagccttgatcacatgatcaaggctctttttctatccttgttgagaaattgttgagatgtggcatgtattctagtccagaaagacattgaggtctaacccattaacctaatttcgggactaaaggaggtaatattcatccccgaatgtaaatttccataaattatgaacaagaaatcaatgcggctaacatagcatcagatgaatgattgatgaatatataaatacagccctcttgacctcgaaggaataatcattagccgctaaataaaagtattttaagaataggagatttgtttaccatatgagaaaaaaatggaatacagcagttgttgcgttattgctctttttgcaatgcttattcagtacaacacaagcctatgcacaaaatcccgactctgctctgccagtgaccccaggaaccgatccggttcagagtgtgactaacgatgtatatccaaagccctcagagcctattaacatcccacctgctgtcccggctccagccgttgaggcaactgccagttcaacttctgaagtgagggcaactcaggaaagtattttaaccaagctaaccctcacagattcctctggaagtgttattgatgcagtgtataatcccgatagtcgtattgatattggctccgccatccatttagggtatgaatgggagctgccgaaccatacgtataaagctggagacacctttacctttcaattacctgagcaatttcaaatttacacagacattacatctcctctgacgaatacggatggagaagttggtcatttcaccgtagaccgccaaggtaaagtaattatgacttttaatgattacgtggaaagccactctaatgtcagcggtaagctggaggtcaaaaccgattttagcaaacaaatagaaaaaggcagcacacaagtcattattgcgattccaatcaaaggcggcgagcaaacggctatcgtaaatattaagcctgcaactggccctactttggaaaagcaagggaaattcgatggaaaaaatcgaattgattggacagttgacgtaaataaacaattggattctataaaacacgccgtagtaaccgacccaactccccaaggattggaactaatcaaagattccatccgggtatatcatttgcaaatcaatgtcgacggaaccaccgtgctacgggacactgttagtgcagataagtatacagtcgaagctgatccggccgggacgggctttagaatccgctttaacgaggagagtataaacagcgcataccgaattcaatactccacgaacatcacaagcgaggataaccgtttctccaacacggctactttttcaggagacaatgtgaaggatctctctgcatcagctactgttaccgttaaacgcggggatcttctaagcaaaaaagtagagcaatacgatccagtcacacaaacaatttcatgggcaatcaaatataattttgccaacaaaaaaatccctgcagcaaaagcggtattgagtgaccgttttaataacagccaacaattcgtcaccagctcacttaaagtttataaaggggatacgcaagaggagcttcctgcatcggaatacagggtcactccagttactgacgacaacggtaccaacggtttcaatctactgttcaatgcagatattgatgccccatataccatccgttatcaaaccaaggctatagatcgtgtacttaaaaatggtaaaataacgaacagtgtaacatcggacggagtaacaaaagaaacaaccacagaactgaaaagtgtaattatcaccaagggctataaggaaccgaactataacaccaaaacaattccttggatcatttccattaatgcagataaatatacaatggaccaagtcgttatcgacgaagtctttccgaatggcggtctggcattattgccaaacacattgaagatccaaagcgcggatggaaaaacaacactaacatcgccgtcagactacgaactgatccctcttacgctagattataaaaaagggttcactatacgttttcacaaaaaaattcaagacacgtatacaatcagctatacaaccacatttaacaatgaatggaaaatcgacaaaaccaaaccggacttttggaataaagcctctatcacttggttatataacggaacaacacaaaccgcggaggccgaagctcgattatggccggacaatatgacccagcaaaatggggctaagtcaggtagctacaatgccagttccaaacaaattacatgggacattaaagccaactataaccgcaaaactctaaatcatgctgaaataagggatacattattacagggccaaaaactggtgccaggttctgttaaagtgtatgatatgaccctgctcgggtggtggaatggcgtacaaaagggggccgaagtgccttcgagccaatatactcttgttttaccttccgctgctaacaacaatgaactgagcgtccagtttaaccagtccatcaactctccttactggatcactttccaaacgacactggaaggagagcttatggataaagagattaacaataacgctcaacttatggatggaaaaaatccagactcggaatgggcagccaaagtgactgtgcctcacggtggagaatacgtgacgaaatccggtactcagaatggaaataaaatcgattggaacatccatatcaatgaagggcaatcctatgtctccaacgcgaaaatcgtggatacgcccagcaataatcaaattctgattgaggattcttttcatctatattccaccaaggtatctgccaatggagaagctaccaaggacactgaattagtcaaggatcaggattataagctaaaaataacaacgactgctcaaggtcaggaatcctttgagcttgcctttacgaaggctatatcatcgggctatattttggaatatcaatcctttattcaagctgaagacaaggcaaaagtgagcaataaggttaatttcgagggcgaccgtttgaccaccgaaatcagggaaacaagtaaagagatcatcgtgcgtacatcctctggttcgggatcaggaggaggagttacgggaagtctggagattaccaaagttgatgaggacgatcacaataaggttctatccggggcacgttttgcactctatgacaaggatcagaaaagagcacctcttgtccaaactaccaattcggacgggaaaatcgtattttcttcattgagttatgatgactacattctggaggagcttgctgctcctgaaggctacaaaataacagcgccaaaaacagaaatcaaaatagatgcaaccatcaaacaaagttcaggcattaaagaaatcgtgatcaccaacaaaaaggacactccggttgatccgggtccaggtacacctactgatccaagtacgcctacgaatccaggcacgcctacaaatccaagtacgcctacaaatccaagtacgcctacaaatccaagtacgcctacgaatccgggatcaggtaaaaagcatgataaggaccctgaaataactgaacctccggtgacgcctgttacgcccgtaacaaccgaagagccgcaaattatcgaagatgaggatgttccgttgggcgttccgactattgaacagccacctgtggaaccagaagtgcaaccacccgctgaaccaggggtgcaagctgacacaccagaagcagaccctcatcaggagccttctccgcccgtgaagattgaagaagatccagtacctaaaggtgtaattcgtctaccggcagaaggaccagaagatccaagtgacccggggcatacacccaaggtggatacattgccaaagacaggagaaaacagccctgctcccttctatgtaagtggtatgttcttaattcttctgggtgcctacctaggttataaacgaacacataaaaaataaataacattttataatcaaaaatcccccttctcagctcatcattagcgagaaggggaattattttacatgtccgttctatgaattactgtattaggaggcttttcaattgcgtaagctggcatacgtgagcatcatgttaggaatcatcattatgttatttcctaccgctaatgaatggttggaaaatcaaaggcaaaaagagctattacaagaagctgaatcattatcaaatacagatacatccgatacatcgacactgactcccgaaatgattaaaggttatacagatttgtccaattggctgacaaataccgcagcagcggatgggccacaattgtctcaaactactcccccttcgtcggctccagagcaagctccaatcgctacaatccagattgatcgtatcgggctgaaacttcctgtgctcgaaggtgcgacccaaaagcatatgagatatgccgctgtacatatgtcggaaactgcgacactcggccaggtggggaatgctgccatagccgctcatcgctcacgaacaactggacgtttatttaaccggcttaatgaggtgaaaatcggggatcagattctaattcacactcggggtgaaaaatacgtatacaaggtctacaacatttcagtcgtcactccttcaaatgtctccgttttaaaaagcatcaagaaacaaaagcttctcacactaattacctgtgatcctcttgtaaatccgacacatcgactcatcgttcatgcaagacaactgacctaatgccgctaatagaagcggaacaacctataaactatattggtggtgaccccattgagtatatctttaacagccttacttctaattggcctaactttggtgttgtggatatatatgttgatttttttacattctgtgatgatggaaagaaattcactgcggaaacttgcctatcaggaccctgtaacgggtctgttcaatcggaatgcacttgagctattttggaaacgaagcaatggcaaggagggttttgctattatgtatcttgatctggatggattcaaagccattaatgacacatacggacatcaaatcggtgataggttgctcagacgggtaagcaatcatttactccaggtgacaaactccaatcagaaagcttttcgaatcggtggtgatgaatttctactcatgatgaaggattatgatgccgatcaggtcacagttctagcagaactgctgctgcaaaaaatcagcgctccttataacattcagggaatcaaccttcaagttacaggaagcattggtattactatgcatccttctccgaagaagcctctgccttctttactgaaagaggccgatatcgccatgtaccaagcaaaaggaatggggagaaactgctatgctgtataccagaggatcaaacagaggccaagcgtcagatcatatgacactgcacgaattataaagtttgcggcttgttttcgaaaaaaagcaaagatccaaagtatacaacaaatggcaagcttctaacactaacaaagatacccgtaacatcaaatcaggcgggtaagtcctgtttatccaagattatacccgccgataaaatattcctactccaccttaccctttgcaatcagcttgaaatcatcaaagtggaatcctggtgcaaccacacaggttaccagcacaggctcatcccccagcggacgtgccgtttgccatactgttcctggtacgagtgcttgtggatgctgtcctgcctccacatccgcaccgacgataattaccgtttcttcgccaggctcttctccgcttccacccaatttcaactctacagggcttccgctatgatataaccacagctcatcggaatggaccacatgccactcggagaactcgcccggatgcagcaagaaatacgtagacgaagctgcaaagcgcggaccggaatatacatcaggcagcacaggtttcggaatttgaaaattagccttccacatctctttgtaccaaccgccttctggatggggctccatgcccaaagccgttacaagcggtgaaatagctttcgtcattgtactaaccttcctttaccctaaattccttcttccctactgtaaaacatagcgttgcttttgtcacgtttctcccttggcatgtcgaacgctattattttatgtcaaattaaataacattaaattgtgaatattcatttgattttatcatataaatagcagttaacaagtaaaagaacataccaaatataatacgcgtaaagttttatgacataaaatcttgttttttattgtaagcttatagtatcatgagagaaattttgaaattctaatagagcttgattatgtcaatccgtctactaagctatgtatccaagcctaaaaggggtgagctctctgatccagtttcgcaatgtcaacaagcattacggtcacttccatgtactcaaagacatcaatcttcaaattaaggagggcgaggtcgtcgtaatcatcggtccctccggctcgggtaaaagcaccctgcttcgctgcatcaatcgtctggaaacgatatcggatggggaactgatcgttaacgagatccctgtacacgacaaaaagatcgatattaatgccttccgccgcaacatcgggatggtgttccaacatttcaatctgtatccacacaaaaaggtgattgaaaacattgtactggcacctatgaaggtactgggcatctcgaaagaagaagctactcaaacagccatcacctatctaaagcgcgtcggaatcgaagaaaaggcacagagctaccccgcccaattgtccggtggacagcagcagcgggtcgcgatcgcccgtgggctcgcgatgaatccaaaaatcatgttgtttgacgagcctacttcagcacttgatcccgaaacgatcggagaggtactggatgttatgcgctcgctcgcccatcagggcatcacaatggtcattgtcactcatgaaatgggctttgcacgtgaagtggcggaccgcgtgatttttatggataaaggacagattttggaagacagccaacctgccgaattttttcagaatccgggtgaggaacgggctcgcctgttcctgagccgtctgattcatcattaaacagactaccaatgtagcgtaaatcgaaaggggaatgttctgatgagaaaaagatttcaatggagtactttggtgctggtagctttatcttgtctgctcgtgttggcaggctgtggaggcaaagaaggagcggcaacgtcggggaatgaggcggcaacagccaacgggctggaagcgatcaaacagcgtggcaaactggtcattggtgtgaaatacgataccaagctgttcggactgaaagacccggctagcggaaaagtagaaggctttgatatcgacatcgctaaggctgtagccaaacatatttttggcgatgaaaccaaactagaactaaaagaggtcacgtccaaaacacgaatcaccttattgcaaaacggggacattgacgccattatcgcgacgatgaccatttcggatgaacgtaaaaaacaggttgatttcagcgacgtctattttaacgccgggcaatctctgctcgtgaaaaaggggagccccatcaccgggctggagtctctgaccccaaaaaccaaggtgctcgccgtgaaaggctctacctccgccaaaaatatccgcgaaaaagcacctgaagcaacaatattggaattcgaaaactatcaggatgctttcaacgccctcaaagcaggtaaaggagaagcattgactacggataactctattctgctcggcatgcagcagcaagacccgaattatactcttgtaggcgggaacttcacagaggaaccttacggcattgcagtgaagaagggacaaccggaactgctgcaagccattaatgatacgatcaaggaactgaaaagcagcggtgaatacgataagctccacgagcaatggcttggggttaaacccgaatagtattcttgtgaaggagccgccattgcgagctccttcctttcttaggtctggataaggaggtacattcacagatgcttacttttgatatcaacgtactttttgatcatagcgaccgtttcagagaaggcttgcttcataccgttcaagctagtgtcattgccttgattggaagctttattctgggggctattattgccatcctccgaattgcgccttttaaatggctgaactggatcggtaccgtctatgtagaggtcatccgcaatatcccattgctgatcgtcgtactgtttttttatctcgggcttcccactttgggcatccctttggacggattcgtatctggaacgcttggattgaccgtatacacggcctcctttattgctgaagccatacgtgccggcattcaatctgtgcccaagggtcaatttgaagcggcaaggtcctccgggttgagttacaaccagacgatgatcagcattattttaccgcaagccatcaaaattgtactgcctgcgatcggcaaccaattcattaatctggtcaaaaactcttccgtgctggctattgtggccggactggacctaatgtattactcggacctcattaactcggataccttcctgcccatcacagtctacgccatcacggcgctgttgtatcttatcttgacggttccgcttagctttcttgtactatacatggaacggcgtctgtccaaaacatcctaaggagggaagcccgtatggatttcggtggattatttgtgtggcctaatgtgcgttttatactggagggcttcctgctcacgctggaggttgctatttactctatcgtgttcagcttcgttctcggtatcttattcggcatcctgcgctatactcgcttacctgtcatttcacaggttgcagcctttatcattgatctcattcgcaatcttccattattgctcattattttcttcatcggtatggttttaccatccatcggattgtcgatttccctcaagtgggcagccattacaggcctgtcgatcttcgagggagccatgattgccgagattgtgcgcagcggtctgaattcggtccataaaggacaggtggaagccgcacgttcctccggtctaagctactctcaaaccttatggcatatcattctgccccaagcgcttcgtcgcatggtgcccccgattgtcagccaattcatttccctattcaaggatacctcactggctgtcattatcagtttgccagagctgacgcataacattcagattgtcggtgggcaaaatcaatcctttgtcattccagccctgctgttcgcagctttcctgtactttgctgtcaattacagtatgtcactgattgcacgcaggctggaagttcgtacacattaaagctcgtgatactcatcagcgttgccactagttggaacgcactgttagtacagcttgtatcttttcaattaatcgcttcaatgcttctccctgataacggccagaccgataaatcaactctagctgaccctggagcacgccgcacaaaataggtacagtgcaaaattgtgagcgatccaattctgccgcaagggactccgtctgtagggttacggcaagtccctcctgcacccagcgcaggattgaaggtatggaatttgtctccaagacggttgcaaagggatacccgcgatcccggaagcacttctcaatcagcttcctgccgggatgacactctggctgcatcgcccagggtacatgcctcaattcgtccagggtaatggaagagcggttggaaaatacatgctctaccggaacaacaagacagtagttctccgtacgaagaggaagctggacaagcctttcatccgtacccgaatgcagtgtaatgccaacatccattcggttatccagcagctgttctgttacatcaaatgatggatggatgtgcaggctgactctaggaaatgactgatgaaaatggataagcatttcatgcaatgactcctccaactccggtaatgcaataccaatccgcaaactcccgcgttgctcggtgcgcaactcctcaatggaagcctttgcttgctgcaaatccttgagcgcatgtgcactgtgttgcagcaacaacttcccggcatctgtcattttaatcttcttacctgcacgatcaaaaagcgtcatgcccaattcctcctccagcgccttgatttgcaagctgagcgtgggttgggagattccgatcttttccgaagcttttgtaaaatgtagttcctcgcatacagcaataaagtattgaagctgacgtatttccgtcttccttctctcccttcgagaatccccagaatgattgcatgaaaggtcaaaagaagcgcaagatcggatccatccggttcgcgcttcttcttcaggttattgcgcttttttgagattattgggctacttctgctttttccgcagtcagcgtaatattcgcaaacgtgtctgcatcgtactccttgccgcgggtaatatcgtaattggctacccgattattcactgcctctaacgagtaacggaataacgtcggtacgatgggtgcctcctcgctcatatacgcctgccactgattgtatatatctttacgataattgtcgtcaaaggctttcacagacaccccttcctgcaacagcttatcattctcttcactggtaaagcgcgagtagttaaagctggctccgcgtccatacagcccactagggtttatatctgtacctgtactccatgcgccgccaaaaatatcaatgccggggtcatccttttgcacacggtcatagaaagaattgaactcaagcagacgaccgtccaccagttcgacatgaagcccgacatccttccaattttgcaaataaaacttcgccagcgattcggctgtcgcatccccgctcattgctgcataatggagtaccagttccttgcccttagggtcctcacggtatccatctccattggtatccacatagcctgcctcgtccagcagctttttcgccttgtccgggtcatacgtgatgccctttgcattcatatcatgatatcccttaaaggcaggcggaatcagggatgttgctggaatccgaagtccatgatagagctgcttgccgacctgctcattattcagcgcatagccgagggcctgacgcaatgacttgttcgccagcttggcgttcgggtccatgatatttagattcttggcctgatcgaatttgcccatcttaaagcccacatagctataagataattcctcctgaccgagaaactgtacatttttcggattgctggcctcattgtaacgggtggttggatagctggcccagtcaacttctccacttttcagcgcctcggtaatgacattcgggttcaccaccttcagatgaaggccatccaacttgggctcaccgtggaaataatcttcatttttgacgaattccacagattcacctgtgaccatagatttaattttgaacggtccatagcctatcggatttttacggacaggatcagatccggccatatctttcacggggatattctgaaacacctttttctccagtggtgtagaccacagtcccgatttcaccgaaggattaggttccttgaaatggatggtaacctctttttcattcagcaccttgatgccagaaatggttttggccttacccgcgtgataatcctccatgcccacaatgttggtcataaagctatcataacgcggaccttcatagtctttatgaccaatcacttcataggaaaaagcatagtcctctgccgttacgggattaccatccgtccagttcagcttgggatcaattttgacagtcacagccttattatctggggaaaaggaaattgtcgccgctcctttatcgtcaatatttagattggagtcaatcgaaaacatagaagggtagaaaaactggaagacttcaaaatcaggattgccttcataaaatacaggattcagaataccttcaaaaggggtatcagacacgagtgcataattgatgatgccacccttaatcggcgccttatcgttcttgaccgccttcgccagcgctgtcgcattcacctgcttgctgtcggaccctgagccgcctgtaccgtcagacgatttccctccatttgaagcggaaggcgaaccgctgcatgcggccagtgaaaataccaaaattgcagatagaacaggcagaattccttttttccagtgtttaaccattgtaaatccctccttgtcattgtccttatccttgaacttcagttaacccaatcgttgtctggcatccgtggcgcgtttgagcgcctggccaataaagttaatcgccagcattagcaccaaaataagcagtgaggctggcaaccacatccaccagctattctgcaaaacatccgggtcattggcataactcaccagtgtacccaagcttggcgtagattccggtaagccaaagccgagataagaaagcccggtctcaatcccgatattccccgcgaggctgagggtcagattgacgatcacgaccgagctaagattgggcagcacgccaaaccaaatgattttccaattgggtgtgccaagggttttggaagcctgcacataatccagttcgcgctccgacaacaccttggcccggataagacgtgctttcccaatccataaaaaggcagtcataatgaaaataaaggaccctatgccgcttttgggtacaatgctgacaaatacgataaccagcatcaaaaacggaagcaccagaataaaatcaatgattcgcatgatgatgttatcgaccagtcccccataaaaaccagccagcaaacctaacgttaagccaatagcggcggataacaatgtaatcgtaaagccgatggtgaacgaattgcgggctccaatgaccagctgaccgaaaatatccctgcccgctcgatctgtccccagccaatgcactgagcccggagcttcacggatcgcacccaaatcgaccgtcgtgactacatcctgatttacaaacaggacagaggcatatataaagatcaagaacagaattacaaagccaatggaaaccaaggacattttgtcacgcaccagctcacgacgtagtacagaccaactggatggtgatttacgaatgatttccggcgtgaagacctcctccacctgtatagacaccataatccctccctttctctagacttgttcgctattcaattcgaatgcggggatcgactttgcttaggatgacatcagataaaagagttcctaatagcgccaagaagccagagatcatgaccagcgcgttcacgactgaaaaatcccgttgagtgatggactggagaaataattggcccaaccccggataaccgaaaatagattcaagaaaaatatttcctgcaattactcccgtcaggtcataacccaaaaaggcagcaatcggcaatagagagtttttgaaaatatgtcgggaataaatttcaccttcgggcacccctttggaacgcgctgttttcacaaaatccttcagtcttgtgtcaatgacctcattgcgcaaatactgaatcgtagccgttgtactgagcaatgcgcctgtaaccgcaggtaaaatgagatgatacgacttgttcacgtaatatgaccatgtccccggctccacgcctacatccacactgccactggttggaaaccagccgagcctgaatccgaatacgtacagcagcaacaacgcgagtataaatagaggtgtcgcaaagctgagataggtatagcccactacggttttgtccagcagactatgctgataacgaccgctgagtacgccgagcggaatggcgatcagatacgtcagaaccagaattactacgcccagaaagaacgtgttccccagacggctgccaatcagatcggtaacgctaattttatgtacataagatttgcccagatccccgtgagccagctggacgagccagttcccatactgcacccacaccggatcattcagtcccagtttttgtcgctgttcttccagtgcggccggattcagattgggtgtcgaagtaataagtcctgtcagggcatcccccggcatagccttagctaggaaaaatataagcacactcagtgcaaaaagttgagggatcataaccagcagccgacgcagtgtaaatttccacatattctgtaccccccttatggtagcgcgacttgatgggatggacttactgattttagtgcaaacggctttccactcgcgtctagatgtttgggtagctctgttttgtaggaggataaaagcattcgccttttttgggcattttccagtcgttttgtaggatcaatattgggaatggttgcaatgaggcgctgggtatacagatgctgtggacgctcataaatgtcttgctcgctcccctgttccactagacgtcctcggtacataataccgatttggtcgcacatatggcggataatacccaagtcatgactgatgaaaagatacgttaaattaaactcccgttgcacatccttcataaaattaagcacctgtgcctgcacggaaacgtccagcgccgacaccggctcatcagctatgatcagcttagggtttaatgtaagcgcacgcgcgatcccgatccgctgccgctgccccccggaaaattcatgcggatatttgtaggctgcatcggcattcaagccgaccttttccagcaacgtctgtactttccttcgttcttcctcactgctcagcctttcaaaatttcgcagcggttcagcaatgacatccaatacgcgcttacgcgggttgagtgaagagtatgggtcctgaaaaatcatctgaatatctctacgcagtggatggcgattgttacggctcagagctgtaaggtcctttcctttaaacagaatccgtccgctcgtcagcttatttagaccgatgatcgtcctgcctgtcgtcgtttttccacagccggattctcccaccagcccgtatgtctggcctgcctcaatgctgatcgacacgccatccactgctttcacctgatcgataacacgctggaagaaaccaccgcgcaccggatagtggaccctcagatcatttaactctagtagtgccatgagcagcctccccctttgcatcgtcttcaaaatgaaaatgctgataacatgtacaacggacccaatgtccaggggaaatttcatttagttggggatggtcttcatgcactctctgctgaatccagggaatacgcggagcaaagcggcaactattgcgggggatatcttgtaatgagggaacaataccgccgatgacatgcagtgattcccccttggtatgagatcccggcatagaagcaagcaaagaacgcgtatacggatgctgtggatgcctgaataattcaaaaacatcagcgctctccacgatttctccggcatacatgaccaccacgcggtcggctacttctgccacaactccaagatcgtgcgtaatcaggataattccgctctcagtctcctgttgaagctgtttgagcaagtcgagaatttgcgattggatcgttacatcaagcgcagtagttggttcatctgcaataataagagaaggtcggcaagctatggcaatcgcgatcatcacacgctgccgcatccctcctgacagttcatgcggatactgctcatacacacgcacaggattcggtatatctacgctttccagcagctccagcacacgttcccttttttgcttcgtagatagtgacgtatgataatcaagattttcctcaatctgcttgccaatgctcatcaacgggttgagtgctgtcagcgggtcctgaaaaatcataccaatgcccgctccgcggattttattcatttgccctgaggaaagacggttcaggtccgtgcctttaaaaaggacctctccctctacacgtgtgcgttccatgtcatgcagttgcgggatagaaagcgccagcgcgcttttgccacagccagattctccgactacagccagcacttcattggggttgaccgtcagatccaaatggtcgactgcggggtgatattgatccttgatgcgaaaagagacggataatcctttaatttccaacacgggttcggtattcaatgcgcgcttcctccattctccatggtcttgtcccgcttattctcaccatgtttgatgtttaaacctctcatgaacattacataccgtttttgtcggaataatttgaatacatcctatcaccagtatatggatatatcaattaagattatgctatcaacatcatttaaaaaatcaatgatccagcagtagcgcggcctttctggcacaaaatgtaatgaaataaccaaccacaggttaattttcatcacaaaaaaagtcgcctgatccctctacagggatcaaacgactaactagcaccagctcacattgagctcctcacgataattatgatgccgctccataggagccagacttgaacgttctaggatcataccatttgtagcctgctgccggagcagaccaaggctcagcctgcggttcggtagaagccgcaggctcctcgaatggcagaagcttcgttggttgatccagagtcaagccttccacatcggacaatttcgtgtagtcctgcttccatgcaagccattggaccgtttgcaccaggaaggtggaatcatccacttcctcgaaaccatcatatgtcttcttcgactgtccgttttcctcacgcacatatttcggtgtagcatcttctacaggggaagaatcaccgatgaacgctgccttgccttgacctaccttggagatagcggcataaggcccttctgcacggcccccgccattataaactccctggtctacagcattcccccattttttcgtgcctgaagggatataagcaatgcctttagccttggtaggatcaataatagccagcgtagatcctgcatgcattgcaatcgagcgcacacccttggtaatgccgaaagattgatctgcggctactatgtcagtagcattcacgtcaccaagcgcattataacggaaacgaacaccaaagttggtcgccagccaatcggagcttgttaatccttgcatcgccggtgatgctgcttcttctgcagtcatgcctttggccggattagtataggctccacgacggtagccattcataacttcggaggaatcccaacggtttttgttacggtccgcattataatgatcggagatgaagaagacgctccccccgttattcacgtattgcagcagagcggcctgctcggatgccttaaaggcaacattcgcttcaccaataatgaacacatcatattggcgcagcttgtcatatgttatggcctgctctccataagtaaaaggaatgggacgattcaattggtctaccgtaaagcctacattacgcagtccattggcaaagtcggaaaaggcgccttcaatgacccaatctgctgcaccagcggtctgtgcgtgcgtattatcgaacagcacctttttgccttttccatccggcaatgtagtaccgggttgacccgggttgccaggttcaggttcgccaggttcacctggttcccccggttcgcttccgcccaccagttcaacagcgcttgggcttttcactccaccaaaattattgtaggcgccgagtgtacccgtcacacgaattttgctgccgatcagctcaggatggcctgacagcccaaattgccctctatacgctgaagtcagctgtacatccaatagattagacgtattacgttcatttgcctgatcggcaatcagtacgttaaaatcattcgcgaacggagaagaaaagttagccgttttcgatccggtagcatgtccgacaatgaagccttccaccgtcaccgtacctccactgctttggccctgaagtgcttcggctactgtcgatgctccctctgccttgacctgaccgagtggaacgaagatcccgatcagcagtgatacgattgctgctagatgcagcatcccttttaagcgtgaacctgtgaaccgcaagccttttaccatacgtcaatatccctcctatgttttccataaatgtacttgtcctttatcagattagccgccaatcttctaattccttcctgatttcatccataattatgtaaattttaatcttttttattggaaacgcacctgtttatgtaaaaattgaaccctgtgattgacaccgagcacggcatacattaccctaagaaagacatgtagaacggtatacgcgaatgaagatgacgggagagtctgtccagggagcctacactctggcggcaccgaaggagcaagacgccagcacccggctggcggataatctctcaggtccatgtatcgtcatctgacgcaactctggagagagcgcaagccacccaaggggtaaggcggtaagaacaccgcacgaaactctcaggtaacgaggacagagataagggaaacttccttatcctgtccttttttgtgctcacattgtgcgtcagcattaggaaccgtcataaccgcgcaaagacgcggaaataccatatagtatggtattagaacatacagggggccacaccatgcgtttcaaagatgtattttctattatcggcccggccatgaccggaccttccagttcacacaccgcaggcgcggtgcgactcgcacgcgttgcccggcactggctcggagcgcagcctgaccgtgcccgcatgacattatacggctcctttgccgatacgtataaaggacacggtacagatctggcgctcatcgcaggactgcttaattacgatacggacgatcaccggattcccgatgccgagcagtgggccgaacaagccgggatggccgtggaattcgccgtcagcggactccccgcccctcatccgaacactgtccgtttcgagctgtggaagggcgaggatcagcgcacactgttgggctcctccatcggcggcggcagcatccatgtccagcaactgaatgaattccgggtcaatctgaccggggagctgcctacgctggtgcttctccactcagataaacccggtacattaggtgcggtgacttcagcgctcggcgctgctgacattaacattgcctatatgcatgtggatcgcaaaggccgagatggtgaagcacttaccgccatcgaaacggacagtccacctacggctgaactgatcgcaaaactgcgctctttgcctcatatgtatgaaattaaaatgattaatttgaaaaaaggagctgaatccgatgcggtttagccatttgcatgagatcagcgctttatgcgctgaagaatccaccacgattggccgcttgatgattcaagagcaggtacaagaaacgaatacaacggaggaagaaatctttcgtcaaatgtctgattattatgaagtcatgaaggaagccgttcatcgcggacagacacaagacaccgtatcccgcagtggattgacgggcggggacggcaagcgcctagccgagtatctgcgggcaggggaaacctgctccggcgatgcctccgcgctcgccatggcttatgccctctccgtgtcggaggttaatgcatccatgggtcgcattgtcgccacgcctaccgcaggctcatgtggggttatccctggtgtattcatcagtgcgcaggagcggttcggctgggatgatgagcatatggtgaacggcctattcgccgctggagccattggctacgtgatcgccaacaactccttcatttctggcgcagagggaggttgtcaggctgagattggctcagctatcgggatggccgctggcgctatggtcgagctgcgcggtggtacgcctgaacaggctgttcacgccgtgggtctcgcccttaagaacacgctcggcctgatttgcgaccccgtcgccggactcgtggagatcccgtgcattgtgcgcaacgggctgggagccgtgactgcgcttgccgcagcggacatggctttggcgggtgtgcgcagcgctattccgtctgacgaagtcattgacgtaatgcttgaagtcggcagtgcgatgccgtcgaagcaccgcgagactgccaaaggcggcttggcccagacgccgactggcaagcgtttgaccgaatcacttacacgcaacacaccgaccaagaaggataagtcataatttataagcggtagcctccttaaaataaaaagagcaagcctatcgtccttggacgtatgcttgctctcttttttactgaacggttacctgtacctttgtcattttacctgcatatttcacagtaattacagctttacccttgccctgtgccttaatgttaccgtctttgacggtcgcaacaataattctggacgaggaccagacagccggtttggaaacatccttctccgactcatccttatacgtggctgtagccgtaaccttagccagctgtcctgccttcaaattcaaagcaacttcgtctgtttgcaggtatttaagcgtatcaacatccacgggtacactaattaccttcccgccaaacttcgcctgaatgttagctttaccgtagctaaccgcagtaacctgaccctttttaacagtagctaccttataattagacgttttccattcagcttgggccgtaacgtccttttctttaccatcactcgatttaaccacaatcgcgatggttttttgatctccagatttgagcgatagtgcaattgcatccgcttcaatcttttgcgctacgtccacttctaccgtaaacgtaatgttttgcttgccatatgaagcagtcacagttgccttaccgctaccattcgctttgatcaaaccttcgctaacttcaaccacttttacattgctagttgtccaggtggcgtccttggttacatctgtttttgtaccgccactcttaactcctgttactttcagttgcttcgtttcctgagcaccaagcgcaattacacgcgagtctgtttccagacggtctacaaggcctacttgcacgttaatcgtcagttttttgccattataggtcgctgtaataaccgctttaccagcggatttacccgtaatcgttcctttggacacagaggcaatatcttctgcacttgaagtccattctgcatcctgtgttacatcttctttacgtccatccgcataagtagccgtcaaagttgcagtatagtcctcatcaatatcaatcgttgccgttttggaggacagagacagatcaccgggtacatttacggataccgtagctgtaactgttttaccaccataagaagcggtgatcgtagcctcacctgttttataacccgtaacttctcccgcactgacaaaagcgatgtcttcattgctggacttccactctgccttacttgtgatatcttcttccatacctgttacatacgttgcggtcagcttgagctttttggattccttggcattcaggctcagcttgtcctcactcaaatccagatatctggaggtttcgacatctgtcttgatcgaaacggtcttatctccatacttagcggtcaccgtagccgaacccgctccaatcgccataatcgttcccttattcacagtcgcaattttttcatcgcttgatgtccaagtagctttatctgtgatattcgttaccgtcccatccggataaacggcagaaacttgtacttttttagattcatctagacggagaaaaatattggattcactggctttcaacttattcgtttgatcgacaaccaccgaaatcgtagcggacatcgtgccatatttacctgtaattgtcgcctttcccgcgctatagccggtaatggtgcctttcagtacatccgccacagctgcattgctggagctccactcagcggactctgtcacgtcctgtaccgatccatccgggaacgtcgctgaaagcttaaccttctcagtatccttcaacaaaagagaaacctctgatgaactgacatcaagacgtttaacctgctccacctgcacagcaatggttacggtctgttgaccatatacggccttaatattggctgtacctgctccctgagcggtaaccaatccgttaactactgtggctaccttttgattatcggaggtccaagtagcatcacccgaaacctgagctgttgtattatcactgtatgtcgctgtcaaatcaacctgtcctgtaccgcttgaacgcaagttcaggctttgtacactggatgtcagcgccttaacctttttcgttacatgtacctgaaccgattgcaccttctctttataggtcgcaaccacggtggcttccccttcagccttggccgaaactgtaccattatacacagtagcaatagctgtattatcacttttccaatccgtgcttacggttacattcgaggttgtcccatcgctaaaaacagcagtagccgtcaacgcagccgtatctccctgctgcaaagttacctcgttagaggaaaggacaatcttggaaagcaccgcatccgcagcagatgcaaatcctgcatatgatgtaaaacttgaaatcaggatgaccaacgccagaaaaccggaccatctattcttcaaaatctaattccctcccatttcaaaacttaaattaaggatttcgcaaaatccttacacctacgttttatgtcgtcatatggaaaagaatagtttaggcttcgaaggaaatttggtccttattaactagatcatttctgataaagattagacattacaatttgtgtagctttagagccatagtgaagagttttctcaacagatccacaatctcgcatttacaaacagctatatgctgctgcgcgaactcttaaatgatggtattcttccatattaggagccagttggtgcatataaacgacggagtaatcagatggctttacattaacagctcagccaccgtttccttccaacgatggatcaccgattccggttccttgagacggactgtgacacctgtcaagatatccgcatattgggccgaatcttctctggctgcaaaaacatgagccgcaaatcgctcacgtacatgcttggctccgggcaaagcaggcagatgttccagcgacaaccgcacataatgcgccttccccccggtgaacaccgcaagcgtcgccttgccagtacggatcatgttgcccgtcgtggtcgtacccggccatagtgccagacgcaaatttccctcgtccagcgctacaacctcgcccacactaatcatcgctatgtgcggccactgatcttccgtgaccgtcagcagcatcattgcttcatgctgcttgtccttcaactccttaccgtccaacagcgtaaacagttccttaccgatccttggtgtctgcatgaagtatattcccctttaattttggcctataacttcaaagtaccataatttacggctacttacgaacgaccctatatccgctctggaataggaggaacatgagcagcattgggaatatcttgggggtttaccttgaacgccgatttatactttgcgggatccgtaatgctatccggttctgaggtccgccatgtgaacaggcatacagggcacaacaaaacctcccaggcgcctttaactggcgagcgggtaacaacttctgaacgattagattcacaacggggacaaatatgcatctgtcagcactcctttaatctttctttatttttaaaaatattcagcgaagcatttggctcaactttttctcccattctgctacacccaacggggaatcgagcgactgcgagtaatgtcctctaatatccggtgctacaggtgtcgtcgcatccaatatcattttgtgcgtcatacctgccggatcagagccggggtcaagcagtaaaatagacaagccaggaacaatgacagcatcatgctttggatgaagcttggtggataaagcccacatgacctgcggaagattgaacggatcgacctcctcatccaccacaatcacgagcttgcaataccccaatccatgcggagtcgttaacgcacgcattcccacagcctttgcaaagccgccatatcgggttttcgtggaaataatagcgaccagcccatgcgtatacatggcattaacagccacgatttcattaggaaaagcatccttaagttgctgaaacaacggtacacttgtattcacaccgatcatataatccgtttccgtccagggcatcccgatgtacagatgctcaaagataggctgtttgcggtgatatacacgattaatctgaatgactggcatcgcgcggccgccggaatagtgacctgtgaattcaccgaatggaccttcatactcacgttcacctgctaacacttcgccttccaaaatgacctcggctccccaaggcagatccagatctgcatccttcgctttgaccacacgataaggctcaccctgaatggcgcccgccatctcatattcggattgatcgtacagcaacggcgtagaagcagccgttgtgatcacaggctcacatccgagggcaatagccaccttcagattttctccgcgctcctcagcctgacggatatggatcgcaatatcatgctgtggtacaggctgaatgcccaaacggttcttgcctttcacctgcatccggtataggccgacattttgcttaccgtaggtgtccgggtcatccagatcgcgtgaaactagaattgctttatccagataaaaccctccgtccccctgattcaaacgaaacaacggcaaaatatcaaacaaattaatatcctctgtaatctcgacttcatgaaagggtgcggtttcttcccgtttcacgggcaccggaaattgttcatagcgtctggcaaattcaaaaaactgctccttgagcggcgtgtttttgggcattcccatcatgagggcatgattgggccaggagcccatcacattcattgcaatacgagcatccgtatatccatagatgttgttgaaaaagagagcaggcgtcttatctccaagattgtttaacgctctgttagctgctgccaggtccggctctggctttacctcatcgctgatcgtgagtaattgtccttccttttccaaggtgtgtagaaaatcgcgaaagtctttataggccatcattcattctccttcgtctttcgatttctcaattctggtgcagtctggagtcattctgcttcattccatcccagcgtttggctgcggttgtgacaatatcgaactgatccaatgcacgaaaaacaatatgatccaccaattcctcgatacttgcaggatgattataaaaggcaggcatcggcggcaggatcatcacgcccatacgtgacagctccagcatattttccagatggatactgcttaatggtgtttctctggtcatgagcagcagcttctttcgctccttcagtatcacatccgctgatcgggtaagcaggttgtccgccataccaatacgaatggaggcaagggtcttcatgctgcaaggagcgacgaccatgccgtctactcgaaaggagccgctggaaatacgcgcagcctgatccttatacgagtaaactgcatccgccattgcctccacttccttcaccgtgtagcctgtctcataggggatgttcgcaatagcccacggggatagcaccagatggctttggaccccagcctctcgtaattgttgcaatatacggataccaaagatcgaccctgtcgctcccgatattcctacaatgattttcttcatatgtcccctccttccatcccatcgttttatgttcacccatgcattactgtcaaaaattatacgcccgttccctgcacacaaaaaatatatataatatatgtaatgcatactttaaaagtattcaaatcgaagcgttgtttagaaatgaggaggaatcccccaatggacttgaagcatctgcattacttttgcgtcatcgtggaggaagggcaaatcaccaaggccgccagaacgctcaacatggcccagcctccactgagtcaacaactcaaaaatatggaggacgagcttggtgtaaagctgatttaccgtgaaggaaagaagtgggaagttaccgaggccgggtatacactgtatacacgcgctaaacgattattggctgaaatggaggacacctgtagagaaattggggagtttgaaaacaaagtaaccggcacacttgctataggcacgtcatccgcctgtatgtctctgattactgaacaactcagtcgctttcatcaggtttatccagaggtatacgttaaaataggacacggagacacacatcatctggaagagctgctgcaccaaaataaagttgatctggccctgctgctgcttccggtagatgacaaatcgtaccatacgattgaactggagggcgtttcttttgttgcggttcttccgtgtgaatgggcagatcgccatcccagtggggaaattacattacaggaagctgccagctatgacctcttgttgggacgccgaacagaaggacacggactatacgaaaccgtcatccgcaaatttcaggaacaccatcttattccgcgcgtcgtactagactgtccagaaatatcgaccattctctcgctcgtttccacaggcatgggaattaccattattccagacgctggcttgggacaagaatacggggacagatttcgcacactctccattaaggagccattccccttcacacagcctgccgtcgtatggcgcaaagatcgttatttatccaatgcagctcgcaaatttgttgaactgctacaagctggagacacaaaaaagactgttcccgagtagatgctctaccgctctactcctgaaacagtctgatgctagatgaacttccttcattcggtcgttgataccgccttacttgactccttgatgccgatactcggttggagtcattccacatttgcgccggaatacctgtgtaaaatgccgcatatcctgatagccgatccgctccgaaatatcagccagccgcagatgaggatcactgagcagccgcttcgcctcctccatacgcaggcaaatgacataatccttgtagccttgtcccgtcttttgcttgaataactggctgaaatacaccggattcaaaaatacgattgaagccaccttctccagcgacagctcctctgtaaagtgagcccgaatgtattgcaatgccacatctaccgtatgcatgcctttgcgcagacattctcctgtatccgctgctgcggctgcaatctcctctggtgtacgtcttagtcgcgccacctcttcaggtatggaggcaaaattgtgatgaacacccgaacgtgtaatttgtaggggaaccttcacataacgcttcagatgggattcgagcaacgtctctagccgtgcggcctctgcttcatcccttagccttgcaatgcccagcagactatggcggtctagactgacgacaaagccgctgcctcctgcctcaatgagctcggacagtacattttcaatcataaaatgctccagatgcgtctgcttgtgatcaggttccatgcgaaccatgaagagatggaattccggataattttcgacaaaaggctgtatatccagcttgcccgtgtccagtccaagggcatagcgttggaaaacggcttcacgcaaataaaccatattggatttgagaagcctaccctcgttcgcctgctgcgaggccacaagcgcttcggctgccagtatttcaatgcattccagcagctttcttttaccaatcggctttaacaggtagtctttggcacccagctttactgctctttgtgcataatggaagtcggaatgggccgaaatgacaacccactgcagatgaggatgctttcgcttagaaatacgcatgaattccagaccatccataccgggcatcaggatatcagttaatacaatatctacaggatgctccgccagaatgcctgctgcctcctcggtggaagcagcgagatgaatgccgcaggttggtagagcttggccaatggtacgccgaatcccctgccgaatcatattttcatcgtcagctatcagaatattcatgtttctcctccttctgtggcagaggcacacttacagtgactgttgttccggccccaggtacgctagagatccgtaggccgtactcttctccgaacatgtgccgtagccgtaaatttaggttttgcaggccgatgcctcccgcctgcccgctgcccgtctgtttgccgggttctgccaaagcgacctggaccacctcccatcgttcgtactccatccctgcaccgttgtcgatgatgtgcaggctcaatacaccgccatattcctccgctctgacaagtagcttgccacctgtatccgcatgaagaggctccaatccgtgcttcaccgcattctcaatcaatggctgtaaggtcattttcggcaagcggatatccatccatcgttcttcaatattgatgtctacagataccctgccctccagccgggcttggataatggtgagatagtggccaacctgctccacttcttcacgaaggcttacatcggccccctcttcccaatggctgctgtaacggaacatatgggataaggagaggaccacctctccgagctgatcctgtcccttttcgtccagcatccaatagatcatatccagcgtattatatagaaaatggggattgacctgcgtctgtagcgcgtgcagctccgcatttttttcgctgaccgatgatatacgcaccagctcaatcagctctgcaatccgtcttaccatatggttaaaagaggtagctagttgattgatttcttcataggatttggtgtttaccgtatgacggaaatttcctgtctctacccgcttcatttcccgaatgactcgcttgagtggaagggaaatgctcctggagacgatagatgcaattaacgccgacacaataataagtataggtgccacgataaataagtacctttgattttgcaccagctccacgttcagatcctcactaggtgtcacactaatcacagaccagtcggcaaacggcaacttggaagcgattacaactctttcattacttcgatttacaataacatcctcctccggtacctgctgctctagattttgcaaatccggtggcggatcagaggaagtggccgacacaattcgattttcatgacccaacaaatatacctgactattggtgcctaaccgcaaattgtggagagcggacaatacagaacgcggctcagcctcaaacaggacaataccaatcggcttgtgttcatccagatcatagagctgccgcccaaacgcaaacacgggtctggtttccacctgatcaatgacagagtgaggatacacgcccagccatgcaattttgcccgccgactttcgaatttccttataccattccgtatgttcgtaatgagtatcaatgacattcatataatttccatagttatataccttgcctgtgtctgtgatgacatggatgccaatcagatcctcacgcgaataatagatagcccccagaatattcgtaatcgtacgttcgttgatgtaattgacagcaggtaaatcactactatccgtcgtcaacagacgaaccaaatccatattgttgctgatcgatttggagagactgttatagctgccgagtagcaattcgaataggcctgccgtctgggatacatttttacgcgccagttcgctgaccttatcatggaactgcaccgtagtacggttgtaaaataatagactgaccgccagcacaatgccggacatgctcaataggaacagaacaaacaagcggtattgaatggattgaaaacggcgcatcataccaccgcgcgctcctttcgcatcggccgcctatcctttaaccgctcccgcaaccatgcccttggtgatattttcggacagaacaaaataaataataatgaccggtaaggcacccatgactagaaaagcaccaatattaccgtagttcacagaatactggctgacgaacgtatatacgccgaaagggagagttttgagcttctcggatgagataaaggtggcagccataatgtattcattccagatgttaatgaaagttaaaatacataccgtcatgataggcggaatcgagatgggtaagattacactgcggaaaatacgataaatgcttgctccgtcaatgtaagcggattcttcaatttcgtggggaatggaccgcataaagccggataggatgaagaccgcaatcggtgtctgaaaagcaatgtagggtaaaatcagtgagaaatacgtattcagaatatggacgtttttaaacatcaccatcagcggcagtagtgtggcttgcatcgggatcatcatcccgatcaaaaacaaagtcagcacaacagccccgaagcgccaacgaaaacgtgtaatcgcataagcagtcatcgagcttaataaaatgacgaaaatcatcgtaaccccggtcaccagcacactgtttcctaaataacgcaagtagctccctgattcataggcttcctgatagttgtgccactggggcacttgagggagtgcaaagaaacttgagctcaatatctcttcattcgtcttcaacgaataggtcagcagccaaaagagtggatacagctgcgtgacaattaagattgccaataaggaaaagactcccgtttttttcaaggcattcacagttccatctcctttagcttaccttattttcgattcttttgaaaacaaaatttatcacaattgtaaatgacaagcaaatcactacgagaattgaagccaatgcgctgccatatccgtatttcatcgataaaaaggacatattgtacatatacgtggatacagtatccgtcgcatgggctggtcctccacccgtcatcacccatatcaaatcaaacgattgcagggagccgataaatgctaatacaattgatatcttgaaaataggtacaatgagcggcagcgtaatatagcggtctgctttgaatccttcagctccatcaattttggctgcttcgtacaactcattcggtatgttttgtactccggtaaactggataagcaaatgatagccaaaatactgccacaacgatacaaaatagagggcgtacatcgctatctgcggttccgtcagccatgagcgtgtccagctttccagcccaatcgccatcaaaataccgttcagcattccacccatcgaggccggattatagatcgtcttccacagctgcccgataatgaccaccgatagaataaccggcagaaaatacatcgtaaccagcgtattggccttacgcacataacgattaagcaagatcgccagcagcagacagaacggaatctccagcatggaaaacacagcaaacatcatagtccgtttcacggatggccagaatactgaatctgctgtaaaaatccgctcaaaattagccagccccacgaactttgcctcggcaattccgttccaatccagcaatccacaatacaccgacaccagaatcggaacaaataccatacaggtatacaacaacaggcagggtagcacgaaaacggcaatggtacgtgctggcaccttcagtacattcatgctctaatctcctttgtgttgattctgaacatcttctgaggatgcgaaacctacatgatttccaatcagggaagaagcattctgccccctccctagtgcctgctacttcaggattttgcaaaattcaatgccagtcgctccaaagtgtaatatctagacgaaccaggccaatttgatctatatattgttcattgggagtcgcttattggatttttgcaaaatcctcacttatttattcgcttcaaaagtgttctgatgttccttggcaacttgtgcagagtcttccttttgcacgaacaggttttgaatgctactcagatgcgcctgcgcaatagccggattcatcgtattatcaaaagcgagatcgcccccttttacattcttgaacagctcattaagactaatcgctaactcggagtagcccgcttccttcagatcacccttcattttctgaccgctgccaatcgcatttttcaaatcaaactgaattttgggcatctccttaataaaatagtgcagaaaatccttcgtttcctgtaaatgctcactgttcgcagataccgcaaatgcgctgcccggcgcaattacatactcattcacatcacccttgccattcaccgtagggaattgaaacgctcctaccttacccgctaccgaagaagcatcaattgaccccgtttcccatgtacccatgatatacatcgcggcttttcctgttttaaaaatattaccgcctgcattgtagtcaatagaagtagctccatccgggaaagctcctgactgcaccaactcctgaaatgcatccaccgcttccacaaaagccgggtcgttaaacgtctttttgccgtccagtacatcattgagaaaattcggtccttcattcgtacgcaacaaaatgttcataaaaaggagggaccccgtccatgaatccttttccccaatggcaatcggagtaattcccttcgcctttagcgttttgaccgtcgtaatcagctcgtcaaaggtggtcggcaacttctggattcccgcctgcttgaacagttccttattgtaaaacaccacttctatattgttgccatccggaaaagcgtagagcttatcgtcgaaactatagtaattaagaagtccattctgaaatgtatcttttaacccctctttatcagccacatcgtttaatggagccagcagcccggcatctacaaatggcttcatctgtgcagccgggtttacaatcgtgatatcaggtacttccttcgccgctgcctgtgtcttcagcttaagcttttgttgatctgtatttagcgaatccaattcaattttgacatgaggatgatcctgctcgtattgacctacaatttgcttaatcattttgtacgaaggggtgctcggatcaggattaatgttctgaaaggtaatcgtaacatctttcgttgcggtgcctctgctcggttctcctgaatttcccggacttgcgctttgtccgttattacaagctgccagcgtcaatgccaaggcgctcgccaccactacggcaaacgctttcatttttgttctgctcatggtctttttcctcctcttgttgaagcattgcgcaatttgccctccttattggtggacactcaatgcccgcttgttcttttcattatgttccatagaaaagacgtgaacaatgcgtgaacttaaggagaagggtttgttttttcaagctctcatttgcgtgcttcaaaattcattcatatcataacttgcaatttatctagaacacaggcataatatgaataagatcatcttttgataatgattatcattattaaatgataaatacacatagactttaaaggaggcaggaccgcagtgaaagaaactttcagtaaaacctccctgcatattgatgattatttggaccttctcaatcttgccgtacaagtcggagataccaagtggcaaaaagaaattacccgtaaacttctagccttgagtgtccttcagacagaacaggttgaaatagattaacttccccagttaatactgtccttagttaaaaatgctaactaagcaccactatacaaaggacaaccaggatatcataaaacttttgaccgaatccatgagaaagacctttcatgtgaatgataaatgaattggttataggaaaaagagcacagcctttaaggctgtgctcttttatcttgcttggcgacgtcctactctcccaggaccctgcggtccaagtaccatcggcgctggagggcttaacggtcgtgttcgggatgggtacgtgtggaacccctccgctatcgccaccaaacatgaatttgctgtgcaaattctacattcaaggttacaccctgaa

SEQ ID NO: 29 - DNA, 297433 bp, Unknown
  Kingdom: Bacteria, Phylum: Firmicutes, Class: Bacilli, Order: Bacillales, Family: Paenibacillaceae, Genus: Paenibacillus
ccagacggcgcagccgttgctgccgtgcgactgctcggcggcaacggctgcgccgtctggcgaggccacgccattagcgcgggcacagccatggcaagcaccagcacccctgccatggcagcgaatggcagccatgggcgtctgctgccccagcgcggggtacgcccggcggatggacgcaggtgcggcagcgtcacttgcagcggggttgcagcgcgtgtgtcatgggccgctgctccagcgataggcagagccgtttcaacggagttcacagcggaaggcacggctgtggtacgccgattgggcttgacgccagtcggcaatgtaccttttgtgtccggctgctgttgcataagcttatttttctgcaacgaagtagctatagagccagagcgttcctccgcaagtaaagcctggcaatgttccttaggatgatgaatgggtatacggatgcgaacctgtgaatctttcataggctgaaacctccatcaaagggctaagtgtccggctggaagtatagatatactccagccgatattttcaatcatatgaagtcgtccactttgatagaaccattttaagagaactgaaagaatgaaaaaagactggctgcaaacaacaaaaaaccaagccctttcggacttggttccttattgttcaagaatatacttatgcaatatgaagctacatacgttaaggcttaggcgagggaaggctggatcttcttaaacagattccctgacgtctcttccggcattacgcgctctgtactgggtgaatgatccagtttggactcatccacggtcactctgtaaatgtccgctcccaatccagtcagcttctcagccaaatgaacgtaaccgcgatcgatgtgatgtacgccggatacctccgttgtaccttccgcaatgagtccggtcagaattaacgcagcacctgcacgcaaatctgtcgaagttacttttgcacctgtcagcttagcattaccagttacaatggcggaacgaccttcgaccttaatttccgcattcataagatgaaattcatccacatgcatgaaacgattttcaaacacggtttccgtaataatgctcgttccttcagcagcaagttgaagtgccatcatctgagactgcatatcggtaggaaaaccaggataaggcaatgttttaacatcaacggcctttaacggcttatctgcaatgacacgaattccgttctcatcaggttgaatggttacacccatttcttccattttggaaataaccggtcctaaatgatcggatattgcgccttctacatatacgttcccgcctgtgatcgcagcagcaaccatataagtacctgcttctacccggtcgggaatgacggtatgttttacaccatgcagcttctcgacgccttcaatacgaataacgcccgtgcccgcaccgcgtactttggcacccattccattcaggaaatttgcgagatcaacaatctcaggttccttagcagcattctcgatggtagttacgccctcagcaagagtagcggccatcataatattctcggttgctcctacgctggctacatccaaatatactttagctccacgcagacgcccgttacttttagcttcaataaaaccttggcccaggctaatctccgcgcccaatgcctcaaaaccctttaaatgctgatcaattggtcgcgttccgattgcgcatccgcctggaagcgagattcttgtacgtcccaaacgtgtaagcagcggtcccataaccaagaatgatgcgcgcattttcctaacccactcgtaaggggcttcacaggaaattatcttccgcgcgtcaacacgaatgacctcatcttggtatgtaacgcctgctcctaaggactccagcactttgttaatggtcatcacatcgtctagaggaggtgcatcaataataacactttctccttcttctcctagcagagaagcggcgatgatcggcagaactgagtttttggctccgctgactttgacactcccggtcaatctgttgccaccgcggacgataaatttgctcatctatggttccctccgcgcgtcatttcccttttccattctggaaaaaaagaacatattccgctattttcatgccttgctttttcattacataaaaaaacaaggttttactaataccctaactgccatcataccactgattaaaacaagtatacaagcgttttttgtacttgatgaccattgtactctaactgattcagccagctatacatgtatggttcttttgtttaccattgttaacaatatgacgcgatgttattcgacaattcccgcagagacacagtcataaggtcatataacccgcctacttcatgttaaaacaaattctagagcatctggctccaagagatgtagctcaacaggaacccagaaaccaactgtcccaagattatagcaagaaacaagtgcagcaatctgccctgcggtcctttgggttgccgaattaacaaatccagctttaagctctgtaaagcccaccaagctaacgctatacagataagcgacacgatcatggagatcagcgcggtcatactcgccgattgacttagctgttcagccaattgctgtttcccgttcaaccataattcctcccatctgcgtcacagacttctttataatactcggcgaacgcctaatatgccagtgctatttctgcttttaggacatttatttcgacaaaatgtgattaatcacttctgtttcgtgaatttaaaaggtactaaatacctagcaaccgggcaagaaataggactgtacatttggtaataacagctaaaaaagggcccgatcacagtgatcgaaggaagcaaggttctccctcaccttctaccggacattctttggcagaagttatgaagtggtctccttgtcgttccatccgtatactatgccgaacccttttaaaattccacttaaaatccaatattaattcttattggttctgatgcttgtagcatttaaacggttaagcgcccgttgcagagctacttccgcccgatggtgatctatctgttcctgtttgctctggagccgcagttctgcccgctcccttgccgcacgggcacgctccacatcaatttcttcggaacgttccgcactctcagccaaaatgaccactttatccttgcggacttcaagaaagcccccattgaccgcgatcacttcggtttgaccaccgattttaatacgtatcggtgcaatcttcaagggagtgaccaagggaaggtgtccgggtaaaatcccaagatcgccttccgagccgcgaacactgatgctgtttacctgttctgtatagaccaggcgctccggcgtcacaatctctagtaaatacgtgctcacttgaatccctcctggaagctgtccgcagacagctcacttcgtaaggctcggctattctttgcctgttgtttacaacgttttagctttttcaactgcttcttcgatggctcctacaaaaaggaaagccgcttctggaagatggtcatacttgccttccaaaatttctttgaagcttcgtacagtttctttaactggcacatatttacctgggaagccgttaaatgcttcggcaacgtggaaaggttgagaaaggaaacgctggattttacgtgcacgtgctaccaacattttatcttcttcactcagctcgtccatacccaggatcgcaatgatatcctgaagctcattgtagcgggccaaaatttgttttaccccttgcgctacattgtaatgctcttcacccacaacgtctggagccaaaatacgggagcttgatgcgagtggatcaaccgccgggtaaatacccatttcggaaattttacgttccagattcgttgtagcatccaaatgggcaaacgtcgtagcaggagccgggtcagtgtagtcatccgcaggcacatagatcgcctgaatggaagtaacagaaccttttttagtagaagtaatccgttcttgcaattgacccatctcagtagccagcgtaggctggtaacctactgctgaaggcatacgtcccaacagggctgaaacctcagaacccgcttgagtaaagcggaaaatgttatcaataaagagcaacacgtcacggccttcttggtcacggaagtattccgccatcgtcagacctgtgagagctacacgcaaacgtgcacccggaggctcgttcatttgtccgaacaccatcgctgttttgttgataacgccggaatctctcatttcatgatacaagtcatttccttcacgtgtgcgttcacctacacccgcaaatacagaaataccaccatgctcctgagcgatattgttaatcaattcttgaatggttacggttttacctacaccagcaccaccaaacaatccgactttaccacctttggcataaggagctagcaagtcgataactttaatacctgtttcgagcatctctgcttgagttgtcagctcatcgaaagaaggagcttgacggtgaatcggatttctagccgtttcactcatatcagcaccattatcaattggcgttccaagtacgttaaatactcgtccaagagtagcttcgccgacaggtactgaaataggtgctcccagatctatggcttcagctccacgaaccagaccatctgtggaagacatggcaatacaacgcacacggttgtcacctagatgttttgaagcttcgagcgtcaggtcaattttgactccgctctccagcacagtcccaatatgaatggcattcaggatttccggaagctgtccacgttcgaactcaacgtcgacaaccggacccatgatgctcactacgcgtcctttgttcatcttttggtttccctcctacaagcttgcacagccgcaaatccgaaccactctgatttgttttgcgcccgcaatttatcataatagtgtagacatgctataaaacagtcgcaacaagcctgattaagactgagcacttgcccctgcaacgatttccgtaatttcctgggtaatagccgcttgacgagcacggttataggtcaaggaaagctcaccaattaacttggaagcattcttcgtagcagatcccatcgccgtcatcttcgctcccagttcactagctttaccatccagcaaagcgccgtaaatgagcgtttccgcgtaacgcggcagcaatacttccagcactccttctggtgaaggctcatactcatagttaattgaggatgaagctgtagctgaatccggtgttgccattggtaacagacggtcaactgttggaatttgagtcaatgcgttgacaaagcggttatagcatagataaagctcatcaaattctttaagttcaaagccttgtacagctttgcttgcaattgttttgatatctgcaaaagcaggtgtatctgacagatctgttaccgattcagcgataggaaattcacgacgtctgaaataatcccgtccttttcgcccaatgatgaaaatcacaaattcatcctgtgaacggtgacgttcagcaatcgtctgcgtaacctgtcgcaaaatattggcgttataaccaccagccagaccacgatctgatgtaatgatgagataagcagtctttttaaccggacgcgtttccagcattggatgcttgatgttattcgctccagaagcaatgctactcacaacttccttaagcttttccgagtaaggacgagccgactccgctttctcctgagcttttctcagcttggatgcagcgaccatttccatcgctttcgtgatctgcttcgtactctgcacacttttaatctgacgtttaatctcgcgcataccttttgccatgatttcaccacctttaagctctagcaaagccaaagctaacttcgtaagcaatcccttagcttagcttggaccaagtctaagcacttcgtaagattcaaatccagccggacatatgttaaagggcctgttatagagggtaaaacatgccaaggaagccaaaacccggagggcacgcttccttaggacatctttcatcataaacaggcaattccaatgtattaaaccgacgtggcgaatgattttttgaatttctcgatagccgccttcaaagccgcttcgttatcagccaccaagtctttcgtgtcgcggatagattgaagcacatcctgatggtcagacaccatgaaagacaggaagtctttttcaaaacgttttacatccgctacagggatatcatcaaggaagccttttacagcagtatacaagctcactacttgttgctctacagcaagcggttggttaacgccctgtttcagaatttccatcatgcgtgcgccgcgatccagacgggcctttgtggatttatccaagtcggacccgaattgggagaacgcttgaagctcacgatattgagcaagatccagacgcagggaacctgctacctttttcatcgctttaatctgagcagaaccacctacacgagatacggaaatacctacgttgatcgctggacgttgccctgcatagaacaagtcagcttccaggaagatctgtccatccgtgatggaaataacgttagttgggatatatgcagaaacgtcggaagcctgtgtctcaatgaacggcaatgcggtaagtgatccgccgcccaactcatcattcagcttcgctgcacgttccagcaagcgagagtgaagatagaaaacgtcacccggataagcttcacgacccggtggacgacgcagcaacagggacagttcccggtaagctgacgcttgtttagtcaagtcatcataaacaacaaggacatgctcgcctttgtacatgaaatactcacccatggcacagccagagtaaggagcaatgtacagcaatggtgatggttcggaagcagatgccgtaacgacaatcgtgtattccagcgcaccgtgacgacgcaatgtttcaacaacttgagctaccgtggattgtttttgaccaatagcgacataaatacatttcatgccattgcctttttggttcaaaattgcatcgattgcgatagaagttttacctgtttgacggtcaccgatgatcaactcacgttgaccacgaccaatcggaaccattgcatcaatagctttaatccccgtctgcataggctcatgtaccgatttacgggccataacacctggagcctgactttcaaccggacggaattctgttgtagcaatcggtcctttaccgtctaccggttgtcccagtgggttaactacacgtccgatcagtgcttcccctacagggacctgcatgatctgacctgtacgttttacttgaccgccttcacgaatgtcggagaattgacccaaaataacaacaccgacattgctttcttccacgttgagcgccaagcccaatacgccagtgtcgaattcaaccaattcaccggccataactttttccagtccgtagacgcgggcaataccgtcgccgacttcaacaacagtgccgacttcaacgacctcgatatcatttttatattgttcaatctgacttttaatcaatgaactgatttcctcaggtttgatactcaagtgtgttcacccctatcttctatactcgtctgttaaaggatttctcgagacgatccagcttgccggccagactgccgtcgtacagtgtatcgccgataaccactttcaatccgcccagcagactcgggtccactatattttccacacggattgttttatgttcacgggctccgaattgctcggctaccgctgttttttcctgatcacttaaagcataagtcgaatacacctttgcatgagcaagtcccagcttgtattcctgaatatcgaggtatccggcaaggagagattcgaacaaatctgctctactacgctgaatcaacagcttgatcgtgttaattagcgaggcagacagcttgccttcaaaactgttagccagaacttgaagcttgaccgtttccgtaatgttaggagaattaatgaatttacggatttcagcatcccccgatacagcctctacaaaagcacgtagctcctgctcggtttccataatggtctgttcttgctctgccacttcaaacaaagctttcgcataccgtttggcaactaccgtatcccggctcatgctttgcctcctacctctttaaggtattggtcgacaagctctccttggacttggtcttccttgatttccttttgaatcagtttggaagcaatttgtaccgaagctttacccacttcgctgcgcagttcggcaaccgccttattacgctcgcttgtgatttcacgaacagcttcgtctttcaggcggacagcttcgtctttagcctgaacaataatttgctccgcttgcttgttacctgtttgttttgactgctcaataatgtcgtacgcttccttacgtgcctgctggagagcctgcttttgctcctcaacataagcagcagcctgttcacgcgtctgtgccgcttcattcatttgctgtaatacaagctgacggcgcttctccataacggaaaagagagggccgaatgcataacgcgtcagtaaccagtacaagatcaaaaatgcaatgattgtgaaaacgatacttgtccaatttaaactcaattgaagtcactcctttccggtgaacgtcggttctggatctttcatgttcaaacgaacaaagaaggcgcggatggctgtgccttccccgccaaaccttgcttccattcaattaagcacctgcgtagaaaatgaatgccagaacgaccccgatgattggcagggcttcgaccagacctacaccgataaacattaccgtttgcaacgttgcttttgcttcaggctgacgagcgataccttcaactgttttacttacgatcagaccgttaccaatacctgcgcccaaagcgcccaaacctactgcgattgcagctgcgatatatgcccaaactcccattttaaaaatcctccttagtgatgtgtatttgtattgtacatgtatttgcagttaagagcgaagcgtactcctgaacttaactaaaaaccggaaaacaagcttgtctaatgcccttcttcatgcgtgtcaatggactgcgaaatgtatacaaacgtcagaatggtgaagacgaacgcttgaatactgccgacaaaaatactgaatccttgccagaccacgagtcccaatacggaagtaaccatacctcccacaccaagtgctgtcattttcagcagaacactgatcaaaacttcgccggcaaaaatattaccgaatagacgcataccatgtgtcaacagttttgagaactgctcaatcaagttaattggcaaaaagaatggaaatggctgaacgtaatgcttgaagtaagctttggtattgcggaagatccccaggaaatgaaccaggacaaagatcatcaaagcgagtccaatagatacccctgcatctgcagtaggtgatttccaccagctgatgcctacatgggcagcttcgcccgggtgagacgcctgtgcttgttctaatgcttctttgactggaatgatttcatgtccaaatacttgggcactttgcgcattatcgaattcggtcacaatcccgaacggtaagcccagcatattcccgacgaaaatgaacatgatcagcgtcatccccaaggagaggaatggcttcccttttttcaaatccatcgtgctggtaatcagtccttgaacgaattcaacgacccattccataaaattttgcagcttgcttggattgtccacagacaaattgcgcgttgcagcaaatgccagtccaaatacaatcgcacaagtcacaataagcataataatgacggacaagtcaatgttaaacccgcccaattggataatcggtgattcatgcaacatgttttctcacccctttctcagttgagccatcatttttcctgaagcgcgaatatgatgcctataattaacagaagaaattgcccagtcaccaggcttgccattacagcgatctcatggaaataggccggaaattctatcgccagcaccactgccaaaatcgaggtccctaatcgaacgccaaagccaataccaaacactctcttctttctttcaccggcggccgcactcgcaacctgtcgaattttgtaggccatatacagcacatttagacagcttactcccgttcccagaatgattccgtgagcaatgtcacgatgttggggcatgaaggcggagaccaggaaacacagagccataataccaagcgctacgatccataacattttttgcatacgggtcatctcattcatggttatccctcagtacctttccgatcacaagggcaatacttaatgcgcctacaaccaagcctgcgagaacgcttacgccaatccaaattccggagccaccaagtttggcatcaagccattttcctgcatagaaaccacccagtgtgcatatcgccaaatcaatgccgatcgcgctcaccagtcctatagccttaaaggcatttccggtgttatttcggttgttgttttgcttggaaggtttgaccacttttccatgtcacccctgcaattccagtccattttacttaaatataagatgctttgtcaattgagatattttagtgccctaaagtataaaatcaaacgacaaagcatcttaaattgctgtatcccttggtaaccgtacagtttaactgtatgcttgccttgtaaagaataattatatcggacgaacaccttttgtgaacattgtgtgaaattcctcaggacgttcagtttgaacaccataatggtgcaaaatcgcattgacaattcttactgatgcttgtccatcgccgtaaggattcgctgcctgactcatagattcgtacaacgcggaatctgtcaaaagagccttagtccgattgtacacgttctcttcactcgtacccaccagttccaaggtgcccgcttcaattccttccggtctttcagtcgtatcacgcagcaccagaacaggtactccgaacgaaggtgcttcttcctgaagcccaccggaatccgtaaggatcagatgtgtatgtggataaaaattgtgcagatccacgacatccagcggatcaatcagcttaatacgcggatggttgcctaaaatctcaaatgcaggttccttcactgccggacttggatgaaccggataaacaatagcgatatcctcaaactcatccgcaattcgcttaaccgcattaaaaatctgacgatgcggttccccttgagattcccggcgatgtgctgtcataagaatcaggcgtttgccctgagcccaatccagtacagggtgctcgtaatcctggcgaaccgtatactgaaatacatcagttactgtattgcctgtaacatatattcgcgattcaggcttattttccttccgcaaatttccagccgataaagaagtaggcgagaaatgcagatcagacagcacgcctgtgagctgacggttcatttcttcaggatatggagaaagcttgttccacgtccgcaaacctgcttctacatgccctacttcaatctgctgcataaaggctgcatagctggccaggaaagtcgtcagcgtatcaccgtgaactaacacgatatcgggcttggcctcgcgcaatacaggttccagaccttgaagtacccgcatggagatttcattcagtgtctggcgatccttcattacgtccagatcatagtcagggtgaatattaaaaacttccagaacctgatcaagcatctggcgatgttgagccgtaacgcataccacggactcgatatgctccgggtgacgctgaagctccaaaataagaggagccatcttaatcgcttccggacgcacaccaaaaattgtcatcactttgattttggacattttctgttgaaccccttttcataataaatgtccgcttcacagatcttccttattcagaaaaacgacctgtcataacgtccatagattttgccgaaccgccaagggttgtctacttggttccgtacaagcggtctcccgcgtcaccaagacccggaatgatgtatccatgatcatccagacgctcgtccaatgcagcgacatagatgtctacatcaggatgcgcatcctgcacagctttgactccttcaggagcagcaatcagattcatcattttaatttgagtacagcctctctttttcaatacatcaatcgccgcaattgccgagccacccgttgcaagcatcggatcaatcacgatcaattcgcgctcagttacatctgtaggcagcttcgtatagtattctacgggttgcagcgtctcaggatcgcggaacagtcccacatggcctacctttgctgcaggcagcagctttactacgccatccagcatacccaagcctgcacgcagaatcggaataagacccagcatacgtcccgaaatcactttaccttctgtctcagcaaccggtgtctgcaccgtaatgctttccagcgggatatcccgtgtaatttcataagccatcaatgttgctacttcatccaccagctcgcggaaatccttggtgttggtccgcacatcgcggataaatgtaagcttgtgttggatcaaagggtgatcgcaaaccaccagtttcgccataatatattccctccggtattatcgtcacgttctttcgcgccagtatatcgaactatcctgagtcgaaaggatctatgtaacctatttgcacaaaccaaataagcacagatgcaatgcgtgcctgtaaatcctgtttattataacattcccttgattgatttaacacctgccaccgtaaccttttgtcaagggaaagatatgacatgtaaaatacttaataggaccgcttcacgtgtgactttcgtcacataaaaccacatcaaaaaggccctgacggcacttgaccgtcaaagcctgctggctttaaacttcctgcccatgctatagcctttgcttcctcatgcagcggtattcttttatctatacttcaaattatcccacgctccctgaaattgctgaagcatttcgtccttcgtgataacccctgcaatataggcttgcatactactgcttaaatcctgatttagccctttcgggaagcgttgaaagttccaactccatatcttgccttccctcacatgccgagatatttctgcacctagatcacctgtcgtctcgtcactggacgtgatacttttgaaggcaggaacaaacttaaattccttggtgatataatgtttgcctgtttctgatgtgaccaaccaattgaggaattcttttgcctcctgcttcacaggtgaatttttgttgaccacccagttcgatgccactcccaccgcgagtctacctcctgtggagggatcattgtctataggcgcaggcagaatacccaaattcaagttaggattaattccatccatttgcggttgcgtccagttcccctggtgcatcatagcagccttacctgtcgaaaacagtgtcacttgtgtattgtaatccgtcgtgagcggattgcggttcccatattttatagtcagatcaagcaacttcacccactgatcgaacacggggttaccggggatgcgagccgttcctttgtttaaatcctcaacataactttccgggttcggctgtctggcaaacgggatattgataaaatggttccccagaacccaccattccgcatacccgttagcaaaaggtataacccctgccgctttcagtcgcttggctgcttcctccagttcatctatcgtctgaggcagtttggttatgcccgcttttttaaacaaatccttgttataaacaaatccaaatccttctaggttcataggctgtccataaatcttaccgttaaccgtcatcggcttacgagcgaaatcgtccagatccttcacccatggctgatccgacaaatcctccaagtactccaaccacgtatcccgatcctgatagccctcatttgtaaaaatgtccggctgatcgcctgatgcgaatttagccttcaacgaagcaccgtagtccgtaccaccaccgacagattggatatccagcttgatgccagggtgggtcttttcgtattcagccttcagcttgtttaacggttccgatatctctactttgaattgataaatgtgtatcgtttttgtctcactctgttgagccttcgtatttccacaacctgcaagtgtacatgcgagcagcaccatcaaggagatgacaagtaacgctgtttttttcatcgattatctctcccttcagcctttgaccgcgccggctgcaatgccagaaacgatgtatttttgcatcaccagaaaaaacacaacaattggcgtgatccccaacaccagtgctggcaacgccaagtcccattgcttggtgtactgaccaaacaacatataggttgcaatcggaatggtacgcagctcaggatcattcaaaatgagcgaaggcaacagatagtcattccagatccataaggtattcaagataagcacggttacgaacataggcagcagcagcggacaaacgatgcgaaagaacaccccgtaccgggatgaaccgtccacccttgccgcctgctcgatctcaataggtaccgttttaataaagccatgaaaaagaaaaacggataaaggcgctccaaaacccagataacataagatcagtcccggtatactgttgttcaagctcaatacgttggacacttccataagcggcaacataatcgattgaaagggaactaccatcgcagccacaagcaaaccgaacaggaaccggttaaaacgagtgtcatgccgaaccatctggtaagcggccatcgagctgattagcagcaaaagcgcattactgacgatcgtgacaatcagtgaattccccagtgctgtgggaaagtttattttattccaggcgttagcatagttttcaaaacggaaggttgtcggccacgaagcggaatgggccaaaatgtcgccaaaggatttaacggagtttacgagcaaaaaatagaacggaaccagaaagattaacccgatcacaataagcaataattcagcagcccatgtgcccaaacgatagtttgacgtttttcccattacatttcgacctcctttttcttcgtgagacgcacctgaatgctggtaatgatcgcaacgaccacaaagaaaatcatagctttggcagtccctaatccaagtcgattatttgtaaacgcttcattatatatgtccaacgctacagactctgtcgacttgaaaggtccccccttcgtgagagccaaattcaactcaaatactttaaaggaccaggatatcgccaagaacaagcagacggtcaccgctggcataataagtggcactacaatatgacgcaaaatctgtcttcggctcgcaccgtcgatttgggccgattcaataagggcatgcgggacattatttaacgaggatatgtaaataaccatgagataacctgcatattgccatacaaacacaatgacagtcccccaaaaagcagttggcccatcacccagccacggcagtttaaaaaaggaaagccctgtcgcctcccctaccgcagaaaagccgcgtacaaatataaattgccagataaagccgagcagcaagccgccaatcatattgggcataaaaaatacagttcgcagtgcattacgggtacgcaacggtttggtaagtgcataggctaggaaaaagccaatcaggtttgtcagaatgacaccacatacggtaaaccggaccgtaaaccagaacgcattatggaaatctggatcatccctaaaaatatgaatataatttcctagtccgagccatcggatattttcagatactccatcccagttcgtcatggagtaatacaggcccagcaggaacggaatgaccataatcaagacgaaaaacaacgccatcggtcccacaaatacgagttgctgcaataattgcgcggattttctttgactcaatgcaatcactcctttgtcgtagatcatgaaggaaagcgcgcataaacccttactgtaatcgcttattacccaaaaatgtatgtttcgagtcgttcggaagcaaaaaaagactgttctcctccggcttacggaaggaaaacagcctataatataaaaattatgaatgtcgatgaattagtattgagttcctggataaatcgggaacttatctgtcaactcgccaaccgcttggcttgctttggacaatacagtatcatctttcgggtttttaagggtttcagcaatgattttaccgattttgaccatagcctcttcatccataccacgagatgttgcagcaggtgtaccaatacgaattccgcttgttacgaatggactggtcgggtcaaaaggaatcgcatttttattgactgtgatgcccaccgaatccaatacatgctccgcttctttacctgtaatattcaaattgcgcgtatccaacagcatcagatggttatccgtaccaccggatacaatgttaatcccttcagccaacagtgtttcagccagcacctgtgcgttgcgaactacgttttgcgcataggttttgaacgatggctggagcgcttcacccaaagcaactgctttggacgcgatcacatgcatcagtggccccccttgagtaccagggaaaatagctttatcaatcgcttgcgcccatgctttgcgagtcagaatcagacccccgcgcggaccacgcagcgttttgtgtgtcgttgttgttacaaattgggcatgcggaactggacttgggtgaattcccgctgccacgagaccagcgatatgtgccatatccaccataaacagagcgcctacatcattggcaatggaagcaaaagcttcaaaatcaatagtacgcggatatgcactcgcgccagctacaatcagacgagggcggtgcttaaaggctgccttgcgcacttcatcgtagtcgatgcggaagttgtcttcgcgtacaccgtaagcagcaaagttatacaacaagccggaagcgttaaccggacttccgtgtgttaaatggccaccatgcgccaaattcatacccagtacagtatctccaggtttgagagctgccagatacaccgccatgttggcttgtgctccagagtgaggctgcacgttagcatgctcggcgccgaacaattcttttgcgcggtcacgtgcgatgtcttcaacgatatctacatgttcacagccaccatagtagcgtttgttcggataaccttcagcatatttattcgtcagcacggagcccatggcttccattactgcttcactgacaatgttctcggatgcgattagctcgatattgtggcgttgtcgtttcagttcaagtcccattgcttccatcactgccgggtcacttttacgcaggtgttccatcatgattgattactccctctccatagtcaattgttgggtatacaagcaaacgcctgctcctctgttgggtacctcatcatcaatgcaaaaaagattagtacaagaatgccgccatgccaaatgctaatcgcagtttccgccgacttcttgctccagactatacactgcccgttgtccaccaataagtggtggacgggtgaatgccgctgtcacacgtgcttcgccaatccagcgaagacttgggcgaaatggaacagcaatgggtcgcagatgcatgccaatcagcgtttcgccgatgtctatcccggcatgggcctgcacgttcgccgccaaacacgcgtcactcatagaacgataggcgacggtggccatagagcctcctgctgtacgaacaggaacagctgcaacctccatcagtcccaatcgctccagcacagcccgttcaacgaccagcgctcggttcaaatgctcacagcattgaaacgccacatcaaagccatactccctgcgaacggactctactccagacaacagttgctgagccacatcgagcgctcccgccgtaccaatccgacttccagccacttcacttgtgctaacgccaataaccagcaggcgaccagccttgagactggctgcttctgcgatttcccgcacaacagaagtggtctgtgcttctagcgaaatctcatgatccaattgtcccactattggaacctcctttggttgaacagcctctcagagactaggcacggtctcatgccccaaattcaacacactctctcctgatcacaatctgactatattatagccgatgtttcagatttcgagcagaaaaaatggaagaacctttaaaggaatcaactctcagctaaaaatctggcataacttgtatatgaaaaaaagagcagtccacacctatgtggaattgctcttttgcccaggcgaccggccgtatatccgatgctccatcgtggttaatcccacttttgtcgccagttacatcggattctcatttttccaccttatcttaacggattagcggccgaaaatcaacagattccgtacaaaacagatgagtaatactaattttattcggaagaagcctttagcttgtccagcagcttatgcagcgccgtacggatttccgcagctgtgacatcgtagtcttctcgcgaaccgccaaacggatctgaaatatcaaagcccggaatccgttggtgtaattcaatcattcgttcacgctcctgcgccgatagctcttgtccaagtgaagccatcaactgctgtgaagcatataaaccatccaactcctgtacatcattcaacaccgcatcccggttctccacatattccttaagtgtaaatactttgcccgccgtttggggaaagcgttgaattacgtgctgtttatgtccttgcgtcaaggttaagatcagatgcgcccacccggcaagcccgtcgctcaaaggggttgaagtgatctgatcggatatatcgtgatcacgtagaaccgcctctgcatgtcgggatatcggtgtgccttccatcgcggctactcccgcagaacgcacttccagttctagcccatgctcagcagccaacttacgcagcatgccttcagccattggactgcgacaggtatttcctgtgcatacgaataagatattcttcaacgttttcaccccccgtatgttaaaaaatatataaacagaggattactataatcctaatcctttacgataaccctgcacttattttacactgtctacactaaaatcaaaacataaacataaagccgaatgccaacaaaatggcaccacccactgcttccccataatctcctagattacggctgaccttgcgacccagcagcaggcccagcatcgccattgctcccccgcaaaaaccaaacgccagaacggacagcaccagatcactttggaacatacccagtgacactcctacagaaaatgagtcaacgctcaccccaagtgcaaacagcaaaaggcctaaaggcgaacgatgatccaatacctgtacgccgtctcctttaaaggaattatacaccatatgcccgcccaaaaggatgagtagaccccctgcgaagtaggccgtcacatgacctaataaagaactcatataatggcctgtgaacattcccagtaatggcatcagaatgtgaaaaaagccaatgacagtactgatgcgcagcacgtctcgcaggcgtatccccttcatgccgatccctacgcccagcgataacgcatccattcctagcgctaccgccatgatcagaatcgttacaacctgcccggcatgggcagaggctgccagcatactccatccctccattatccgtctgttcttgtacacgttatgcggacaaggggcaaatcagtacaagcatgtactgaaagtacccaataccgagacgaggagggaggaaaatttaatataagaggctctgattcgacagaagctacaagcggacgattcggtgacctgccgctttaagcaggcggttcatgacggcgtctcccaatcccttcggcggacaggattccgccaaaatgtaggtgacgccgtcctcgtcgcagcgacgcagcacgccgtacaggcgctgcgccgcctcatggagcgcgtccagcttgcctagcgtatagacgcgctctccggcgtagccggcggcatgctcgtcgaacgcgagcactgccgtgcgctccccgcgcgcggaagcctccgccaacgcggcgcgaatccagcccgtcacctcaacggacgacgggccttgtaccacgctcaagcggcctcgcggcgcgtagtgcgtgtacttcatgcccggcgagcgcggggctgggctgtccgcgtcttccccgggcgtagcagccaacgccgggtccagcacgacggcgcgagcaaccgcagcgagctgctcagccgtcacgccgccggggcgcaggatggtgacggttccgtcgtcacccgcctgcaccaccgtggactccagccccacccccgtgggacctccgtccaaaatgccgccgattcggccctccagatcctctcgcacatgctgtgcaagggtgggactgggtcttcccgaccggttggcgcttggcgcagccagtggacaacccgcttcagcgatcagacgaagcgctatcggatgatccggcatgcgcacaccgactgtatccagcccggctgtcacacgcgatgacagtgcctgcggcactaccggcaatacgagagtcagcggtcccggccagaacatattcatcagcgctcgggctgtatcgtttatttctgctaccataccctctaattgatcagcatcagaaatatgtacaatgagcgggttatcggagggacgtcctttggcagcgaataccgcctccaccgcttttgtactacgagcatcggcccccaggccgtacacggtctccgtaggaaaggctaccgtctctccagcttggaggagtacgccagcctcccgtatgcccttttccgccgcgatccgagtctgttcagcccaaacttcgtcagaaacatccccgtcaatgttgctcacaggaaccaaacatcttacatcccaccattgggtatgggaagacctcaatgcctgcttcagctcgcaattttcctgttcgtccagcttttgctccgatttttccttttgcacaaaatctccgcgcaagtcttgcatttgattcgatttatcactcatatcagatcatcccatatcttattgtcatatacaggccagtgatttcgcttgatcctataaggctactttgaaagatcagtttatttggctctgccatgtgtatatctatcgtaagctccattatagcatatggggaaacttacactcctcaacgtttaggcaaacaagccactcacccagctacacagtcccgcaagtgcatcccacagaaaaaaacgtacttccggctccttgtcagcggcattcgtccgactttctccgtgatccgtttttgctgatactgtttgtgccgctgcttcaccactgcctgcatcaataaagcacagcggaggaaacagcacgcaccaccaattttgcccttttccttgccccagcgtaacccgaagcgcttcataattccctgctgggtagaccagaccaccgtacattttcgtcgggaaaggtacgctcgccagttccacctgatgatcatatgcaatgccgcgacgagccagttccgtacctaccaaacggtcaatttcaggtaaatgagcaccaatcaatgatctagcttgatctaagctttgcgggttttccagctcacccacccaggcattcatctgctgtacaatagcgtcccgtatttcgcgtttaaccagctgatcctccggacgatccgagttggccaaaatacgcagtcgaatggagtcatgtggaatcacattcagccctgttgtagctactcctgatgctaaggtacctcttgttccagtggtcatagcagcatccgtcttttgaccttcccaagacatcattaatatcgaaatacaaaatagtatcattgcagcttgcttgatccaatttctcatcttcgtctcccccaaacccaaactctatcatgtctatcagtctgtccggtttgggagagtctaaacctatgcatcttgtaaaagattcaagaacactttacagattttcttccatacaccctcaaatcatgctacaccaagcttctgaccctcaccgaggcatataaaaaagcccagatttcacaatctggactctctcgttgcaccgtttcaactcacacaaatgccaatcagtttcaagccaaatccacctgcactaggcttttttcgccttcctcaagcttactctggaaggctgtggcagatcgtcctctagctcttggccgtgcaccttaatactcataaccaagccgatactagccatgttaataagcaacgaggtaccaccataacttatgaacgggagcgtaatcccggttagcggcataatgcccagaaacgcaccaatattctcaaaaatctggtacagcaacatggacacaatcccaacaataatatacggtccggcgcgatcccggcattccagcgaaatcaggatcattcggtgaatcaaaataaaatataacaatagcagcactgaagagcctacaaagccaaattcctccgctacgactacaaaaatagaatccgcgtacgtataaggaacacgcccggactgtaccgaggttccttgcaaaaagcccttgcccatcatcccgccagaggctatcgccagcttggcatttttggtatgataagacgccttcgcggttgcctcttccggtaccaaccaagggtccaaacgctcaacccagtgactacggccaatccccttcataaaggaatcaatctcatcgtgaaacgaaatataagccttgatcccgccaccaacggcgactgcaaatacgatgaatccgattaacgcatgggatgccttcacattaccaatccatagcataccaatgacgatgacaatgtaaccgagcgcattacccaagtcattttgtgccataaccatggcaaacgggacaaagctcaccagagcgactggaagaacatcctgaatgaaatacagcttgctcttgcgctttttgatcagcatataagtcagaaaaatgataaggaccagcttgaatacctcagcaggctgaagattcaagccaccaattttcagaaagccctgagagttgttaaccgtcccgccaaaaaatccgagacccaataggaatattccgcctccatatacgtacagggcttttttaatgaatatccgaaaatcgaccatcgctaaacccaagatcgccacaaaacccaatatataatacccaatcatcctctggtaatcgttgccgtgatcaggcaggttcgtaggagctctacctgcgctgtatactgttacgatactaatcgccatgagcaaaatcagaataaagataaccggaccgtcaatttttttcaatttctgaagcatgatttccccctgagccgtttctcggtcatactcctcttattctaaaggaaagactcgcaaaaagaaaatgcagcactactccgagacacctaggacatgtcgttcgatcccagcaaggtcaggaacgattataatgttcttccaatgacccgcctgttccagcaggtcagccacgtctctggcctgtcccatccccaattcaaacccgattagccggggcggagcctgaaggagtccgagctgctccagcattgcccgatacgggccgagcccgtcaggaccaccatccaacgccatccgcggctcatggtcgcggacctctggctgtaagccagcgatgtcagcagccgggatgtacggcgggttggacacgagaatgtccaccctcgttcccgcaaatggcgtcagcagatcgccctcgcggaattctacggctgcgccgttcgcagcggcgttatgagccgctacttttaacgcggcagccgaaatatcccctgccgccacgcgccagctcggtcgctcagccgccagcgtcacggcaatcgcaccgctgcccgcgccgatgtcgagcgtctgcggagcgccgcttggccacagccgatcaccgtgctggagtatcgcctcgacgagcagttctgtctccgggcgtgggatcagcaccgacggcgaaaccatgaacgggcggccatagaattcctgccgtccgataatatactgcgccggttcacccgcagctttgcgggctatggtccgttcccacgcctccttggcggtggaagggaacggatcacccagagcggcgtaaaacgccgtaccttccaacccaagcacatgctccagcagcaaacgggcattatgctgcggctccagaacgccacagcttcctaaaaaagaagaagcctcaactaaggcttctctgacactcatgttccgttccggcgacatccgatacacacaatcgcgttcgttccccaaaacttaaacctcttgttccatcaaatcagcctgctctgcaatcgtgagcgccgatacgatttcttcgatctccccgttcatcacctggtccagcttatgcatagtcaggccaatacgatgatccgttacacggctttgcgggaaattgtaggtacgtatacgctcactgcggtctccggtgcctactttgctcttacgctcgcctgcatatttggcttcctcttcctgacgcagcatatccgaaatacgggcacgcaaaacttgcagcgccttctccttattggagttctgggattttccgtcctgacaggttgccataatacctgttggcatatgcgttacacgcaccgccgacttggtcgtattaacggactgtccgcctgcaccgctggaacagaacgtatccacgcgaatatccttatcggaaatttcaatatccacttcttcggcctcaggcataacggatactgtagatgtcgacgtatgaatacgcccacctgattccgtcgtcggaatccgctgtacgcggtgtgcgccgctttcgaatttcattttgctgtatgcaccacgaccgttaatcatgaaaataacctctttaaagcccccgagatcattcatgttcgcgtccatcagctctacacgccagccttgagtatcggcataacgagtatacatccgatacaagtcagctgcgaacagtgccgcttcgtcaccacctgctgcaccacgaatctcaataataacgttcttatcatcattcgggtcctttggcagcagcaaaatacggattttttcatccaactcccgcttgcgaacactcagttcttcaatctccattttgaccatttcacgcatctcgtcgtccagcttttcaccctgcatggtttttgcagcttccagctcttcaacgacatttttatattcggtatatgcttcataagcaggctgtaaatcagactgttctttggaataatctctaagtttcttgctatcgttcgctacatccggatcgcagagcagttcgctcagtttatcgtagcggtccgccaatgattgcaatcggtccaacaagcgattcacctcttcagttaaattaatatgaaaccagcttcaatttcactggctacagctctttattataccaactaattcatgaattagctacaagaaatactgactaatttaggattttgcaaaaatccacacaacatgcaaaacaataaaaaagtcgccgccctaatataggcagcgaccacgtaatctagcacctttcagaacacacataatgaagtcatcgtcttttatatatccgaatcaggtattgtattctggaaattatatattaaacattaaaacggaaatgcataacgtctccgtcctgcactacatattccttaccttccagacgaagctgaccacgttccttagccccgttcatcgaaccagcagcgaccaaatcgttgtaggatacaacctcggcacgaataaatccgcgttcaaaatccgtatgaattacgcccgcagcacccggtgccttcgttcctttgtgaatcgtccaagcgcgtacttcctgcacacctgctgtgaaatacgtatacaggcccagcaagcgataagctgctttaatcagacggttcaatccggattcagctaatcccagctcctcgaggaacatcgccttgtcttcgccttccagctcagcaatttcagattctaccttggcgctgatcggcaccacttctgcattttccgccacggcaaaatcgcgtaccttttgcacatatggattgctatccgcttccgttacgccatcttcgctaacattagctgcgtagagtacaggcttcatcgtaagcaaatgaagatcgcgtacaatcaaccgttcttcatccgacaattctaagctacgcgcaggtttatcagcatacagcgattccttgatccgctccaacacttctacttcttgggtgtactgcttgttgccacccttcatgtttttgcgggaacgttcaatacgcttgtctacactttcgatatccgccagaatcagttccaaattaatggtctgaatgtcgctgatcgggtcaattttgccgtccacatgggtaatgttctcatcttcaaagcaacgtaccacatgtacaatcgcatccacttcacgaatatgagccaaaaacttgttacccagaccctcgcccttgctcgcaccgcgcacaagtcctgcaatatcaacaaattcaaatgccgttggcaccgttttattcggcacaaccagttcggtcagcttatccagccgctcgtctggtacttcaacgacgcctacattggggtcaatcgtacaaaatggatagtttgcggattccgcacccgcctgcgttattgcgttaaaaagtgttgatttgcccacgttcggcaagcccacaatccccgcttttaaagccataatcagaacaactcccgtttatataaaatatgcgttatgccatccgttagtttaccaacccacattatatatgagaacctatacacgcggcaagcatacggttatgaaattcaggatattgctatatccctatttagatttctttgctcatctggatatctgtaatccgatagcccgacttgcgatatacatgcaaagctcgctcattatgcccaaatacatgcaaaccgatgcgtacagctcccagcctgcgagcctcctgttccaaagcctccatcgcctgcgtgcctagacccctcccttggtatgaatcgtatacaagaatatccagtaggaaggcttcttttccttgcaccccatccgtaatattgaaccagatgtagccagcttcctcctgactctgccccccggcatcggaaaacatcaacatatacaggtgagcatgaggtgtgtctagtctctgtggcaggtatcgagcaaaactttctgccgcacgttctggtgcttcttctaccgtccatgtacccgcttggattttctcatccgcgtagtcggcaagcgagcgttgttcaaattgatcatattgctctgcattcatcggaaccaatgtaataagtccgctcatccgtttaccttctttcttagtcgagtcgtatttttgagtccttctattccatctaccccaataccaaacataaccgtgcggagttccagttcgacctgctccatacgtgcctccagcgcttcactagaggcaaccgcagaaccgagcaaagaacgcccgaagcctgccatatcagctcccaaagcaagcgccttcgctgcatcgacaccgtctctcagtccaccgctgccgatcagagcaccatgtggctcagcggctctgacttccacgatacaatcagcggtcgagttgccccaatccgcaaacgcctccgccgccgcacgacgcacaggatcaggattgcgaaatttctccacttggctccagcttgtcccgcctgcgccagcgacatctataaaggctgcacccgcatcatacagtctcgatgccgtctcgccatctatgccccaacctacttccttcactcctacaggcactgaaagctgacgacacaactcctcaatgcgttgaagcaaaccgctaaaatccaaattcccttcaggttggaaaatctcctgcaatccgttcaaatgcagcaccaacatatctgctccggcaatttccactgcacggcgacaatcatccacaccaaatccgtagttcagctgcaccgcacccagattggcaaggatcgggatactgggtgccagactgcgaaccgcaaaggttgaggccagttcttccctttccaccgcagcccgtaccgaaccgacgcccagcgcccagccgcgtctctccgctgtctctgctagtcgctcattaatcgctcctgtctcggcgctgccgcctgtcatagagctaataagcagcggtgttcgtacagctcgtcctaaaaaagtagtatccagacgaacctcgtcaaaatgcaactccggcagagcgcagtgcttaaaggcataccgttccagcccgctggtgatgccttgtccggccacatcttcttgcaaacaaaggcggacgtgctcaatcttccgttcacctgtccttgcggcaggcagcaaagagccggatttgttaaaaccgtcaggtgctccctttatattatccgtactactcatctatgtcccacctcatccaaagtcactctgttattgcatcaagttcaagaagcacaaataagaccgttcccgaacacggtaaccgatctatttatcgtctcttatattcaatatcgtagcccttaaagtggctattttaagatactttcattgtatcatggatggaaaaatatatacacgatcgtgaacattttttcttacccatggccatgttcaaaatttgcaataaaccagttatttcggaaactctacagaaaagccgctcctaattgaactgccgcttttctgcaaaatgcctactcgaaaggacgatccctattccagcaagataaaggccatttacaatctcctctatcccttcatcgaatcaggtacagatgaaatgctttctgcttgttccttcgtacgcccatgtccaaatttgaataccagaataccaccgataatgaccaatactccgatcaacttgttaaaggtaaacggaatcttttctaatcccagccatcctaacgaatcccacaacagggccgtgcctaattgcgccgtcaatactatggagatcgcataggtcgggccaagtcgcttcattccttgcaccagacagaacacaacaccgacaccaatcatgccactgaaccagtaccacggctgcatatgctgtaaagtaaatgtatttttcccttcaaaaataagacttccgagtaaggaagccacgaaccctgttcccagcaccaatgttgttgtagtccacgatcctgtccgttcattcaccttattattgaatatcgtttgcagactgaccaaggcacctgcgataatcgccaatacaattcctaataacatatgttaactctcccttgatgatccttgatattcttctgctttcataaatgcccatattacaatgattcataaatattatgtcctgccagttcactcaaaccttttctgtcccgaatgacaatgtagccttttgtccgttcaacccatccatcttcaatcattttgcgaataacacggttgagatgtctatagctggttccgatcaaattcgccacatctaccagactggatgcacgtaattcctcatgaaaagccgtattcgattcgtcaaaagaaaccgatagcaggtagctcgccagcctgacttccaccggatacatgagattgaaactggaaaagtcggagtccaggcaaaactttcgcgtgacaatatccaatagaaattgcagcaaaggagcatagtctctgccgtatttgttcatccattggtggtgaataccgatcacatagatcggagacactgcctctactgtgttgatgacgtgactactccgaatatattcaacatctcctataacctcgatcggtgttttgaagcaaagaatcagggtcttcccttctgtagagctggtataaatcttgaccttgccctgcaccagtatatatagatgcttgatggggtccccctgtaaacagagcttttccccttgctccaaacgatgcaacgacaaataaggatgtagtggctcgtagagtatggattccaactcatgcagctgcaaaaaatattttagctgctcttgatcctgaatttctctcattcctaagctcaccttcaatctctacattctaagctttctttacaagttaaatttctattttaaagcttcagaataattacacccgcgatcatcataccaatacctataaattgtggcagcttcatcttttgcttcactataccgaaccatcccttaatatctaccaggaaggttaaacacaactgcgcaatcaacaacgccgagatcgtgaacgtaaccccaatatgttggattgccgtgacttcactaaaaataataattgctgcaaaggcaccgccccaaagatacatcggctttacctgtttcagttcagccacattgccatcccttgtaaacatccagactaatgctgccaaaataaagcctattagctgagtaacagtggccgcctgccatgtaccgatatcctgactaatccgtgtattcgctaccccctgtagcgtaatacacgctcctcccagaaaagcaaacaagattcctctcataaatcgttattctccccatgtaaatgacttttctatatattaaattatagggcagacttcctataaaggacatatgtcctcaacgaatagtaaaacatcctccaattcattccattcagcatccgcgtcaatcctgcacacttgcgttaataacttgacagtatcccatcataaaactgcatgttccggcacgataaaatggaatgcagcattcaattgaggagttgatcgtcatatgactacacgtgatccgctgcattctgtgccggaatatcaaagaagaactgagaaaaagggtcgggcttttaaaatcgccattctggtacttatcctctggctgattgccgtcatgctgtatcagacccataaaccattgcctccgttcgtctcttatgagagtcaggagtattcgacccatgaggtaaacttctggacagatttgacctatcccaccggggatggaagcactgcacagcatgaaggtcaaactttgaatcgtatgctcgggatcattgatgaagctgagcaatttattgtcatcgacctatttctgttcaatgactataagcataaaggtcagcacttcccccaagtcagcgcacaaatgaccgatcatcttattgccaaaaagaaagctcatccggatatgcctatctttttcattacagatgaagtcaataccaactacaattctgcccccaatcctttgttggagaatatgaagcgagcagggattcaagtcgtgcagaccgatgtagacccgttgcgggactccacccccatctattcggcagtgtggcgtacctttttccaatggttcgggcagcagggcacaggttggattcccaacctgatggccagtgacggacctgatgttacggctcgctcctatcttaagctgttgaacgtcaaggccaatcaccgaaaattggttgccaacgaacagacagcgctcatttctacaggcaacgtgcacgacgcgagcgcctatcactccaatgtagcgctggaggtgaaggggcctatcatcagagacattttacaaacagagcaggcggtattagacttttcgggcggtggacagcttcctgcctatacaccacaggccgaacccaaagttccatcgagtaaggacagctatcgaatcaaatatctaactgagggcaaggtgtacacctcagttctgaatggcattgcgcagacgaagaaaggtgacagcattcatatgggcatgttttatttggctgaccgcaaagtattgaacagcctgctggatgcctctgcccgcggtgtaaacatccaattgctgctggaccccaatcaaaacgcgtttggtcaggaaaaaatcggcatccccaatcgtccggttgcccaggagttgtccgataaatcgggcgggaacattcaaattcgctggtatcataccacccatgagcagttccataccaaactgatttatatcgccaaggcgcaaggagagcatatcatttggggtggctctaccaatctgaccccccgtaatctggatgatttgaatctggaaaatgagctgtgggtggccgctccggcggacagcaagctgacccgacaggttgcggcctattttgataagctatggaataatcagggggctgaatacagtttggatctagcagcttacgaggatcattcaacattttggaaagatattatataccgcctacaggatattttaggctttactacattttaactacaggatactgctgtagcgaattcgtttatgcttacagcagcggtgaaagcagccgcgcgagcgattccatcaaacgtttgaacagacgttttttcatgaattcttcacgtacaatcaggctggcagagtgcaaatctcgttcgtagtctgttaccatctgctgcacactgtgcgtttgaattaacagggcgttaacttcaaaattcaaatgaaagctacgcatatccatattggctgtcccgatcgtcgcaacttccccgtcaatgatgaggagcttggagtggaggaaccccttttcatattcatataccttgactccaacctccagtaacgactggaagtacgaatgagacgcgagaaacggtagccatttatccggttttgcgggaaacagaatacgcacgtccaacccggacaaggcagccatccgtaaggcagtcaggatatcttcatccgggataaaataaggagtggcaatccagactgattttcgggcggacgtgatcatggagaaaaagagatttttgagcactctccgctcattatccgggccactggcaataatctgcacgcctccgtccgtaattggttcaatattgggagacagatattcgctatcgagcaccgactcacccgtcatgtgaagccaatcttgtagaaatataagctgcaacgtccgtacagcttcgcccttcacaatcatatgcgtatcacgccaaaagccataggctttgttgcggctgagatactcatctcccacatttagaccgccaattaatccaatattaccgtcgatgactacaattttacggtgattacgatagtttacccggctggagaagaacaagatccgagcgccgccgtacgcaacaacctctactcctgcatctctcatttccttcaaaaatgacttcgacaactgaatactgcccaccgcatcgtacataaaccgaaccttaacacccgctttagccttttcgatcagaattttttgaatgctggtaccgatatcatccgaccggaaaatgtaatattccatatggatatgatgctgcgccttgcgcagttcttccagcaaagtggagaaggtttcatctccattgttcagaatttgagtttctgtcgcaaaataaatcggggagcgggccagtctgcgggccaaacgcattaactgctgctgctcacctgtaaagcaggtcagatctcgtttgactcgcaaagcatccttttctatgcggtcgtaagcctgttggtcacgcaatgcctttttatcatacttgcgacgcttgaatacattttgcccaaacagaaaataaagaggaagtccaacgactggcagcaatgccagcagcaaaatccaggacatcgtagtggagggattacgattctccgtaaaaataatcagactgatggagatcactgtcagggtggaaaaaatactgatgacagttccttcatttttgccgatgtaattaaacaagccaaaataataaataataaacaccatagccgcgatcaatacggccagtaagcttcgcctcataactaacctcacttccagtggactgcatttgacaagtattcttcattatattgtacatgagccccttatttcttcccacttttttattaaaatgttgataaaaaaaatccaaagaaaagctttatacaaaacgcaaggatgctgggttgacacttactttttttcgtgcaagaataaactaacgaacgttaggtaggtgaaaataatgggaatggaagagattcgaaaggccgctctttttcaatttgccaccaatgggtatgagggagcctccttgagctgtattgccgctgaggttggtatccgaaaaccgtctatatacgcgcatttccaaggcaaggaggatctgtttctacaggtggctaggtacgcttttcaagagcagaatttacgtattttcgaatactttacggaacgtaaagatcagccgcttaagcataccctgcatgacttcttgttttggatgggacaggaatatgagagcaacgactcagccaagtttatgcttcgcttttccttctttccgcctgtatcgttgtatcacgaggtgctggatattgttaatccttttctggataaaatggagcgaaaattaactcgccgcctccggaatacacgggatcgggaaccctttgggcatatggagccagtggatgtggctttggcttacatgaccctggtggacgggatcatggtggagctcctgtacagtggaagcatcaactaccaccgaagactgaacgctgcatggcctattttttggcgtgggattacgctaacctcacctcatgaagcgtgaagccgtcgaacttataaaatttatttttaaggagaacattcatcatgaatcgcagttggatttacgtttttgttggaggcctgattgaggttgtatgggtatcgggtttgaagcatgcggactctatactcgcctggattgtaacggtgctggccgtggtggccagcttttatttaatcatgaaggctgcgaaccgactgcctgtaggcacagtgtatgctgtattcaccggactagggacagggggaacagtcgtaggcgaaatgctgctattcggagaaccgtttcaatggtccaaaacgctattaatcgcccttttgctggcaggtgtggtcggtctgaagttagttaccgaccgtgatgttcaggaagggagtggcgcataatggcttggattgcattggttatcgcggggtgctcggaagtgttaggagtcatcggtatgaagggagttacggtgggcaaaggctggaagtccttagtgctcatggtcttatcctttgttcttagcttctctctactcagctataccatgaaaagtttgcctatgggcacctcctatgcggtatggacaggcatcggaacggttggcagcacaattacaggcatgttcttgtacggtgaacaaaaaagcgtactgcgcgttttattcatcgccatgattcttgccgcagcattgggattaaagctaatatcttagcatgagcgaatggcatcaaatgttgcaaattgctgatcttaaaggagtgatgccttgtgattaccaccgtaacgcttaacgcggctgtggataaaatctacacggttgcaggcttcggtttgaatgccgtccaccgcattgaaggcggcctgacggtaccgggcggcaagggcgtgaatgccgcccgcgtcatccgctcgctaggcgagcctgtacgagcgaccgggtttgctgccggacacaccggacggctgctcattgacgggttgagcgcagaaggcgtaagcgccgatttcatcgaaatggcacatggggaaacccgtctcgccattaccgtgctcgacccgtccgcgcgcacgcagaccgagctgattgagagcggaccgaccgttgggccgattgaattagccgcactgcggcgcaaaatcgagacccttgccgaggattcggcttgggtcgtattctccggcagcctgccacccggatgcccgcccgatctgtacgccgagctgtgtacgctagcgaaggcgcgcggcgcgcgggtggcgctggacgcgagcggtgaggcgctacgcttggggctgcgcggaaagcccgacctcgtgaagcctaacgaggacgaggctgctcgcttcgcgggaattgacgccgcgcgcccggatgccgctgaagcggcggcagcaaagctgctggaagctggagcgcagctggccgtcatctcgcttggtgcgcacggggcgctggcggtaacgcacgatgcgcgctaccgcgtgagcctgccagacgcggacattgtcagcccgctcggcagcggtgacgctatggtcgccgggctggtcaccggcgcagctacggggctggatctccctgccatgctacggcagggagcggcctgcggcacagcggcagctctgcacgccatggccgggaagatcgagctccaggacgtgaagcgtctggagcagggcattacggtgacgctgttttaattcagcgtcattttttttatttcatccaagcattcgcttatcttcatttcacaaatacagtttccgaatgctctatattccaaatgtgggttttcgagttgcttacagcaaaaccctgttttccagtatatttttcatacaaatatgcgacttcgaaggccccagcttaactaatgaatcctgaagctctgcaatttcctctaccgacgcggtttgtatcttaatgagataattaaattccccactgatgcgaaataaatcggtaacttccttcgcctctctacaaaattcaaccaactcttaatgtggatgaaatatatcaaaaagcccttgcccacggagcaagaacctttgtggaacccaatcagcttacacttggtgaacctcctctagttgtaacaaatgcattagtccacagccccaatggtgaggttatcgaatttatcgaggatgttgattttgatatgtctctattgagcaataagtaattctcatagctattaaacggttcctaaaaaacatccgatatattgattatcgctttgtttaaaggagtagattatcatctcaattgatttcaatgtgtattggtttcattttagttccgatttgctgatgccattgttcagcttgattggactgctactcatctatagcaccaacctaagccttaaccgagttggcagcaagattaaagtattatacaatccatctaaccctcgggacgcccgaattgcaggcggtgtaaatggtgcaggctgtctggcctttatgctgtttttgatcggtgttccctttgctttgagcggggtattcgctatattgaagtttttcctctaaccaggcttggatcacatactggtaataaaatttatcgccatatacattgccaggcctaaaataatcagtgccgatattttgttgagcacagtcccaaacttcccttctgaatccatacgtcccacgagacgccctgccgttgccagaccgataaaccatatccaagatacggacacagcggccagaccaaaggcccagcgttccccgccgtcatattggagggagctggttccaattacgccaaccgtgtcgagtatggcatgtggattcaatagcgataccgaagcggcaaaaatcatctggcgtttcggccgcatcgcctgactttctcccgaggaagctgccttcgatctccataaagtccaggccatatacagcagaaacaaacagcccgccgcataaagtacgttcgtgagccatagaaattgctgcaaaataagggacacgcccccaaccgcaagcgtgatcaggattgtatcacagacacccgctgtaatgacagcaggcagtgcattgcgaaaccgcgactgggacgccccctgattaaacacaaatacattttgtacccccaaaggcaaaatcaatcccaatgccaataaaacggcatgtataatagcttccagcataattatattcccccaaatttagtccatcatatttctctagtatttgctctcctaaatagtcctcgcgcaggaagcttgtacgtttctaatcctctcgtatttcctttaaattcttcacgttctgcgtgttctgttgtacactatgcttcaactgctctaacgcaagctcgtagtcccgcggattattcatattgaacgcggccttatgccacatgtcttcactcacccgcggcaaatcctctaccgtcgcataacgaacgttcagcttgttcaaccaatcggtgagacgcagctgtctattgcgcaaacattcctcggcagacggcagcacgctccgatggtacacagccagcaacggatgtatacgtccatccatagaaggtattactgcttgcaatgttggttccgtcgttccatgcaactccgtccatttctcagttacaacgagcaggtcttgcagcacctctagctgtataaaaggcatatcacaagcgacaaccattccccactccgtagtagatgcagataatcccgcatggataccgcttaggggtcccatacctggaaaaacatcagacacagtttccataccactcagaccatatccttggttgtcacgagtgactacgacaacccgctgggcagcctgctgcaatgtagtatacgtccgttcaagcatagtggctccattgatctcaagcaaagccttatcctgtcccattcggctggaacgtcctccagcgacgataataccagtcactttcacaaataaatcctcctttttttcagaaaacaattgcaaatatgcatatgaatttttgaacaaaatttaattattacataattgttaatttattggtttgttaaccctttcaacacatgatacattggaataaagaacctccccacagatcggcatcgatgcgcagttctctatcgggctaagaaaggaatggcttgtcttgcaaaagagagaaattcaagagactcctctatattccttaaaactgtataatttttttctatatggagctatggtcattttctccagcttcttcccgttgtatctgcaagatatcggcatggacaagctggagatcgggagtctgatggccatcgggccttttgtatccgtattcgcgaaccctttttggggctatacaagcgaccggagccgtaacctccgacgtattctgctatttatgattataggtaccttgttattgctacaagctttgtttcatgtccatacgtatatcatgatttatgtgtcgatgattggtttttattttttccaaagccctttatttgcgcaaagcaacagcctaattctcagttatattgagggcacagaccggaaatttggcgcattccgtatatggggctccttcggttgggctgtgacagcagcagctgccggcatagttattgaccaaacggggatatccagcatatccaccatctttacggtacttcttctggctgcattgatctgcaccttgtcgattccaccactgaaaagcactgtggagacagcaaccattcatttgcgcggctttggcagtgttttaatgaacggatactttatatcctttattttattgggcatccttgtatccatcccgaattcgatcaacagcgcctttatgtccctgtacatcaccgagctgggtgggtccaaacagatgcttggttttgctgtttttatgtcatcggtattcgaaattattgtatttttgctgtttgatcgcttcttgaagaaaagaatgaccgtgatggtcggctgtttggcactcgtcagtttgctgtttgccttacgttgggaactgatggctctggccacagacccgattcagattgtgttcattcaggcacttcattgcgtcaccttcggtggatacttctatgtaggcacccagttgaccgtcctatttacccctgcagcataccgatcatccggacaggccgtatataccttaacctggagtggtatatccggtatcgtagcaggttttgcgggaggttggctattccagaactttggtggagaaatgatgtaccatgcaggggtgttcttcgccctacttggatctgcgggattcgctatcatgtggtatatgctgtacaagaacggttatcagccaggactgccagcgggcacaaacgaatagaagaagccccttaacaacactagaggaatgagctatcccctcttcccttctagcttgttagcaaagacaatagagtatcgtcaagtcaatgatcatgtataaagagtgtgcatgcgtaaaataaaggagtctgccgacggcagactccttttcaacttggtcgcacgaagctaccatctctcccacactttccaccagcctattgcttaggcaattggaaagagcttttcaacgatacaacacggttaaatacaggctgacccggttgggaaagcttcggatcgacactgaaataaccatgacggaaaaattggaacttgtcctgtgattgagcttctttcatgttcggctcgacatagccatgagcaatttccaaagagttcgggttcaattggtcaaggaatgttttttccgatgcatcctcttcaatctcttccgtgttctctgcgttaatcaaaggctcatacaaacggaattcggcaggtacagcctgagtagcctctacccagtggatcgtgcctttcactttacgtccagtaaagcctgatccgctcttggtttctatatcataggtacagtggatttccgttacatttccgtctgcgtccttaatcacatcgttacatttaatgaagtaggcatgcttgagacgtacttcattaccagggaacaaacggaagtatttgcttggcggattttccatgaagtcctcacgctcgatataaatctcacgggaaaacggtatttgacgtgtaccgagttccggattttcagtattgttttccgcctccagcatttcaacttgtccttcaggatagtttgtgataaccaccttcaacggatctatgactgccatggtgcggggtgccttaagcttcaaatcctcacgtacaaaatgctccagtacctgcaaatcgatgactccgtaggctttggaaatgcctgtctcatatacgaagctgcggatggcttccggcgtgtagccgcgacgacgtaaaccggaaatcgtcggcatacgcggatcatcccaaccatctacgtgcttttcatcgaccagaagcttgagcttacgcttgctggttacggtttgagccaggttcagccgtccaaattcgtattggtgcggtaccttttccatctcacattcagctacaacccaatcatacagcgggcgctgatcttcgaattccagcgaacagagtgagtgcgttactccctcaatcgcatcttccagcggatgagcataggagtacattggatagatacaccatgtgtcgcctgtattgtgatgtgctgtgtgtgaaatgcggtaaataaccggatcacgtaaattaatatttcctgaagccatatcaattttggcacgcagcaccttttcaccattttggtatttgcctgcacgcatctcttcaaacagcttcagattatcttccacactgcgatcccgataagggctattttgccccggttcggtcaatgtgccacgagtttcacggatttggtccgcgctttgatcatccacgtaggctttacccttttggatcagcaggatggcacgcttgtacatttcttcgaaataattggaggcaaaatgtttttcctcccattcataaccgagccacttcacgtcctcctgaatggagttcacgtattccgtgtcttccttcgccggattggtgtcgtcaaaacgcaaatttgtgcgtcctccgaattcatctcccaacgagaaattgatccagatagctttggcatgtccaatatgcaaatatccgtttggttcaggcggaaatcgtgtaacgacctcctttaccttacccgtacgtaaatcctcttcaataacatttttaataaaattggggggagtgatcggcttctccacgctaatcaacctttcttccgtataatctgtgtaaaacctgttcccttaaatataccctttcacaccgcataactcaataaaatgaaaatccttatgctctctttagcaaaaaaagtaacaagttatgaaaaagagttaacattttcggcaaataaattcgttatagtgtatatatcttttattttgcccggaaaaggagacccacccgtgtttaagctgctcattgtgatcctgctgtctatgcttttgtcctcttccgtcatgacttccggccatccttcatcggacccagtgaacgaaactgtacaatctcagccgctagccagcgctccagaagactcatccgtccgcttatatgccgttaatccgtcacagggattattccaatcagctgtactggaaatcggccagcaacgccgcacattccgatggtcaggctcggcggatatctccaccgcaccacaattattttacagggatgtgaacggggatggtgtccgtgaagccgtcgtgatcctcacgcgtgcctcgggaacgggtgtcgaattgcaggaattgcatattgttaacgcacgcacgatggaagaatatgcggtcgaatcggcagtagatgctgtgtcccagcgcgtacatagctcagtggagctacgtgaccacaaccgccaggttcatattgctgtcacgattgacggtgttacacacacgataaaccctaaagcatccgtattttacgatgatccagcccaatttacaaagtatctcgattttagctctgtcgtaatgtatgatgctgaacagcttcctctgcaagccactgtatctggcagtgtatccccaaccgaatttgtaggggatttggatctaaaatatgtatacgagcatgaacggttccgggtgggacctattgaatttgaagcttcctctcccttttgacgactctcgcagaataaggtagcatgggattaaatgctagactggctggtttagcgattttccgagtgaaagaggggatcaatcatgtttacatatgcgttggacgaacgcacagtccttcggccgctcaccaaggagcatgtgcagcctctgtttgagctgatcgaaatgtcccgtgaccgcctgcgtcaatggcttccatgggtagactctaccacggaaatcagccacacagagcagttcgtgcagggcgccttgaaacaagccgcagagaacggtagtctgaccgccggaatttggatagacaacgagcttgctggcatcatcagctaccatgagattaattggactcaccgctccgttagcatcggatactggcttggacacgggtacgaaggacaaggtctaatgaccagcgcctgccgcgtattcgttgaatatgctttgatggagctggacttgcatcgggtcgaaatccgttgcgcaactacgaaccgccgcagccgcggtattccggaacgtttgggctttgtgctcgaaggcattgtacgcgaagcggaattgctgcccgacggctacatgaaccacgcagtgtacggtatgctccaaaatgaatggaagcagcttcggtaatattgtattgtacaacaacgccgcagacctgatcaggtctgcggcgttgttggtttaggcccgggcatacaaccgaattgctgtctgtagccttccgcctatttcaagaaataggccattaacacatcatctacgaattgacctgctatgtaaaactcctcatgcaaacgtccttcaatcgcgaaaccgcttttttcataaaacataagggcttccgtgttgcatgagagtacacgcaaactcaacttacgtatgccctccgcagctgcaatgtccttcatggagttcatgagggccgtcccaatacctttgcgatgataagctggatgtacagctatatttatttcgagtacatgacagttactagccaacagcgttggagaacgaaatccaatatacccgcagagtacttcctgttcgatggcaaccagttgagagcctggaggcgtattgcgcagaaactctccgcgcgacttccaagacaatgaagcgggagccgtgcgttcattccataccaattcatccagcgcaatcagatcaggagcatccttcatctccgaatgacgtatcgtcaagggttgacttgtaaacaattcctttcaatccttcctgtgaaggctttcctgaagcaataactacaaccatccgtcactattgtaccataatcacagcatattactgcacttttattaggacttaagaactgggagcgtccaccttggacgtcgtagtatccaaagtatccgaatgatgccggaaacggttcaaccagctatgcaggacgaaaaacaggatcgacaacaccgctacgcctgatgccagccaaagtgtaggcggtaacccaccgccatcatacaacttccccataatataaggccccattacccgtccggctgcgccaatgccccccacaagcccaatgtaaaagggtgcaccccgacctccatgatcagacagaaatgctggaaccgcaggtgcaatcagcatttctcccagggtcgcgagaaccatagcgaatatcattccagtatagttctgtgtgcccagcatgacaatataagccgccaaataaaatcctccggcccatgtcatttgcgctgaagcgtgatgagcgtacagtcgttttatccaaaaaataatgggttgtgcggcaaaaataaggataccattcagtgtccatagtaatccatacatcgttttaggcaagccctgctcaataatatggggagacactcctgtattccagatcgaattcccgaaccataaaaaaagcgaacctaaccccacaaagagatacagtctggtatcacgaaacagcaatcgagctggtatttcctctctttttttcacagacttactgagctgcacttctccctcttcccgatccaccctgcttagataagaccagaagaacccggcaaataccgcagaagtcactccgttcatcacgaagctgagctgataggaaaggtcagccagaacgccactcaatcccgtacccactgcaaccccaatattgttagcgacataaataatattaaacagctcaccacgacggtcagcaaaacgaaaacctacaaaggcctgaatcgcaggcacagatacgacattaaaaaagccgataaagcccatcatgatgacaaacgctacccaatgaccactggtaaatggaagcgcgagaagtcccagcgcgttcatcgcgagtgagccaacaatcagtttcttggctccaatacggtgatagagggctccgcccagcacttgaccaaaaattccgcccagagattgcactaaaatcgcaatccctgcatctcccatactacggtttagctcgtcaaacacatacatgctaaccaacggccacatcagggaacttccagcagaattaatcagactagcaacgagaaacactttcacttctttcggataagactccaaccatttcatatcttttgtttctccttttgcatctgacgccataaaaggcattatctcattgacgcttcacattcaccaccgttgagaagaaagtagccccctgtcccatatccgacagccgatcagaggttaacacattggcacgctgtctgcgtcctttgccttcccaccataatccctgactaatcactgtaccgggcagcattagatcagtgactttcgctttcagctcatacgtccctcgatcattccatacggtaaccgggtccccatccgcgatgttccttgtctgagcatcctccgggtgaatttgtagcaagggctcccgctccagtcgctgatgcttgggcaagttagcgaaagtagaattcagaaaattatggtttggcggtgaaataaacattaatggatatcgctcgtccgcttgcggtcgatgctctccgtcgtacccttcaatcagcggtacataagaaggcatcgcgggcagacctgcttgtttcattttttccgaatacaactcaatcttgcctgaaggcgtggttaaacgatccaaataagtagcctttggcgtcatatcgagctttacaaaaggtgacttctttaaggcttccaaagttacaccgttgagataagggttcgttggattatcaagcgcacctgcgatcatgtcctcttcactttccgtaaaggcagcttcgtcaaagcccatagcccgtccgagcaggctaaacagctcataattgcttttgctttccccgagtggagcaatgacgggttcctgcatctgaacatagtgatgccagtaggatttatataggtctgtaccttcaaaggaagatgctgcaggcagcacaatatcggcataacgggccgtatccgtaagaaacaggtcatgaacgactgtgaacaaatcctctcgtccaaatccttcagtcacccgttccgaatcgggggctacaactacggggttactgcagtatacgaataacgccttaatcggctgtcccttctgtagcagcgcttctccgatccggttcatgttgatcacccgggcatccggattctgtcgcagatcaggacgcgccagattggcgccgttaaacttgccataagcgccattagagcgtgacgctcccccgccgtgcttcagccattgtccagtgagcgcaggcaagcatgtaaccgcacgtacgttcataccgccattatcatgatgctgaagcccattgccgatattgatatacgctgctcgcgcagttccgtacattttcgccaaacggatgatatccgcttccggtacgccggtaatccgcgaaactcgctctggtgtatatgtcttaacatgctcgcgcagttcctcatggcctaccgtgtagcgatgtaaaaactcgtcgtccgtcagtccctgagcgaacagcacattcataacacccagcgcgagcgccgtatccgtccccggatataacggaatgaaccaatccgcccattgcgccgtccggttgcgatgaacgtcaataacgaccaccttagcaccttttttacgtgctttctcagccaaaacgacctgatgcatgttggtgctaatgacatttccaccccacacaataatgaggtctgcatcctccgtgtcctccgggctggtgccgcccttaaaacccataacggacgcccagccttcattccctgccacgctacatatcgtctgatccagttggcttgaacccagcgcattaaaaaatctgcggtccattccatccacactcaatacgcccatattgccataaaagctgtaggggagaatagattccggtccgtccatacgtatcagctccttgaaccgacctgtaatggtatcgactgcctcctcccagctaatacgttcaaatttcccttctcctttggggcctatacgtttcaacggatagagcacccgatcaggatcatatacccgctccgtcatattgcgaactttgttacaaatagcccctttggtaataggatgatccgggttcccagtcaccttgactatctttccattttccttgtgaagcaggagcccacacgtatccgggcaatctaacgggcatacagccggaaaaataccgtcctgctgctccgtcatccgctgccccctttgtaagtcttgttgaagcgtggcctcaggaggcgcgctattacgatgatccatagtgttgatgctcctttccgttaccgtttccaaaaattacactgatcttatcatatccacagctttggcctatggcaagagaaggatttccccacacagccgctctccagaatattaaaaaaatccgtctgctgcatagagcaaaacggatttttttagaatcataattttttttcaacatcctgtttcatcacatcttaccgagggtaaaagagatcaaggcattatgggacgagagcacactcatcctccatgccaaatcatggaccactcccaaaaaaatccgccatgacaggtttcgttcccccgggcctgtcatggcggatttgctttgttcattgctgtttacagtaccgtaattaagcaggatcactcaacggatttgatgtgcaaccgaagaagtagttggagattcattcgctggaagtgcgttggtttgaggctttttcaaataggccaaccagtaggctccagccacaaacatgctacctcctaccaaattccccagccagaccggaatgaagttcataacataatctgcccacgaaaagtggcctgcaaaaatagccgccggaatgagaaacatattggcaacaacgtgctgaaatccaatagcgacaaaggccattgtcgggaaccaaatccccatgattttgccaccgatagagtctgtgctatatgccagccatacagccagtgctacgagccagttacatcctatacccgatataaaagactgcaaaaagctttcatgtagcttatgtcctgccatatccaccactttgtccaggtaagggcccgtttctgtcaaacccagcacatgcccaaagaaaaatgcaacgaataacgcacctgcaaaattactgagtgtaataatcgccaaattacgaagcatggctcctgtcttaacccgtcctgcccatctcgccaaagggaccgccatcatattgccggtcagcaattctccgccggcgatcaaaactaataccagacctacggggaacaccgcagctccaataaaggtggcaatgcttccccattctttaggcgcacttgcaataacacgtatatccagcaaaaacccgagtgcaataaatgcacctgccaaaaatcccagtaccaccgccacagtccacgggttgttcgccttggccactcctgtttccaccgtcttttcagcaatttgccccggtttatagctcgccatatgtccccgctcctttaatatctttttactaaaatattcttctttcatattttatttaaaatcagtgattatgtttgtgaaaaaaatcactttctcaactataaaaaaaacagcccttggaaaaaggactgtctttctgtattattacatctactgcgctactacgcgctttacatttagttgtattcttccttttcaactgctctcaagaaccaaataactccaccgaggcctaccagggccacgactacaagaaaaaggatataaaacaaatccataagctacttaccccctaatccttatgctactctatattgtactataaggattcgtccgtacgtctcagattgttgacaaacttatgaacaatgtcacagacaaatctaattatacagtaactgggttccgttcggatattgtaggcaatgcttgcaagcctgctgcattcaggaaattccaaggcttgttataatgcggctggaagaagaaatcgacaaaggccaactggtcaatggtcatatgattttgaatggctacggatagtgtgttaatggattgcgtcaaatccaccttcgacataatttgagcccccaaaattcttcgtgtctcctgctcatataccactttcagtaataccttttcggaggttggcataaattcaggccggtagctgtcctcaatggttacagcttctacagtcatgccttcgtccgttgccgccgcttccgtcaagcctgttcctgcaatattgtcttcgtaaattttgatacccgaagttccttgggttcccatgtaggcaatggttggttgtaccagattacgtgctaccagtgtacccatacgaactgcgttggttgccaaagggatataagccgttttacctgtcggattgtagcggattgcacaactatcacctgctgcaaacacgtccgggcagctactttgcatatagttatccacaatgatcgcaccgttaggcaacatatctacctgacctttgagcagatccgtttgagggcggaaaccgatgcagagaataacaagctctgtttcatattctcctttagaggtcacgactttactcaccttaccgttcgtaccctcaaaacgactcaccgtctcgccaagtaccagcttaatgccatgttccctcagggaactttcaatccggtctgtatactcatggtccaaatacttattcaatatacgatcagcactgtcaatcagcgttacgtttttaccgttcatttggaaagcttctaccagttcaacaccaatgtatccagccccgacgactgtaatgttctgtacgtgctgggctttctcaatgatatcattggaatgattatagtttttacagagcaaaatatgatcaagttcaatgccctccagctttggaataatgggccatgatcctgtggtcacaattaatttatcaaatgtgtctgtaaattcttcacctgtttggagattacgtgcatgcagcgtcttgcctgccgtatccacactcgttacctcatgaagcatcttggtcactacacccaagtcagacagttgatctggagacgaataaaacaggccgtgtggatctttaacgacaccacctacatacagcgcaataccacaagataaaaatgaaatattatcattacgctcgtaaacggtaatttctgcatctggataacatttagctgtgttgacgatagctgccgtgcctgcgtgtgtacatccgataactgctactttcatgttaaattcctccttggtgtgtgggcataaaatgtataataattgtgaatagtttcacgtaaacagctcgtttgcatttgtgatttatttcacttcatgcgcttattatagtgtgatatttttcacattacaatagcttttcgtgatattcacaatttgtccacatttaaaaaagaaaggatatacaaaatcaacggtttgctgaaatattttttgctccattcagttttccctgtaagccccctgattatgcccttggaatcgactttcacatgatgcgccccccttaaacaaatgcacatgtagagaacaaaaaaaggtccgtttcccggagacacgcaggaaatcagacctttttaaacatatactttggagttaaggcaaagctactatagcacttgctcaatggctgctttcatcgcttctggtgactccttcggttcaaaacgacccacaggtacaccttcacgattcacaatgaatttcgtgaaattccactgaattgttccatcttcctgttctccaggctgttgctttttcaaatattcaaacagaggcgctgtatccggtccgttgacgtccactttggcgaataccgggaaactaaccccgtaattcagttggcaaaattcagccgcttcctcgctgctgcccggctcctgaccgccaaattggttgcaaggaaagcctaatacaactaatccccgatccttatattcatcataaagcttttgcaaatccccatattgcggggtaagtccacatttactggcggtattcgcaataaccagcaccttaccggtgtaagtatccagagaaacctcctgattcgctggtgttacggcattatgtgaatagacagacatacagcatcctccttcgtgtcgcttggtttaggttacataacctattttaaccaaaacgtggcggacatgccaacatccgcagatcctttaccgtgatgccatcacttcgagtctgcgtgttcacgttcggaagcggacatttttgggcaagcataacaataccgctggcctccacctgtcttgtaatattggcaacaggacggtttcatgtaggtattttcaccggggcggtaaggattgtccaattcaacgagacgaaccgtaaacgggtttcttttacgtccgaatacctctccctccagctcacgtgtcacataaatataatcttgttcaaagcgctccacatcctgaggatcagtcaacaatggctgtactctatccttaaaatacagcaatgtcaacggaaactgtccccacatttgcccaatagatgcgctccccactgcagctattgcctccaatatgggccgcatctgcaaactgtaaaagtcacgtaacacttgctgagcctgttcggaagaagggtcatccccattgttccgcgtattgtccagctctgtgaggtcgatgacctgaaggctaatagagggatattgaccttcataacaaatatgaaatctaagattagatacggacagatccaaacggcgttcacacagtgacaccataaaatgctgtgcaaacacgagaccacgcaactggttcacaaaataaacggctgcggttaaatcgtcttcagcacgcagaagatcaccgtaatactccatcacagagcggatcttctctggttcaagccattcagccactggcccggaatatactgcatcctccggcgtgactctcactattttcgctagttgctcaagctgatcgtaatccagtggtttcatggtatgtcctctttaacctcttgccgctacttgtgctctagcatcacgtcgctcagcaacagaacccacgagtttcttatcttccacattcatttcttttactgcttggctcacggcaggctgtccagccaaagcatacggaagacagagcggtacacccgtacgaggatctgttacaatatccgcctcgatcccgaacacctcacgcagcacatcaggggacataacctcagttggagttcctaccgcctcggccttcccttttttgatcgcaatcatatgctgagcataccgggcggcatggttcaaatcatgcacgaccataacaatggtgcgctcctccgaagtatttagatactctagcaaatgcagcacttccaattgatgtgccatatctaaaaatgtcgtcggctcatccagaaacaaaatatccgtatcctgcgcaagcgccatagcaatccaggcacgctgacgctgaccgccagaaagctgatcaatcggacgatcgtggaactcgctcattcccgttacttgaatggcccactccaccattttgcgatcttccgctttcatggaaccaaaacctttttgatagggaaaacgtccgtaagataccagttccgtcacggttaatccttccggtgcagtcggattttgtggcaaaatagccaactgcttagctacttcccgggtggattgcttatgaatggatttaccgtcaagcagaacactgccgcccttaggattcatgatgcgagccatcgtcttcagaatggtggacttaccagaaccatttgcgcccaccaaggctgtgattttcccttgcggtatttctacgttcagatcttctacaatcaatcgatcttcataagcgatatccagatttgccgttttcagacgaaacatttggaatcatccctttcccttatccaatatatatagtcacgggcttaacgcacgactttcatcaaaacttcattctatctttatataataaagatattgataatcattatcaagtgttaactggtttatttcctatatcatacagtgcatatcatccaatatttccacaaaaaattcaaaaaaagatcacagctccacgaagctgtgatcttttaaatccggcgaatcgcattatgactgtacagaagacagtccaaatgcttcagccatgagacgtatagatttcattttggcatcaaagtcgtgaataatgctcgcaaccatgatctcctgtgcattatagtccttacttaactgctcaatctgacgcttcacctgttcgggcgaaccgaccaccatacgtttgcgattctcacgaatccgcatccggtcaaacggcgtatacggatacgccagtgccttttcgacggaaggtgttccagcggagcgcattccctgctctaatagaacaagagacaagtccatactggaagccaagcgattcgcctcctcttcggtatccgcacagatcgcaaatacggcaacaagcgaacgtggttggtcactatgctgggaagggtggaagctttcctggtattccttcatagcccctgtgccgccttcaccattaatgaactgcgcaaacgcaaagcccacgccacgctcggctgccagacctgcgctatcaccactggagccgagcaaccacatttccggtacagtttctataagcggcatcgcctgtagcgaaccgaaacggtgattattgcctgtgctgtcatgtaaataagctaacaggtcatccaactgctcagggtatagatctacaccacctcgcattttgccttcttgcagggctctggtagcaatgggcatgcctccgggcgctcgtcccaggcctaaatcaatgcgtcccggatacaatccctccagcacacggaagttttccgctactttataagcgctgtaatggggcagcatcacaccacccgaccccactcgaatggttgaagtacatgcggcaagatgtgaaatcagcacctccggactggagcctgcgagatttgcggcagaatgatgctctgatacccaaaagcgatgataacccaagcgttccgcctctatagcaagctcagcggtcttttgtaatgcctgcgcatgcgtcatgccttccgataccggagattggtcaagaatgctgagttttatcataaaagtctgacctttctatttgggaataaggataggcattaattatagcacgcgcagccacagttacccaagaggggcccatatcaattttatagtggaaacgtttatttttcgtaaagacttgcgttccctttatccgcctcatagagatgcgaacgctttttaaagaaactgtacagatgtgtaacgattactttcaagacagcataccccggaaccgccagtacaattcccaccacaccaaacaaattgcctgcggtcagaataacgaagataatcgtgatcggatgtacccgaagagatttgcccataatttgtggagaaattaatttaccctcaatgagctgtacgactgtccacacgataaccatcttgagcagcataatcggtgaggtgaccaaggctacaattaacgcaggtgtaatggcaatgacgggacctaagtaggggacaacgctcgtaaaggatgcaatgactgcaagcgtcagagagtagtctaatccaatgattaggtaaccaatatacaacagcgccccaatacagaagctgacaataatctggccacgaatataggaactgacctgatgattcatctcggtcataatgcgatctgtttctttacgaaacataggcggcagcactttcaggataaactgtggcagcttgtgtccatcttttagcaagtagaacagaataaatggaaccgtggcaatcgcaagtaccgtttctgtaaccacgcccaaaaagctgcccacacccgtccatgcattattaataaagctagataacttttcagaagctttggaggccagctcagatggattaatttgaatggtgttctggaattggtttacaaaatcgctgccgatcagtttctcaaattgtcgttgtacttgctcgctatagccaggaaaattctggataagtccttgtatttgatcgcggattacaggtaccaccgatgtaaccacaatcgcaataacccctataatgagcaaaaacagtacaacaatggagtatactcgtttcaccttgttacgctccagtacatcaaccaacgggttgaacagatagtacaacacgccggataaaatgacagggagaattatcgtttttaacagcaccatgacaggtgtgaatatgtatgaaattttggtaagcaccaagatattcaagccgatcagcagcagtaccagcaggaataacacaaacttgttgttcagaaaaaacttcttgaatcggtctttccatgccggagttatttccacaccacattccccttctctttacacaaatgagtagacgttcttcatagatacgatatatttttggaacaaaatatacaaggttatacccaaataaacacaaaaacaaacaaagttgtacgtcatcgtacgaacttcgcttgctttcgagggttatggagtatcatttatcgtggttgcagcatccaccgtcgtggtcacaggtttgttctcctgttcaaaaagattctgtatgaagcgcttgagctttctttcgtctacacccaacacctgcgcacccttaatggtttccccgcgcaccaattcattcggcgggatttgctgcttcgctactgttgttgcatcgatattaaagcccaatgaagccaattgcagcatttccgtagtgctgagattcgtttcaatataaggagaaatgctatttagaatactcggcagtttaattagagatgaagttgactgaattttaccgccaagctcggtaatgaatttgcgttgccgttccgtacgcgtaaaatcggaagtagcatcatgacggaagcgtacatattgcaaggctgttttaccgtccatgtgctgcattccctttttcaaatcaatatcaaactggtgtttatctgccttggaggtatagtgcatatctttttcgacatccaggtcaataccacccacagaatcaaccagcgcaataaagccattaaaatcagtatatacataatattgaatcggtatgcccagcaggtcgctcacggtctgtctggtcaaatccggtccaccgtaggaaaaagcagcatttaatcgactttgcccatgacctgggatattgacgtacgtatcacgaagaatcgacataagtgtagcctttttcgtaaccggatcaatagaagcaaccataacggagtcagaacgccctgaatcctctccacgggagtcgccgcctagcagcagaatattcactctttctgtcccatcccattccggtgggagagatacctctacaggttgtacattggtttgagtttgtgcctgcggtttgaatttcgaatcctgtccggaagcaaccgaaatttgattcgtaaaatgatatatagaatacgtataataaccgcccactaaaagaaccgccgcagtcacagaaatgcctaaccattttaaaaattttcgcatattttcgggtaacctcgcttttattcatcatcgttcggcttttaaaagcatacccttcctgcaagttatctgtcaattcgtgtcgtctgttctagtggtcgtccgcataccatggattcaaatggacaagcacctcataaacccgaggttcccgcttcataacagcccccttaatcagtcggataatatcgtgtccctgctgaatcgtcaaagaggcatccaccgaagcgcggatgtccacaataatataatggccgtgctcacgggcacggatacggtcaatacgttgaacctcggctacactcagtgcggctgcggcgtagctttcaatttcctccgttgcaatcgctttttccataagtacatctatggattcacggcccatttcccacgccaatttcagaactagcaatgccactacgaatcccgcaataggatcgccgtaagataagattgaaatgctccaatgctccccaattagccctaagccgatacccagtacagcagccccagaggcgtacacatcagcgagatgatcttttgccgttgcaataagaccctgactattggccgctctcccgatacgaatcgtgtaaatatacagccactgtttccagagcaaggaaataatagcggctaccaatgccagtatatgctcctgtggcatcggttcgaacagtgctgcaatggaatgatagccgataaatatgcccgctccaaacaatatgaccgccaccacgcttgccccaatcacttctgctttgccgtgaccataaggatgatcctcatccggcggctggctggatatgcgcatcgctcccagtgccgttgcagaggcaatcacgtctccggcattatgcacaccatcggctaccagcaccttactgttgaacatgagtcctgtaataatcttaatgccggttaataggatgttgctaatcaggctgatccatgctgagaccatggcgcgcttgcccatatcctgttcctgcatgatgtataatccctccaaatttatcttttgaaaaatgcatcctaaacgctaatcgtatatttcaaggtagccccgctactcatgtcatcttatggtgctgctccttcagcggtatggatgaagattacaatagccccggaagatgagcctccccggggctattatgataaccatagtggagtattctatgagaatactcctgttttaactatctagaccgtccgcgacggcctccttgtccttgaccaccacgcgggccgcctttggcttgtccaccgcggccaccttgacctccgcgtgcagaaccgccgctgctgcggtcatacccgccacgctcgctgctttgtcctgccgagcgaccctgacctccgcgtgcggaaccgccgctactgcgatcatatccaccgcgttcgctgctttgtcctgccgagcgaccctgacctccgcgtgcggaaccgccgctactgcgatcatatccgccggtttcgctgctttgtcctgccgagcggccctgacctccgcgtgcggaaccgccgctactgcgatcatacccgccacgctcgctactgccgcggctagagcgacgttcgccgcctgtggcatcacgacggcccgcctgttcgcggccgctgccccggcgtccaccgccagagtcgttgccgccgtaggaacggcggtcgtttctgcccgagcggcgttctcgaccctgccgatcagccgtatcggaagcaggtctacgctgtccgccgccctcactgctggtgaatgtgacaccagcaactctttggatgttccgaagctctggaacatcccttggcgtagcgagcgtcaccgccacgcctttgcctccggcacggccggtacgcccgatgcggtggatgtagctttcggcatcctgcggcatgtcatagttaaagacatgcgtgacgccttctacatccaagccgcgtgcagctacatcagtcgctacgagcaattggagtttcgcttcccggaatgccttcatcacttgctcccgcttgttctgggacaaatctccgtgaagctcaccactctcaaagcccatctcttgcagctcttcgttcagcttggcagcccggcgcttcgtacggcagaaaataacagccaagtacggacgatctgtattcagcatatccaccaatgcctgttgcttaccacggtctgttgtttgcacaacgacctgacggatttggctcactggaacggaagaagcggatttcactttgacatctacgggttcattcatatatacacgagccagcttgcgaataccggctggcatcgtagcggaaaacagcatcgtctgtctccggtaaggaacctcctgaagaatcgtctccacatcgttcaaaaagcccatgtgtaacatttggtcggcttcgtccaggaccagcattttaatgccacccagatccagcgtgccacgtctcaggtgatccagcagtcgcccaggtgtaccaataatcagttgtgcgccgcctttcagtttacgaagctgacgctctacgtcctgtcctccatatacagccagtaatgacaggttcggctccgtagcagccaagcattttgcttcctccgtaatctggagcgccagttcacgcgtaggtgcaatcacgagcgcctgtgggtgtcgcttatccaaattcagcttttgtagaatcggcagtaaaaacgcaagcgtcttcccggttcccgtatgtgcctcggcgataacatcctgaccttccatcaacagtggaatcgactcctgctgtacaggagttggggatgaaattccctgttctttcaaggcttctacccaatgctgctctacgcctaatgctgcaaaattcttcaagtggtattcacttcccttatctgtattcaatatgtgtcacgtaaaataggttcatgtgccatatgacatctatcgttccatagttcagaattcccatttttgtatcggttctcattctacccttttcaggaagggagcttatccgttatcgttgaatctgttcatgtaaccaacatacggccgccatgcggctcaggcccgttccatgtatgactttcctagtatacgcgaagttgaactggtttccaaacgattttaatgaacagtaccacagtcaatgtaaaaggtgaattcgatcttcatgtcatatattatggtataagaattggtaattcatgaataaaggatggatgcttgtggttaacaacctgcaagagctgctccgcattgtaaccgatgatgaattgattccgctgatgctagctatcgaggctcccagtatcaaatcatcctataacaaagggacaacgccggaagtgtacattcttttgtccaatgaccccatgtgccaatcttctaatcattgcggcatgctcgtttcaatccgtcaggacgtttatgaaaatatcgaccaagcaatcgtcgaagacgttatgatgaagctgagccagtggttaaaggcacacaagctgctacacagcccgcgtaacttttatgctggcagtaaagcacgcgctattatggatattgttccatttatgctcgaacaggataccccggatatgaagtatgtttttcaatcgtggactccgttccctttaccacacacttaaacaatccgccataccattaaccctaggaggctgcaatttatgcaaattcaagttcaaaaggttgaaaaaaaagagaacgaatatctcattcattatcaagccgggggagcgttgccgttcgttccgcatgatattgttctgatccatggcaaacagtattttataggcacgattttgaaagtagagccggaacaagcccttgtacgtatcaatccagaatatgaagaccaactggcagggtccatcggactggagctggctttctctccaaccgtttctattcaaggtgcagacagcattgtcgaaaagctcggctatttccctccctttcattatgaccgaattacggctgctaatatgacgaaagaccaaattacgctgacgattgagctgtcctacgctagcgtgcttgtccctaaatcaccggagctggagccttcggctgaggcacctgtaatccctgaagctccagcagaagacgtcccacgttatgtagttacttttacatttctggaaaccaaagagcatgtattaactcctgtagaaacagaaaatatcatcttgcagcttgatttccgctatgaagaagcagacatggtcgttgatattgatgccctgtcgggactgtcaggtagctttctgtgcagaggtatccgcgcagagattaaggaactgaatgaataaacaggaggctcgcgagctgttacgttgtcattcttttattcacgatgatctggatcatcccaaaatgcaaaacggatttctagggatgctccgccccttccagggagaactgcttgaggataatttccatgagctgatgaccatcattgaagttctggcagatgagttggagaaaccatccgtagaacgggagctgtccacatcatcgacatccaaaggagaatcactctacttatgcgtgtaagaatatttatattcatattgattatcggaattatatgtgtgcctgcctatttcattatgagcagctttggattatttcaaaatgaaaaggtgcttgtacattacaagcttgccattgaggtaaaggataaaaagtatgatgcctggcctttaatcagcagctataccgctatagataaaaaaggggataatcgtcagctctactatcaggcgaagggctcgggcatagagtatctgtttcaactagcctacaggcattatgaactccgaccctccaaggaaaatccttttctggacggggaagtccactacaccatggatcatcctgagtatgtgcgtgaggaaaagcagtatgagaatgctaacgactacacggaattaacccattattacaatcagcaggaacagatcatttatacctataatcccgaagccaagctcgataaaacatacgtccgttccatcatcaccgctgggatgactcgcacaaccggtagatcaagccgtgcggtaaaggatgactatattaatatcagcaagctgtttaaggacaagctgggagtgaatgtgaaggtagatgtggatgagaacaacaaaatcgtcaccttatctatgacatgatctcacaaatgatgcaccgctagcgattaataatgattttctggatgaaatcaatcatgtcgagaacgctttgttaattggtgcagatgcgggcgacaatttttacgttctgatatgtaatgaatacaccccgtatgtgtactactgggaccgcacacatcttcatgcttatgatgacaaactgaactatgatattgcagagcaggacgaatgtggacatttgtatctggtggcaacagactttacaacgttttttaatcaggtaattgaacgactcaacgagcagaaagggaggcctactgatgacagaaatacataatcctaaatggggaccggcttatttggaaggttggattgtacccgaaaacccggaggcatgggttgagcaggagtggacaggtaagctccgttcacaggccggacatacaaaattccacattttttattatggagagcttatggacgagcttatcgctgtaactgaatttgcaccccagctcattattgcagaagatgcagtcacaagtgaacagatcgtgatttttgacggaacccgccatggttacgatgctctgctatgcgaagtttataccaaggaacaacagaacaatcgcactcccctgctgccctatctggacgaagatggtgaagatactttcgaggtaagcttgaccgctttttataatgtggattgggatgacgagtttgcagacgatgtggatgagaatggacagttagagctgatcaacggcgaacgatgcgattttgaagatgtgaagcggaacggctatgatgcgatcagcattacgattaccagcgctaaaggtctaaaaacagagatcattcaggaagagctggcctgacgatggtgttcaagggaatcaagcatcgggaaggcgatatttttgttattcccacgcatgacggccgatttgcggtatgtcaggtgatctgcgcactgtatggtagattcaaaaaagcgttgttaaaaaggctcgaatgtataagggaatggtgtacgatctgagcccaataccgactttacgcgctcttcatccaccaacgcttcgacgaggctatacaaatccgaggctgcataccgaaaattgccccatgtgcgtagattcaaagcatagattgggaattctccccgttcatcaggcaattgaatatcccaaatcagcaggtcattcccttcactggaagcgaagggaaccgcatgctccaaaagttctggaaagccatctggctccagcgccgcttcttgtaaaacctcttccgattcgagtaaatcatcaaaccagggccgccagtcatgataacgatgaagccatgaatcggggtgatcgccaagaggaatatgaatgttccataagccgcatagtcgcccgtaaccaagagttttgacataatctatataagaaggcggaaaactcataccattttcaaaacgatgttctattagaaaagtctcgtcataataagcctgaaactgtggacgttgcagccctgtaaaaatgctcatgttcgccctctccttttgcacgtcctattcaccttttcacccttcggtgcattgaaaaggccattttcaagtgttaatgttactaaggaatattataacatacgaatcataaaatgtacgtttttacgctctttccgaaaaggaggaacgaatatggagcaaaagcgcttcaaagatgaacatggatataaatatgactttgccgccgtgatccggagaggagaacaagtagctgttcactgtccccgttgtcagggccaagcttttatttccagatccaaaaaagaatgttattacgttgttcgatgctctcattgttattacacgtatcagcagccagaatcttatacattctatgcacgcggcgtatgcaaccattgcgagcggtattttaatatcgaaatccatgatgaccgaacgaaactccataaaaatacgaatataaactgtccgcactgtgagacacgcaatcaggttccggtgcatcgtgttcaatcacgcgaatggcatacggacgtgatccaaaacggaaaagaccctattttccagctccagctgtacttcattgattactatcggggtaaacctgtctgggctcttaaccggatacacctgaattacctgctctcctatatctctgccgagttgcgggaaaagcctacatccggtatgatgcgtacggcttcccattccattcccaagtacattaaggatgcgaagaatcgccaggccatcttaaagatattacaaaagctacagcataagccagcggctaagagaggagtctccatacatgagcatacaaacttttgacagccttgaagcactggtccatgccgttggccaaacagaaatcaatgaatgggtatttgccaatctggaacgtgttcaaagtaatccgctcaattctacctactacatcattcccgaggaagaattgtgggagctggaggatgccggtctcatcgtcaccaatcatcgtgatgaaagtatccctgcatctctgccagaccatcacgtgcaatcttggctggaggtagcgactgtacaggatgttattgaagtgttacgccacagcggaagcgagccggatattgaacgcattgcgcagggactgcgatattatcatgaatatgatgcttttatggaataagcgtctccagcaactcttttacctcagggacagcctgctttaggctgttttttagtttcttcgcgccaccccatatacgataaacaagcacctcttgttcgtagtcctccagcttctcaagctcctccatcagtacctgtgcctgctctacagtttcgattccggatgacttcagtggtttggcagactcgttgcttgccagtagaatcctcgtccaaacggggatcgtgtcaggtgttagcccatgcgcttcggcaaaagcagccgcgtaaccgtcctgtacggactgatgttcactgtccaccagcttcatataacgattcactaatgggaaatagttcgttcctttcagtcctaatcccattaccgcataggttcccggcatcgccgacttttcaccgggctctacatcgttataccatttgaattcttccatcacggtttcggcatattcagccagcaacggatgcagcgacggatactcaagtgcattggcgaagaaacgatgtagcgtagatttagccaacttgggtacaggcaggtagtttttcaccttgcttttgaacttcatccgatattccttggtaaagcccttctttaaaataccgcataaatatacaagtgcttgtctatagctttcttcttcctctgaacgaatctgaacctccaatgtttgcaaaatatcattggcttggcagatgactcgctcgcttgtatgtagcgctgggatgcttcctgatccgctctcaagccacacggaagcctgctccgagcctagctgtgcagcaatctccaaatatttctgccgtgcatcggcatcggtcgaacccacccgcatcgcggtaagcaggaacatctccatggctggcgcgggaatttccgaagggagaatatcgggcttcactttataatccaacccatagcttttttcccgatccgcatacttcagcaaaaattcatcttcagcccaatgctttaagccactgctgagctgatacctccatgcttcctcacgcttgcggctgaccttcactttggcatccattatatggagcaactcatccacacgctgggcatctatagcgtacaaatgaggatcaagcaagtgtctcactaagaagaaatcgtcctcttccttcgggatagctttactggaggggttgagcttctgctccacaaactgctggatagtggctaacagttgctgccgtttatcttcatttaggagtgagaatgtaaaatgattggccttattctccaagaccacttccagatgaaaatccagccgataacgaaagaacatggaactgaattcttccgaattaaatagcgcctctatccgttccctaaacacaggcatccattcgtcctgaacctgctgcagtgttaccccctccgtaaaaccagaaatctccatgtccggtctacgatgatcccaatcaaacggttcgtaggtatccacccacagcccatccttcttacaggtaacttttaagtattcatgaatcccttcgtgaaggacacttttgatttggatttcggcgatgcgcttttgctcagaagcgtacgcctcatcaatcgcctcaaaaattggatctatgtaggcttgtacccctgatgttgtcataagatgtgttcctccttcgtcccctcacaaattgtagttcctatggaattaagatagactaatctataactattttatttcctaattatagcatatctctcatttacttttgatctctatccctatagatagagtgccggaaagcaggtgcatcctacatgtattgggtttccacacaacatacgacggtggctgccacgacactcggagatcattactacgaagactttagatgttcaagtcccattcacagaagcactggaacatattttacgggatgaattcggaaagatggaaccatttccccgttatttcgaacctgtcagcccagacaaagccgcaacattcctactgtttaatcccccggatacgaccgaggcctacaatccagcccatccgaacgagcaagccctggatttcgctccggcatccatacaagcattggctcagcggtttaaacagcattttgcctcaaacctatggattgaaaatgagcatatctgcatggcttttcttcagactctaggcggatacgtgcgttttaactatgcatatggacgcgaagtggcgatcatttatgaaccgaaagcgatagcacttcgtgatgaaattctagcattcttgcaaaaagagcattgtcgggttgtagagtaagaggaggacgaatacgaatgacagtacattttgcacaaaccttagaaaaactggaacaagtcgttgatcctctgagacaaagtgggatgcctgatgtggtataccaatggacggaggggatttctacaggtgaactaactgagctggaggaacggctgcggatgcctttgcctgcctccctgtctgaattaatacagcggtgtggcagcttaaatttactatggtgcctccccccacactgtattgtagctgatggaccggagtgttcatataaaaacagcaatgatcttgaacaagagcagagtatcctagacgatatcacaggagagtttggctggaatcatgagtatattggctattttacatcctatggggaagataccgactcggtagtggacgagcaacgatatctgatccttaattataatggtgcgggtgatccgatactgcttgatatggcgacatccactacagagccagcggtgttctgctatcatcacgagttggaccagttcacgctgcttgcggaaaatctacctgcctatatagacaccatgctcaccttgcatgggctatggctatgggattggtttaaagtggccgatgagcatggcattcagctaaacagcccaccactgcaactctggctacgctggttgaacatgttttgcacgatgaaactggaggatgcgcagtcgttggagaggctgatccattacaccaccatgcatggcgtggatcatcctgctgtgttgcaggcttttcaagcctatgatccaaaggatatttttcttgcctgggagcagcactggcagaacattcaacatagccaggttccattctctacttgggccgttttggtaggggagaccgcggggatgggggctgctgattgggtccgctccttgtgggaaccggaaaccgtgcaagcatggacatctttagttcaaaacaataccctacatgctaagggtgcatttgtgtccacacgtgcctatctgagcgcccgttgcctacccgagcaggaaggcttggtatgtgtttgcaatcacttgctacaggattcggctgcagaagacaaattagaaggatacaccgctaatgggcagctacagcattttcgttcaccacagatcattaactggatgcaggataaagtcaatcatccggtggatggctgggcaatactttttgctcactcccgtcctacagctgagcagttgattgaatggctatccgatagcgagcttcatcagaaaattgcaacggaggcgctggatatcatgattcatcgggatcttcttcccgctctggaagcagacgcttgggccaatatctcagatctgcttcttgcttctttgcagctcagctcgttatgctcaaaaaagataaacgtcgcattgaagccgtgcttaagcagctttcagacgcggattcgcatgtacagtggtgtgaggtaaagaaagttagccgctccgtcagcggcttaaccccctgaggaaagtatctatagtgaatgcgatcaattcatcattggattttgccataggaagttcaaaattcaggagcaaagaagtcaatccgtgcagcatgctccatacggatctggcgatcaggcgctcatctccttgcatgatgcagccttcctccatagcggctttgagcccagcttcaagcagctcaaagcctttaaaacgcccactgtctataaggctgaccaagcttacagattccaggttgctgataaacaggatgttgtaatattccgggttagccgttccaaaacgaacatacgcatcagataccgtcttcagtgtgtccagagcgttcaatcccgctgcctgtgcttcatccacacgctgctgaagagcctgcaggaacaaggtatttccttctaccagcagttcacggaccacggcttccttattggcaaaataatgataaatagttgttggtgaatattcgatctgatccgcaattttgcgcatggagacttcggcatatccttgattcaggaaaagcgaccgggcggcctcaatgattttccggcggatctcactgctttcacgttctcggcgtttgatatgtttcatgagtagatgtacttgccctttctgcctaccccaatttggcggcgatacgatcagcttccattatacccgagttcataaccccttgaaacccgcccccaggctgtgtccaggcccctaccaatgacagacgattcacagctgatttgtgcttcagtctttttataccggactgccggaccgtttgtgcgtatccataaacggccccgtcgggattagcggtataacgctgcatcgtgcgcggtgtgcccaactcagccacgactaccttgctgcgaaaacccggatacagctgttctagacatcctagtatctgctgtgtcacagcttcttttttggctttatattggggacgtgcggctggccagttctccaatctgtccaaaaatgtaattgcaatgacaccctttcccggttcattaagcttagggtccatggcgttataattcgtgagcatccagttgcctttggtatactggccgctcatcataacttcataatctgtttccgaatccggctcattgcacaggattaagtcttcttcggtgatgccaagctcatgaggctcacatgataatcccagatatagctgggtgagagacgtgccagtctccagactgctgacagcttccagctcacgacgggcagcatcatggttttccagtaggcggccatacgtatgatggggactgataccagacacaatccagttggctttatatacatcgccttttttcagacggactccaactgctttactgcgttcgagtataatctcagatacttgactgcgcaggtgaacttctcctcccgctgacttaatagcgtcaaccaatgcattggataaagcctgtgcgcctccctcaatgtagtacgtcccctccaaatgatagccgatccagggaatgaaaaaatacaaggccgcaagccgctttggaggcaatccataataggcccacagcgcggtaaagaattctatgaagcggtcagacaaaccgaactggcttacagcttcccaggtcgtcatttgcgtccaacggaagaaggttcctgctttgagcaggccaaccgccttgcgccaggaagtgagagtagaaaaagcagaaaagcctgtttcaaaacggcgaatgcccgcgaataaactgacaatgcccgacacctcagcaggaaacatatttttgaggagctgcacatactcctgaacatcggacggaatatcaatggtctgtccttcccaacgaatggagtaagggtgctttttgcggagaggaacaattcgctggtccgcattgcagtcctttaacagccgaccgaagctgccctcctcgagtccgccgacaccgtgcaaggagacatcaaaggtatatccctttcttgtaaattcagttgcgaaaccgccagctaaagtatggctttcaaaaacagctgttcggtaaccgagcgcggaaagtcttgctgcacaggacaagccacccagtcctgcaccgatgacaataacatcgtattggttcatgatttcatctccttttgttaacatcgttatataagttaacactgttaagttaaggagattatataccacaatattaccgttgaaaagcccctatgacttggttttcctgctatagatgaataccatgagttcgacatatccacttctaattgcaagttgctttaaggatttttgtagaatcatccgtaacgaaagtaaaactttttatataaaaaacacccaaaaatgtagcgctttcacttgtcagattccaatgaaggtgctatccttcaagtgggattgttactgaaaaggcaaaacccgagtacacacgtgtacccggagtttgcctttttttgatttgtatgaattccacagcatacagtcaaccatcccgaacatgtagtaagcgcttttaaaaatgacaccaaaggagattaatctcatgcaaagaagacgttttgcccttgtattattatctttcgtgttcctgcttacgatctttttcccatcctccagctcagccgcagcagccgatgtcccagcgccacaggctaccctacttactcaggtacagcctttgggtgaagtcgtttctgctgtcgtactgaaatacagcaccaatattgacggggcatccttatctacgtccagctttcaggttcaatctgtactcaatgatgtatatacagacagaaccgtaaccgatgtatataccaatgatactggagccatcaccaaccgcagtactcatggcaaatatgtcgtgattgagctggatacgcaagataaaaatgcaagtacccttacttacgatgcaacaagcgcagttaaccgcatcaacacgttgaattatacgattagtcaaaagaaagatattgcaacttcaaagaaaacagtcatcccagcctctacacagactgtaaaagcaacagataaaattacaccaatcgtggacgacttccaaaaaaacacctttgaaaataaagaaggcttcaagctgaactactttacatttgagcctaaagtagagcctgacaaaacctacccgttggttgtattcctgcacggaaacggcgaacgcggtgatggaaacggagtcaacctgttagcgaatgctggtgctgtcacttgggcttctcctgagcagcaagccaaacacccatccttcgtcatcgctccacaaagcccgattgacctggagcataaattcatttgggcggatgagccacgcaacagcgctgtagccgatttggtacgtgatacggcgttaaaatacccgatcgataccaaccgaatctatattgttggtatttctcaaggagctatgggaacgtggagattgttggaaaaaaatctggacttgttcgccgcaggtgtgccgattgccggtttgaccaactatgaaaaagccgttaacatgtatgcgcctgttgaacctacacacgtcgaggcattgaaaaacgtcccgatttgggccttccatgctgcagacgataccacagtaagtcctaaaaactcgcaagaaatggtcgctgccattaaagcacaaaacggaaacctcattcacttcactgaatacgaagcagggattatcaaacctacgggacacttctcctgggttcccgctttgcaaaatcaggatatgattgaatggctgtttgcacaaaagaaataaaattgtttttcatatctataaaaaatagcgccagaacggttcgatacccgcctgacgcttttttattattcaaaaaaagacacctactttcctgtgtaccaccatcaggaaggcaggtgcaatatcaaaacgaggagactgaaaaatttgacactggtattgccatttgcagttaacttggaacctgctacttcgcgcgtttcgcagctttgatcgttctcaaagctcgtctgcgagttaccttgtttggactccgaagctgtcttctggcagttgccacatctgctttagccatgtgcacatcaccatcctattcacttaggctcatattgggagcatgcacctaaagactgttattaatgattatgattctcattatcatttaaaattatataatgaaatctactagcatgcaagagctttgggagaagtatgtatctttattacggcagtgttcatttcacccttttacgcttctgtgttacattatataagtaaaacgagaacaaaaattcgaatcagaatttacgttcgccatttttcatagtcctttattccgaactaagtcaaagtctatatcttcccgacatgtgttccataacagttcatctgtaagaaaacttaatgcatccatgttgcgcaatcgttcgaccaactcagtaatcacatctatgtcttcacgttgtacatgtcttgcaagagtgattcctcccgtgtcaccatcaacatatagatgcgaataatgcttttccttttttacatgtcgaagagtaagcacgctattgtcgatcatcatgacgtaacggtccttgatcagatagccttcaaaaagctcatacatatgcggaagatcacagggaccaagaatgacacttactttttcaaaattgcctttgttcatttagatttagctcccttcacatctattaaatcggcctttactatagattagatttgtaatttttataacttttcaagattaacctttgtagttattttatatcctttaaagataaacttcaataggtaatgctatttctatttaaatttctataatgaggtgtatgtatgggaattgtttttaaacttgaagaattacttcgagaaatcgggattactaaaaacgctctcgctcgtgaggcaaaaatcaggcctaataccatctatgagatgtgtaacaatacatccaagcgaatcgaatttaaaacatttaataccgtgatggaaacactgattcggctctctggtcgtccattaaccctacatgatgttctcgaatatatacctgaggatgaatcagagaaacactgatacattcacagaatagtccgctgcaccttatatctctgccctggcagggatatttttttccttgttatttagcataatcgttatcattatttcagagtacgtgtaactagaatctatactgataaaggagtattttttatcatgaatattcatgagagatatcattttaaacttggcgatattttagaagaacttgatatttcccgaaataaactggccgtagaagcaaaaatacgtccggctaccgtaatagatatggtaaatggcaaaaccaaagacttgaattagaaacacttgtccatatcctggattctttgaacagaattgcctatcaacgaagattttcaaggactattactcttgctgatattatagaatacatctccgaagatggaatggagaaacagtgagactgtaacatgagaatgaagattactattgcccagcggacatctccatgactaaataagtagttgcccgtgctcccttttccccaaatgaaagaagcgttgggacagcaagcccaacgcttctttataattaataagcaacttatactatgattaatccactttgccgccctctacgaccagttgatctgtaaagccttctccgtaaacagaggtcaatgtgtccttgtaggcttgatgcacaaagttttccttgcctaatgtagccagctcattgttgatccagtctaataactccttatttccctttgctactgcgggtgcaatcgtatcttgaccaccaaaggccgggatggttacggtaaagccagggttggcctttgcccaggcgattagctctgtattatcattggcaatggcggcgccgcgtttgtctttgagggctgagaagatttctgtatattgatcgaatttaagcagcttgatatcagggtaatttttcgtgaaataggtttcagccgttgttccctttgcgacaatcagcttctgatccgaattcttcaattggtcaatcgtggtgattggagcgctatcaggtgacacaatgccaaaggataatttcatatacgggttggcaaaatcgactttttctttacgctcatccgtcaccgtaaagttagccatgatgatatctaccttgttggattccaaataggcgacccggctggcagcatccaccagaacaaattccaccttggaatcgtcacccaagagatctttggcaaaccgcttcgcaatatagacgtcaaagccttgattcttcccttccgaatccacgtagccaaaaggcggcttatctgcaaatacacctattcgaatcttgccattctttttaatgtcctcaatcgaagcaaatttagccgggcctgaactaccgttggtatttccgcctcctgcacatcccgccaaaccaacaatcagcaagctcaaagccagtaataacgtcgtgaacttcattccttttctcatctgtattcatccccctgtttatatcgtttcgtactgaaatatatccagaaagtgctgggcacgctctgtttccggttgggtaaaaaattgctgtggcgtagtcatttcgcatatctgtccttgatccataaaaacgatacgatcccctaccgacttggcaaatcccatttcatgcgtcacgataatcatggtcatgccctgctgtgccagctctcgcatgacatctagcacctctctgaccatttccgggtccaaggatgcggtgacttcatcaaagagcataatttccgggttcatacacagggcgcgcacaattgcaatccgttgcttttgcccacctgataattgtctcggatacgcatctttgcgatccagcagacccactcgctccaatagctgctccgcttgctcaagtgcctcctgcttatttctccgctgaactttaagcgggccgagtaatatattttctaagaccgtcatatgtggaaacagctcgtagttctggaacaccattccgatatgctgccgcacctcacgccaattcactttcctatccgtcaggtcctgccctctataacggatttctccactctggactggttccagaccattgagacatcggaggagcgtgctttttccacatcccgaaggaccgagaacgaccacgacttcccctttcattacgtccagattaatctgttgcagtacttttcggtcttcgaagcttttgtgcagccctcgaatttcgagtaaaacctccacagcctctcccatgacatccaccccatcctgctaattttgccatctgcgttcaaatcttttggaaagtctggataacggatagcatacgagaaaatacaatatgaaaataaagccgtacacccagaaggatgccgagggcgccttgattacaccaagctcaataatctgctgccccaccttgaccacttccactacaccgatcagcaccactaatgaagtggttttgatcatccgtgtcgccagattaatagaaccgggaagcattcggcgcaccgcctggggaatgagcacatggcggtataactgtccatatgtcagtcccaatgcttgcccggattccacctgatgcttgggcagtgattccaatgcaccacgaacgatgtcaccaatctcggccgctccccacaggctgaatacgataattgctgtcaattccccgctgatattcacattcaacaaaggagtaaatccaaaatatacaacatacaaccacaccagaattggaataatgcggaatgtctccaaatataacctcagcacaaaccgaatcggtcttgattttaaggtgcgcagcaaccccatcaaaatgcctaatagagtaccgataataatggaaagtagcgcaatctccagcgtaacgagcaatccccctaatagacgctcgaaattggaaccttcaaaaagtacattaatccccgaattcagcatatcgcaccttcctttccacccacgtcagcagtatcgacaaaggtaaaagcaggacgagatatgccaataccagcagaattagcgattctgttgttttgtagtacatgccaatcaggtcttttgccacattcatcagatctaataaagcaatggcgccaacaatggaagtctccttgagcaaaaaaatcgcattcgctcctagagatggaacactgatggcaaaagcctgtggcaaaataacatatctcgccagttgtatcttggacagtccgagactcagcccggattccgtctgggttttactcactgcttccattcccccacggaacgcctcagccatataacccccgcccaaaaaggtcatgcccacaatggcacacgtcatttcgctcatatgcagacctattttcgtaaacccgtaatacagaaaatataactgtacaagcagcggcgtatttcgggaaagctcaatataggcaacaacgatgccgctaattccccttaccttgtaatacagtactgtgctgcacagcaaaccgacgactaatgaaaatagaatagcaaaaaaggcgatcttcaacgtcaaccacatagcttctccatataacggcaagctctctacaataaactcccagtctaagttcatatgtgtatacctttcgattttcaattattcctatgtatttgctctgcttagtaacaatgattgtattcctgcccaattattacgtcaatactttgatgaaaatttgtcatatttatctatgattcaggaagaaaagtgttgttttatttcagaaataaataaaaaaagcttgaaatgaataaatttcatttcaagctttgatttatgctatacgattcatcacacgagcggctcggtaacaagaaggccgccgagcttctctacaattaaacggctctcctcatttaatccccgcagggtgatggatttgccggatttcgtatacttttgcaacaccttgccgatggcagtaactgcggagtgatcccaaatatgagaatgactgaagtccaccacgacacgttctggatcatccgaaggttcgaaatgatcgacaaaatgagtcgttgaagcaaaaaacatcggacccctgacatggtacaccttttcgtcgttgttctccgttgcgctgatgcgaattttagccattttccagccaaaatgcagagcactcagcagtacgcctacgatcacgcccttggacaaatcatgcgtagccaccacaatgatcaccgtgaccaccataataaatgtgtccgccttgggtaccttggcaatgtttcggagcgatttccagtctacggttccgatacacaccataaacataactcctaccaatgcacccattggcacttcctttacaaccccgccaagcacgagcagcagaaaggccaagaataccccagctgtaaaagtggacaaacgccctcttccacctgagctgacattaatgacggattgtccgatcatggcacaaccacccataccaccaaaaaagccatttacaaagttggcaatcccttgcccgcgggcttcccggtttttattgctcttcgtttcggtcatttcatccaaaatactggctgtcagcagcgattccagcagtccaaccagtgccatcgtaaaggaatacggcaacaaaatccgcaaagtgtgccacgaccactcaatttgcggcaaatggaatgaaggcagcgagttggttagcgtaccgatatctcctaccgttttcacattcaatccaaatacatacgtaatgatcgtcatgatgatgattgccgtcaatggagcaggaatgcttttcacaaatctcggtaaaatatacacaatgagcagcgtccccgctaccatcgcgtacatgatccaattagctccatgaaagtgggtgagttgcgccataaagacgaggatcgccagcgcattcacaaatccggtcataaccggctgcgaaataaagctgataaagcgacctattttcaaaacacccagtagcacttgaatgattcctgccaaaatggtagctgcaaacagatactccacgccatgatccttcaccagaccaacgaccagtacagctacggccccggtcgctgccgagatcatcgccggacgtccacctgcaaaagagatgacaattgccatcgatatggaggcgtacagtccgaccatgggattgacccccgcaatgatcgagaaggcaatcgcctcgggaattagtgctagcgccacggtcatgcccgcaagtatatcagcccggatattaccgaaccattgttgtctaagattcatactgtctcgttccagcctcctatatttacggagagtagcgtgttgactcgcaccccgtgtgtttcgggtctccgtccagcaaccaatcgccaaggctctcctatcattcagttcgtctctctcaaacgaacccggtccgttacattcagtccatcattataacgtaaggaattcgcagagacgaatgagttaaaaggctgtttacagaaagaaatcatctatttccttgaaatatcgattattatcttcatcttattcgttttcttataattaaaattttcgcaattcctaaaattctaacctgctaaagtttatcaccttaacttcatactcagactccgcgaactgtagatcttgatccgccgtaaccagtaccaattggtttataatagctgtcgcaagaatcaatgcatctggagtcttgagctttcttgcaaacttatctttttgttctcttctgatacgccccgctttaactgcgatatctgaattaactgcaataaattccccgccaagaaaaggtattgaatctaaggcagtatcagtgggcaacccggctataaactcggactgagttataacagaaaagaaaatattctctttgtctttctcagcttgtcgtattactctatccaaagatgagtcaagtctatgaagggcaatagctgcattcgtatcaaataaataccccatctaatcccaatcctctctggattgtttaacactctcttcgatctcaagtaattgctccttacttaggctgcctcgggaatttaaaacagcttgcaaccctttcggtaacggggactctaaatcaataacctcagtttccccctgtttattttctatagtaacttttgatggttcaaacccaatatcacgaaggagatttaagagacgtattcgatgtagatcagttaatttttttgccactaaaatcactccttagcaaaagattagtttcctgtcatagctcatttgattcgttttcttatgtttaaaattttcgcaatttctgtacaagctccgatagggattcagcaatctcagagtccgcatgctgctgaagtaagccttcaaagtcaggcagtgcttgcttcaataatcgataactatagtcataataactccaaaaagctaccggaacataaccgcgtgcttcttcctcttcccactccagttcatcttcttctggatcgctgtctgccggccatagatatttttcgtccagcagcatggttagggattctacagacttctgtgaatcctcttgtgcgttttccatgtccaatgttctaacaaccgcatggtacagttccaactcactccgcgtgatatcatccgaatttctcatatgcatattacgcaataagaaaagtaacacccatggcgtaacctgccacaatgtgccttgatgctctatcagattagcaattgctgcgtactccccgttggatatcaattgtggcaactccgtgcccctgccataaggagtagtcaggcggtgccatggcacatctgcaatttggagattattcatcttatgtgtatccataagttttcctttctggtcagtatctagaatcttcccgatttaaaaatggaatatagtaaaaaggcaaccattaagagagcgacaacaaagccgatttcaatggcaggtacattccacagcatggtcacctgatgattcagcgatgaaccgataatcagtccgaccataataatgctgaacgctaacagcacgatactgaatgacagacggttgctgatctgatccagcctgcgtagaagcatttccagctccggcacagtaacctccagcttaagcttgcccttgctgataatcgaggccaaatgcctcgcatgtcctggtagttccatcagcgtctccaccagctcagtcgcaccacccagcagcttgcctcggatatgacgaccgctgaagcgttccttcaacagcttgttaccaaagggctcagccaaagcgataatactgagatcggggtccaggtgctccacgaccccctccagtgtcagcaacgccttgcctagcaacaggacgtccgacggcaaaccaatccgatggcgctgcgctgcgccaaataggtcgttcaaagcatcaccaatactgatctgtgagaaaggaacgtctgagtaatcttcccgtatcttgtccagatcggcacgcagcgcattcaggtcggtgtccggttcgaccagacccaaacgttcgatagaccgaaccatggcatcggtatttttgcgcatcagggcaataatgagggaagcgagatgattcttcatctcttcgctcaaccttcccgtcatgccaaagtccaaataagcgagactgccatttttcaaaacgagtaaattccccggatggggatcggcatgaaaaaatccctctataaaaatttgatgcagcatgctgttcaccagccgctgcgccagttctttcaagttatatccacggcgtaatagctcttcacgactacccaagtgagttccgtctagaaactccatagtcagtatacgggaagaggtatgatcccagtatattttcggaatatagatatgtgggtcctgctcaaattggagcgcaatcttctctgtattacgggcttcatggttgtaatccagctcctgaatgagcgatctccctagctcctccaccatctggcgaagctgataccgctctacccactcccagcgcttggctgccatagcggtcagttcccgcaaaatgtccaaatctcgccgaatgatgcgattaacgccaggacgctggattttaatggcgaccatttcgccgctgtgcagcttgcccagatgcacttgcccgatcgaagcagcggccagcggaacatcgtcaaaacgaaccagtatgtcctctaatgacgtgtccagctcttgctccagaatgccacgcgccgtttcagatgaaaacggtggtacctgatcctgaagcttaaccagctcacggataataggctccggcagcaggtcagcacgtgtgcttgccaactgtccaagcttgatgaatgcaggccccagatcctccagcacaagtcgaatccgttcacctagcgttttggactcgggagtttctctcgtcagccacttgcgaggcaatgacagcagctggaatagtcccatttcttccaccatatagccaaagccatgacgcgccagcgccatggcaatttcccggtaacgaccggcgtgcttcatacgaaccgccattttaatccagccggttcgcttcttcagcgtcgctcgaacccgtaagcgccgccttttctttttccagctccgctacctgtttttccaacaatgccacacgctgctccaaacttgtaacatcattttcggtagggacttccagctcctgcaaaatgcggctaacctgttcgcggatcactgttttgaattgtccctgttcctctgcccctcgttcgatcagacgatcgaccagtgctttggattccgagggcgcaagttctccccggtttacaagatcctcgacggctttctccaccttttctttgctgacaacggtgaggccccaccccaatgagatggcttttttgaacaaatcgctcataatatatcctcccctacctgtgattacctatagtataacctgaaaaggggagccgcataaagttcgcagctccccttcctcaatgaatggaatgatctatgtttaacccggaaagcgtccagcccacttggcagcctgaagcagtagcttgcggtatccctcgtgctggaagcttggctgattatgtccaggcatcaaatagacgacccgacccaagccataggacagtgaccatgccgccggccaccactggccttcgtgttcatattccatcagtagtgttttttcagtgaatggatcaaaatcaaaacgatacggctcctcttgcatctcgaacggctcgattccttccataatcggatgatccggctccgttactttgaaggaaagtggacctgcagccgggtgtcgcaagaaacgtgcccccattaactgtgcaatttcataccgtccttgcaatgtgattccgttatgcagcacaagcaatccacccccgccactaacataaaacagcaatcctgctgtttgttgaggtgacagaacctccttgcggctatcgcagtacgagatacatagatcaaatgaggttagattttccttgagcagcattttacgattctcactgcactgtacggtcatccaatcctgtaaaatatggctaatctcttcgtccaccccttgcagcgggtgaaactccggatacgaataatctcctaacaacaatgcttttcttttttccatgataaatcctccttgcctgacttgtatataaggactttaaaggcggggcccgtgtcatttattcttgtttgtggggtcaaaacgctcagaaaattccgtttggcccttatccatttctcataacaccgccatcattgtccgagctacggcatatataaataattctacagacggcctattaaatcctttagcagacgattatagcatatatgttcgctcgcaataaacttattaaaacttattcaaactttataaatctgaacgatggcgattcggcctgtttatggtatactcgtaagaaaaaaagtgcgtccatgcttgattaacaatgaagggccgctttttgtaagaatttatgcttgcggttatagaattgataagaattgcctcaaaccttatacattctataaatcttaaaaaaccggggaggttgcatgaatgaaaaggactggaatgacccggcccttggacagcttggggcgaattgtgcttcctaaagagttgcgcatgacgatggagattgacatcggcgatccattagagttttttattgaagaccagacactcatgctccgtaagtacaaatcaaccaactgtatattttgcggtgcggttgataccaacacctactttaaagatcagtttatctgcgatgaatgtgcagcctcgatgaaaacggaagatttaattccggtcacagcgactgaaacccattcacctccacttaagcaaaatatgcatatgaaaaaaatttatcagcgcacagacgttattttggagaaaatgagagagcttatggaagaacatccagcatcttcacaaaaacaactcgcctccatgcttggcgtgagtcagggaaggatttcccaactgaaaaaactcatgtaagcgaatcaccaaaaaagtaatgtatacgcttccatactatgtaaggtttaaatctattgaatttagaaaagccgggccctttaggggactcggcttttttcgtttatatgaagtagtggactcgtttgcaaacctattgaccgtaagcccggcattgttctacccagcgtgctgccgccttgggaagagatgcaagatggacatgcgtgtaggctgccaaaaggttccctttcgcataaccctcgctctggagaccacgcatccccttggtttgataggcgtaggagtagggggcggatgattcatcatagtgcatgacagaataatgaaattcatgtccccgaatggtctctccagcctccagcagcaagcaatcctgcaaagcggttgcttcccggtatcccagtgcagcccgtttctcctgcatgcggacgtccgacggaataaccccggccatgtgataggcattccccatacgatccgtaagtgtccgtgccagtaccatataaccgccgcattcggcgaatactggcatatcccagcttaccgcgttgcggatatcttccaaaaagcccgtatttgcagcgatatctgcggcaaactcttcggggaaaccgccgcccaggtataggccgcttgcctgctcaggtacgcgttctcccgccagcggactgaaatagataatctctgctcccgcctgacgtagtaaatccatattttccgggtagtaaaaattgaacgccgcatctctgacgacggcgatgacgggacgttccccggtatcagcttcatgccctgctgatggaagccaatccgggggaaacaacggttgtgcgggcagagacaacggtggagccgaatccgccaatgcccgcagtgcatccagatccgtacccgcgcggatcagctctgccgcccgttggaaaagcggctccagctcgccgcgttccacagcgggtactaaacccagatgacgctcaggaatatccagcccgtcatcacgctttaaccagccgagcacggggatgccgcactcctgctcaatcgcctttttgacgatgccatagtgcccttggctaccgcagcgattcacaattacgcccacaatgcgcagcttgggctccaagcgctgaaagccgagcacaatagcggcggcgcttcgtgccatactgcgcacgtcgaccaccaacaatacagggctgtccgtcagcatggcgatctcagcggtcgagccggtgttgctgagcgggtccttgccgtcatacagccccatgacgccttcaatcacggaaatatccgcgccttcggaagcacggataaagatttcacgcaccgtatccggtgaggtcatccatgaatccagattacgggaagaggtcccggtcgcggcagtatgataggtcggatcgatataatccggcccgcatttaaacccctgcactcgcaggccgctgtcggcgaacgccttcatcagcccaagggtaacagtcgttttgcctgcgccgctgcctgttccggcaacaacaatacggcttctgcgcgtagcggcagacggaccagactgtacaacctgcttcatgacgtcagtcataggaaacccgcgctacagacagcgtcatattgccgctttttttcttctccagcagccaatggtctgcaccagaagacaacaaggctgaaggttcactgaccccatatgcaccagtgtatttgaagacggtttccgatggattgggaagctgcaccgtattcagctctgacggagtatacgtcaccagttcccaaccgtatttggcgcaaagggcaagtaagccctcttcgtcctttttcagatcaatggtggcaatattccgtacgcttttcacggacaaacgcagctcttgcaaggtgtccagcacacccgcctccagttcctccaatgcagtcccacggttgcagccgatgccgagcaccaagcttttcggacggtacagcacgccattagaaagaagctgctcctcttcctccggctccaataaacggtcactcacgaccaatgcggcgttaaacggttcttgcaatgcttctgccgtcgaagcatataccttgatatgtccaggtacaggcttgtcataacgccaccagttccgttcgcctgtctcttgtatgagcgcaacaggctcctcgttcacaacagcagcgctcacaggagtagccttgtcgaagctatcgaccacccaacccaattcccgaccaaacatgtccaccgggatcgtgccctgcacgtccgatgcagtcgtgattacagcacgtgcgcctagtacagccgctacatggcgggtcaattcattggcgccacccaaatggccagacaatacgctaatgacatgctcgccacgatcatcaatgacaactaccgccggatctacctttttatccaccaaaattggtgcaatcatgcgaaccactgcaccgagagatataaataaaataataccgttatattgtttaaataaatccggcaaaatcagcttgaccgagccttcgaacaattgaatgccacgctcctgctcgtcgccacgctcaaatttggacatgtaatacacatccgtgcccggaaagctggctcccaaattgcggaccatttccactccatgcttcgtgattgccacagcggcaaatggattactcaccgggcttcactcccttccggtagccatgggtgaacgacttgtcgtacagcttggaacgatgcgcgtccttgtccaccagtcccggatcgagcgcccagcctgccaaaatcatggcatgcatcgttatgcctgctgcacgcaaatcggcgggtaattgagcaagcgtcgtgcgcacgatcttttgatccggccaggtcgcgcgctgcacaaccgctacaggcgtgtcctcactccagcctgctgccagaaactcaacgaccaccttctttgccagcgttgcgctgaggaacagtgccactgtacagtgatgggatgccaagtcacgcagcttttcccgatccggtacaggtgtacggccttcggcacgcgtcagaatgaccgtctgcgtcaggtcaggcacagttagctctgcacccagcaccgccgcagaagcaaagaccgagctgacgcctggtacgatttcatatgctactccgcgctgcttcagcaacaccatttgctccaaaatggctccgtacactgccggatcacctgtatgtacgcgagctacactgcgtccagcctgcacagcctcgctcataatctcgacctgccgctccaaatccatgcctgagctttgcagtacctgcgcctctggcttggccgtggcaatcagctcgtcgtttacgagtgaatccgtgtacaataccacatcggccgtgcgtagaatccgagagcctttgaccgtaatcagctccgggtcgcctggacctgctcctacgatatatactttgggctccaacgtcatttgctcaccaccattaaactcaaatattcaagctcctgtccgcgcagctcacgtgcgtcgcgccataccatttcataaggagaagtgaccttggtaatgactgatgcacggtccccaagatggagttcatccagcacatccaaaatcaaatccagtaccttggcaaccttgataaacacgaccgtatcgtgattatcaatcgcccgcttcatcgcttcccgatcatccgtagccggaataataccgacctgctgatctccgtctgccaaaggcaattccagcgctgccgccgctcccaacacagacgaaatgcccggaatagatacaatcggcacctcaggatggagatccttcatgagccgtgccaaatgaataaaggtactgtacagattagggtctccctctgtgacaaaggctacatccttgccttggctcagtgcctcccagcaagcaaccaccgttttgttccactcacgctccagtacaaccgggtccttggtcattggaaaaatgagtcccagcatctccttttcctccgggttgacgtacaactccacgatttcgtgagcatacgacttacctccccggcgtttcttcggataagccacaactgcacattcctgaatcatgcgatacgccttgaccgtaatcagctcgggatcacccggccccacgcctacgccgtaaagtgttcctgttgctgccgtattcatgctgtctctctccccctcttgaattaccagcttactcccctgctacttcgtcagccacgtccaccgacggctgtcctgtaataacatatatcggattgagtccgtcaaaacgagtcatattcaaaatcggcttgctgcgcgctgtttgcaataacgtcaccgaagtatcgagacctgctgcttgcatcgccttcatcccgtcatgcagcgtctcaatcgttgcagcattcactacaattcgtccatccttccgcagacgggaagcacacagacgaatcagttcggccaattctcccccgctcccgccgataaacaccgcatccgggtctggcagatcttccagtccggcaggcgctttggcatgaataaccgggaaatcggtacggaatttgattttgtttgcttcgacattagccagatcgccttcgttcttctcaatggcaaatacttgcccatacttggccagccgcgcacattccaccgctacagagccagaacctgcgccgatatcccatacgatgcttcgttcggtcagacgcagctcggacaagctgaatacgcgtacttcacgcttcgtgatcagtcctttttctggcttacgctggtgaaattccgcatcctcgaagccaaatccccgacgaattgcaggcacgtcttcacccttacggcggcgcaaaataaccacattcagtggttggaacgttctctgcgccatcgcatccaacgtataatgctgatacgcctcatccggtccgcccaaatgctcgccgacaaaggcatcatattccgtcatgccataatgcagcagataggcagcgactgcggcgggatgattccggtcgtccgtcaacagtgcgaccttgttctgtccgtcaatccgctgcgccaatccggtcatcggacggccgtgtacgctttccagcaccgcatcctgccaactttcacctagacgcgcaaacgccagctgaaccgagctgagatgcggcaaaatatccagatgtttcgaccctagcttggcagacaaataacctgcaattccaaaaaaaagcggatcgcctgacgcaagcacgacaatatccttgtccttgcgcaaccgtcccaattcttctaccacggcagataagccgctctttaatgtttgtttttcccctgcgaatgccttgaaaaaggctagctggcgttctccaccaaccagcaggtcggcacgctcaatgtgctccagcgtctcctgcgacagacctgccgctccattttcaccgataccaatgacacgaatcactctactcaccgactctcgccctccccagcacgttccctttcatcgttaccagtaccatttccacgacaattccaccacctgcatggtccagacaatgctgacatccataggtacacagcttttcaaaaaagctaagcgcattcgcttcggtcatcatatccgccacctgcgtagctgtattcgcctctgccactgccgctgcaagcgactcatccacccccgcttcacgcgcgacctcagccaaaaaaccaaaatccaccggagcgctcttggagtgaaccatcatgacaccttgagctaccttcgacagcttgccaggcataccgacgagaataatttttttcattcccaatcgtttgccatgcttgactgcaaagccgacaaagtcgcccatctgaataaaggcttcttccgtcagctgatcatacatttgcatggcatatttttcactgctgccgcctgtggtcaggactatttcctggcagttcatcgcttgcgcaaccgatatggcctgcacgacactggctttataagctgacgtggaaaacggaacgaccacaccacgcgtgcctagtatggaaataccgccaagaatgccaagacgcccgttcagcgttttcttggcgatttcttccccgtccggtacgctgatgacgacacggacacctttggccgatccgtgctcttcaagcacgcctgtcacagcctccataatcatacgtcgcggcaccggattaatcgccgcttccccgacaggcacaggcagaccgggcttcgttacccgccctacgccgatgccgccatccagctcaatacccggctcctcgcgccagctaacagaggcgataattttcgcctgatgcgtggcatctgggtcatcgccaccgtctttgatcgtcgtgcaggaagcttcgtccgcgtccaacacaggctcgatcagctcaaacgcatgatcgaatcccgcgggcagcgatatcactgcttccttcggtggaatgcccgtgatgagcagttgtaccgctcctttggccactgcagccgcacaagctccagtcgtaaagcctgaccgcattggcttgtccggcgcgggagcttcaccgcttttcatccgtttgggcctgttggcggacgccgcttccttttccatgccaattcctccttaacctcttctgctgatcatgttctaattcatttcatgatacagcaaacggacaaccgcatctagcggacagccattaaggagatcgcattcaatgctgctacgacaattgtactgccgcccttgcgtccaatattcgtaatgaacggaatatccagcttgcgcagctcgtccttggattctgctgccgatacgaaaccgacgggcatgccaatcaccagtccgggcttagccgctccttcttttaccagacggatcaactccagcaacgctgtcggcgcattaccaatggcataaatgccaccttcgcccgcctgaatcgctttgcgcatcgaaataatggcgcgtgtcgtattcagtcttttcgcttcttccatgacgtcagggtcagatatgtacacatgcacatccccgccaaattgacggatacgatccttgctcagccccgcttgaatcatctgcacatccgccactacctgctgtcctgcgcgaatagctgcaatcccggcttcaatcgcctttggatgaaacaccatgctgcggcccagctcaaaatcagcagatgcatgaatgacacgctgtacaacgggatattgctctgctgtaaaaggatgctctcccaattcttctgtgatcatctcgaagcttttgccctcaatttcctgcggctgcaccgttagcggtttgaattctgttttaaaatccatcgtatcgaccactcccttatggaaaattagaaaatagtttaggaaaatgacaattcattgctacaaaatcatagatacctctaaaaaacacctgttttaagatgactatattttaaatacattccagaagtcgttcctgatggactggactcgcaggggtaaggctcaactcaaattgaagttttctcttttgctgtgcgcagtgcgtcgatgactccgccgaaatgatcaaatactgtgccaaattccacttccggcctggaaatcaaaagtacgtgaatccccagctccaatgcagattgaaccttttcatccactgctcccgtgcgtccgctttccttggtgaccatcacggtcgtgccatagtgcttatacaatgcttcgttcatctcgcgggaaaagggtccctgcatggcaataatattcttttgctccatgcccagttcgccgcatttctccatattgtccaagcgcggcagcatgcgtgcaaccagacgaatctccgggtctccgagtaaatgcttggtgaacgtgccgagcgtcttactgcctgtcgtaagcattacagagcctttgagttgcttcgcttctaatgcggcctcttcataggaagacacgatgtggagcaatggatgattgtcatacatcagtcccgcccgctcgtagcgaatataaggaactccggactcgcgagcagctgtcatcgcattcgcatgtgcttcttctgcaaaaggatgactggcatcaacaaccgcctgtattccctgctcccgaatcattgcactcatttcatcggctgtcattcggcctgtacgtacgtccagtcctgcttcggacaagctggctgccgcgctttcggttacaaccgaggtcaatacgttgaagccattgtcacggatttgcagcgccaattcccgagcatcgctcgttccacatagcatgaatatcatgagcccttcacctgcccgcttccattcactacagatggcgtatgcgaatgctcgggatggtgatcatggtcatcatggctgtgagcatggacatgctcatgagtgtgatcgtggctgtgtgtatggtgatcatgatgatcgtgctcatgtgcatgatgatggtgatgatgctcatgatcgtgatggtggtcatggtcgtggtgatgatggtggtgctcctgcgcctccagacggaactggcagttatcacaattggccgtaaccttgccgaacaagccttccttagctcgctccagcaccagttcaatcaattgaggatggaaaccaaaatatcctcccatttccacttgtaatgtagggtgagcctcggcaaattcctgggtcatttctccgatgcgcttaatcagcacacccgtgaacagaaaatagggaagcacgataatctttttggcccccagtcgtacacaacgctccaatccatcgggaaaagaaggctgcgtcacaccgataaagctgctctctacccacgtataagaaagctgttcccatagcatacgggtgattttgaaaaagtcactgttcgcatctggatcgctacttccgcgtcctaacacaagtaccgccgtttcttcgtcggatacctcggcaaatgcctctacagcgctattcattcccgctggaactgcaaccggacgggcctctttcaagcggctttgcagaatgctgacgattttctcgtgaacgccaatcgggcgtccatatacaaattccacctgcggatattttgcttttgcccgatcaatagccatcggaatatcaattttggcatgtaccgctgcgaacaagataatcggaatgagaacgacacgcgtcgcacctttctccacacatgtttgcatcccatcagcaatgctgggacgtgtcaactccaagaaacaggtttccacgcacatatccggtacccggtctgccactgcctgtgcaaattccagcagttcctggttcccctccgggtcccgacttccatgtccaactaacaatattgcatccactgctgttttttcctcctctttaatagggatagcctgcatgacgccctattttatatatatgcttgtatccagttcatcaggccttcagtccattaatcaccacaaaccgcattcacttctaccgttgctggtgcatcttcatgccggaaacccgcaacgacacctacacgtttaaaaaatttatgaaaacgctcattcggatgccctttttccttatattcagcgatgacgttctccacaatgtcagtaatttgatcacccggaatcccttccgctacgggctgagcggcatgagcattgcgcccgaattttttgccaccaaggaagaggtcgtatcctcccttgcgatagacgatgccaatatcctccagcaccgctccatagcaggccataccgcatccgttcaaagcaatgctcgtttccttgggtgcctgtaatccgccaagtacaacctgtagatgttcagccacaggcacagcgtcatccttctccatattgcagaagtcgcacgccttcaccttaaacacatcgccgatcggcatgacaatgaatcgttcatcccgcagtcgtccgaccagttcctcggggtctgcgcacggcacacgcagcacgatctgatgatccggcgtgtactccagctcgccgtcatcacccgctacctcggcgagcattgccatctggcgagcggtgaacttcttgtttcccacacccggggaaacgcccacctcaaacagcgcaggcttgccaaagccgcctgtcgccatcccggccgtagcccccgctccggccaccgctgacgttcttgcggtgctctcggcggtaggcgcttgcccgctccagcgagcgttggctgcgtcaggcagcttgccgccaacagcgaggcggcttagtgcctctgccgccagcgatgccggggttgctgcgccggtttgcacagcggtcgttgcctgcacggcagccatcgcttgcgggcgtgcctgcgtcgcaatcgcagcgccgctcgcggagggaccagcgagcgtagtcggggctgcacccgcctgcggtgcggcctcttgcgcgcccagcgaccacggctctgcttccgtacggagacgctgatgcggcttgagcgcttgctcggtcgcatccagcgtgtatttgcgctgatatccgcgcggagtcacgatcaagccgtcatacaccgttgtcgaggaattgccgatgattacagttgtcagcatcccgatgtcatgattcagcatatcttccagcgtcgtgacaataacttgctgacgttcacgataagcacttttcaccaacccaactggagtttgcggatcgcggtaacgcagcaaaatggactgcgtctccacaatctggcgggtacgtcggccactgcgcggattatataatgcaatcacaaaatcggccgaagccgctgcttctacgcgcttcacaatcgtttcccagggggtcagatgatcactcagactgatcgtgcaagcatcatgcatcactggcgcccccaacagtgaagcacaggactgaatagccgagatccctggcacgacttctacctcaaccccgtcctcgcgtcgccagcctttttgcatcagcacttcgtacaccagccctgccataccatagactcctgcatctccactggaaatgacagctaccttcttgcccatctctgcttggcgaaccgcctcctgcgcacggctcacttcctctgtcatccctgtgcgtacaatctcctgtccgttcaacaacggacggatcaaatcaacgtaggtattgtagccgataatgacctcactttcggccagcgcatccagcgcccgttttgtgatatgttccatatctcctggtccaaatccaatcaccagcaattttcctaatgggctcatcgtgctcctcctattcacccttttcagggtagctatcctatctatttcaatgatttatggacatcctgtaactcaaaaaaacccatcctacccggatggggtttctatgtacgtatctctcatcagacgaacaaacagcgtaagaagacactatttgtcttcctccagcctgccgttgttttccacctgtctgtttacgcttcaaacgctgctgcacgttcatatccacgcaaacctctaaccaacatggaaaaagcaacgtgtgcctgatttcctgatttcgtacacccatcctctccgcgaaggttaacggtgcatacagatcaaggtaggtctcctggcttggcatcaacagattctttcgtcttccccgtttttcacgagtgaccatttaaaaaaatcctcttccttacagtggcgggaccgctcgggatttgcacccgattccctgttaccctttgctcaaccgcaaaggcaccttgtctgtccgctatttgattatgggtcttatcataaccttgcctcaatcagttgtgcaagcacgaaaaacgctttatttcaagttctctgctttattttttaacatatgtagcaattcgtccgggtccgcagagatacttaataacgctggatgctcagccccggtaaacccttcttgcacgctatgacgcaccatttctactaacgggtcaaaatatccattcacattcagcagcccaatcggcttgcgatgaatgccgatttgcgcccagcacaatacctcgaacagctcctcaaaggttcccaagccacccggaagggctataaacgcatcggccatctcgctcattgccgctttacgctcatgcatgctcgctacttcaataaattcggtaactccccgatgaatgatctctgcatcaaataacagggtgggcataatgccagtgacctgaccgtcacccgccagcatgccatccgcaacctgacccatcagccccctactggagccaccgtagatcagacggatatgatggcgagccatggcttctcccagcttgcctgccgcttcaacatataccgatgaatgtccaggtctggacccggcaaatacacaaatagaattcattaacgtctcagctcctgtcctaagtatcatgcatcgaaacttattcattatattagctaaatattttcgctataacaaaaatctttgtcgatgcatgtccaataaaaaaaagataaagacctcgcaggcccttatctttattttacgctttatccaaaaatataagttcatttttagcatactatatttataatttctatctcatttctatctcatttcaatgaccattcacgatcttcagaccacagccatgcaccgaatcgttatgctcaaaatatttgccaagctccaccatcatcgcgcccatgcgctcttcggttggaaacacaactcgttcaatcccctcttccacaatggactgcgcagtcaccttccctactgatacagcaatcacatcctcgcggaaagcttccagtaaatcctcgattcgattttgctctctcgcatattgggctaaaaatcggatttgcggaccactcgtgaacgtaacagcatcaacattacgatggataacatcctccagtaacgcctgcaattttgcttcctcaggtgggatatgcttataaggaagtacctggcgggtcactgccccctgctcgtccagccattttaccaaccgtggggctggatcgccatgcagttgcaacaatacttctttccccttcagatcgtatggggcgaaagctcctgtcaatccgatcaaacttccgtcctcgtctcgtactactggcgtaaagccacgctttttgagtccattgaccgtcttgtagccccgcgctgcaatgttggaagattgtagaagctccataatctgctcagccacgcccatatcctctgccatatcgaacagggcatccagccccatacctgtcgtgaagatgtaccagtccggagggttcttcacccacgatacaacagcgttgcgcagctcgatatcatccagaaaaaccgtgccctgagccggacgttgtactggctcaccccccatcttcacaactagcagcgccatttcttctgctttacggggacccgcaagagcgactctcttacctgccatgcgttgtgccattctgttgcctcccttgtagaagtcgtatttctttctaccaagtatacaatcagaggggtaaaagacaaataagaattacttttccgatgaatacagtaatcttataagcggccgtgttctgttctgcctccatgctggctttctttctgactactactatcccgctccccactagatgaatgctcaccgtcgtctttttctttagatttgggtcggagcaacatccatagcaccaagggcataagtacaaaaaaaatgattattaccgcggtccactcccggctgaactcataaatttgcacaatgttggagaacagcataaacgaacagacatagcctaacaaacctacgggccaaaccatcaggctcccccaggcttgggcaaacatccgttttaccgccaaactggtaacgtacagatcaaccccaatcttcgtaagaaaggtcggtacggtcagtactgccacgaacaaatcgaaccgatccagaaagtctgttagctgcaattgacgcaccagttcatacgatggataaaatagccgtgacaagataggaacaccaataaccaactcggatagcagcaccagcatggtcagaaaagcggttccgagcaaatgcccaaaccacgcactacgcccattatagctcttcccagaaatcacaaaggggactatcataatatcggccatataacccagcatgcgccaactccccttgattactccctctacttctggatgtaagtagggtctcagcatcgaaaaatccatattacgcccaaaaaaaagaggcatagtcaacagcgtcacaatcaacagcggtataaaattctcggtcatattcacgatggtgcttattccacctttagccataaataccagagtcaacagcacaataagagaagtgaccacaatcggagtcagcggcaaaagcaccacctccaccagatccgtaataatcctcaaatcccgtgcaaagatgatcaggaataaaataaggtagattgcaagcagcacacggcccagcacagggtgagagctcaccatcgcctgcatcagatcctgatcagggaaccggcgtttaagtttcaacatcgcccagatcggcaagcatagcacgatagccgcaattatacaggtccagtaagcatgctgattcgcgtgatccgctgcctgcgccggagcatgtataagggtaataccgacctccatcaatacaccaagcagcacaatttgtctggttgtgaactgtttcatgcaggtacatcctccttttgcccgcaggcatccattacacgatttacaacgtaggggggagccacaagtcaataaaacgggtcagccatgtagccacataaacggtgctcttcgttgatgttccgtaaatccagataccaatgctaataacatacagtacgcgggagacccagcgattgatggctggtgcattgtgaatatttttacggtccatcagatacatgaagagcataaccagcaccaaaggtaacagaaatactttattcattctggatttgctcctttttgaccccgaatggtttggtgaccgcaccgatattctcaatatgcacgaccggatttatggtgaccttcaccttgggatacagttgttcccattgaggtttgatccgtttccattcatccggttgactcgtaataatagcccggcccaaaccaagtacgtctgaacgatacttttgctgaatcacctgaacagcctctcccagctccctcttaatttcctcggctgtctgctgctccagccacttcaaatttttctcgttggaaatatcgaaactcgtctcattttccttcacattcccattgcagttcatatgaatggtcattcgaatctcatccccttggatatggggcttaatttggactttattttcgatgaggtgtacagatatgtaacctctacctttgggagggggaataaatatttctgtctccttggcctgctccatacccaaaagcagaaaccgactgaggtggttatcaataattcctgttaacctgtctttgcgaaacacagccagtccatcgacctgaatattcgtcttctgttctttaaggttagggggcccattcttcaccagagacattactggtaccaccgggtcaacgccttccagcaggacggaattcatcaacagcttaacggaacgaggttttttcatataggaaatattgagctcacgcaccatttccgctggatattgctcaatcggtgcgtctgcctgaagcatttccatcgctgaccccttcgtaataacaaccagggacgacagacggttctgcggaacacgtgccagtacatccatcattttgctaatcccttctcgtgcgagcgcctcgccgaacagcagcacccgccgatgggagtaattgagtgttcgcgaaactccgcgctgttcctcggtacttgctcctcgaaagcttgggcctattttggactccagatagtaggatttcgtaccactggtacctccccctcctcctgtactgcccgaagatccgagttgtccgggtagagcgatttgcatcgttacccggtactgatcgccttccttgtccagcccggtacccatcacgaaagcaacatcattcacttcacggcgatcccagcatcctcccaagagaacagagcatagcagcagacaacagagcacagcgactttacgtatttgttgtgtattcgatttgggcttcatcaccatccctcctcgcttttaggcgttccattcatcttttccttcgctcgtttgttgttgtctttaccaatccaggaaggacgtttggtcattttccaccaaggcgcgcggacgacgatatccttttgatccatatggttgtatgggctatatccactcatataagggacaccaaacgaggttagcttggttagatgcgtagcaatcagcgttgtcgcaataatgatcccaaacaatccgaataaacccgccatcagcatgatgggaaatcgcagcagacgaaccgtgatggcaaagttaaaacgcggtatagtaaacgacgcaatacctgtgagcgacacaacaatgactatgggcgccgatacgattcctgcctgtactgcggcctgcccaatgacgagcgcaccaagaatactgacggcctgaccgactgttttggggagacgaatccctgcttcccgtaatgcctcaaaggaaatctccatcatcaatgcttccaccagtgctggaaaagggatggattcgcgagccgccgcaatactcaggatgagcgtcgtcggcagcatatcatgatgataggtcgtcaccgctacatataatgcgggtagaaagagagccattacgagaaaaagaaaacgaatccagcgcaccatattactgatgaaaaagcgctcgtaataatcctcgctcgcttgcatcatctgccacatggtgactggcccaatcagagcaaaaggcgttccgtccacaaaaatggcaaaacgtccttccagtaactgcgcagtgacggtatccggacgttcagtgtattccatttgcggaaatggtgaaaacggatgatcctcaatcagttcctcaatataccccgtctccagaacaccatcaattttaatatcgctgagccgttttttcacatcctccaccagcttcgaatctatgatcccttcaatataagtaaggacgacgctcgtttgagtttctgttccgatggtcatgctgtacatcttgagcttggaggtcttcagcttgaagcgtaacagtgccgtattaacgcgaagagtctcagtgaagccctcacgcggacctcgaataaccgcttctgtctgtggttcctctacgccacgacgaacgccccccttggcgctaaaaatatacgcacgaggcgtgccatctacgaataaggcggcattgccgtccagtatcgctgccgataccatcttccattcttccatcgttttggtctgggacatggagatacgagtttcatccagcggctccaatttgccgttcacttcagggtccttgagcatcatgcccagaatgacaggccgcaggatatgatcctgcaaatcctccgattttaccgtaccttcaaaataagccaacacccctttgcgttcaggggaaatcatgagctctcgatagacgatatcagagcaatccttgaaaatatcacgcaaagcaatcaaattgtcttccacactgctacgtagcggctgttccagccacgaagactcaggcagtcctttaggcacattggaatttcgtgtcttgcggtctgcggctggaatcgctctccggctccacggtggcttcggcaacttgggaaagcgccctttcttcatcgttattccccctttacaaatgagccgaacagataatatgacatataggatgtaccagcctgcaaaggattatgtatccaatgaactcaacatattgaacggataacaaaaagaccctgcaatgatgcagagccttcgaaaatccatcatatatccgaaaatttatgataaaggaatgattaatcgccccaatactcctcgggatggtattcaatcttagaactagcttcgaacgtaagcttatctgtctgatcatgatattccacgctttccggggtgacgtaataccaatgcttcaccagggggccatcatctaccggggttacaaaacgaaatacgttcaactccccgctataacgcacaatcgcctccgccgtctcacgcggcaactcttgaagcgtaaagcgaaacacaccgtccaccgattcaaaatgacaatcgaaactctgcttgcggctgtcagcaaagctacgtcccgtgacggcatgcttgatcagccatgtttcctgctgcgccattgtgcgcacctccttttagggcaaatcaatcaacatataaaaaacagaatcttctgctttcagtgagagcttcggctcctgctcaatacgagcggaatcgcgtccttgcagaatatgttcaccgttcacacgcagcgagccttcaatgacgaataggaacacgcgccgaccctcggcctgtgtgaattctacttgttctccaggctgaagcttgcttaaataaatcgttaaatcctggttgattgcagctatttcaccctccgtgcttggtacgcgctttccggcaacgacaggcagaagctgaccgtgaagacgctcaggattgaatgctgtagcctcatatgacggtttcagtcctctcgtatgcgggctaaaccacaattgcagcagactgacatcctccgtttgtgaagcgttgtgctccgtatgaatgatgccgtgccccgctgacattcgctgaatgcctccaaaacgggttaccgctacatgtccatggttgtcttcatgacgcagttccccatacagcacaatcgaaacaatctccatatcactgtgcggatgcgccccaaatccccgtcccggtgcgatgacatcgtcattacagacacgcatagggccaaacgctgtattgttctcatcctgatactccgcgaatgaaaagctgtgacttccccgcaaccagcccttatcgaagctgaatcgggaagccgccggatatattgtaaacataatagccctccttcaggaagaaaaatgagatcaaatccctctcattgtaaccgagcccaagcgataaagctacgcctctgtctgagtgataatctcatctataaaagactgcaaagtactggtaacaaaggcttccttacgccggataaacaccgttgttacttcattgtacggctcaggcatcgcatgaccgcatacaaggccttgagacaccagcccgctgatcgacgattcgggaaaaacagtcattccaataccggccgccacactgccgataattgtctcaaatgtcccaaactccataatctgcttgggaataatcccctccatcttgagccaagtttccagccgtccccggtagccgcaaccttttttatacagcaggagtggacggattgtaagatcctcaacagaaaagtcatctccttgggatacgaggaccagtttttcctgaaacacatcaaactgttcaatcagcggatgcttgaccggcccggtcacaaaagctccatccagccgcatttctgcaacctcctgcaccagagactctgtaaccccggccttgagggacaactcgacatccgggtacttgctatagtaagcatgtaaaatggccgggagggcaatgacagtctccacaatgccaatctccagtacccccgaaggtgcagaggtattctgaaacgcatgtttcatttcctcaaattgcgataaaatgcttttcgtatattgcagcagacgcttgccctctgcattgaggatcattccccgcttatgtctattaaataaaggcgtttgcagttccttttcgagcagcttgattctggccgttacattggactggacatagctaagctcggctgcagccttgctgacactgccatgcgcagccaccgtctggaaaatgtttaaatcgttcagatccactactgctcctccttattgtgaagggcaaggggccatcaaaattgacgcgccttgtcacttattatcattctaaatgatcataatgtttattttcaatcattttaccaacagcttcctatcctttatgatgtgtccataagatatgtccgctgagaccggcaaggaggagcttttgtacaccatgaacagacaaatcatgaccggatctttattatgcctaatcgccagtatgtcctggggggcgatgtttccggtttcgcacattgcattacaacatatcaatccactgtacttttcatttttgcgctatttatcggttacactcattttagtcgtactattgtggctcaaagagggacgaacagcatttcgctttgagggcaagggcaagacgttgttattctttgggaccatgggattcaccatttataatatggccgttttccagggacagcacgcgatgggggcagcaggtactctcgtagcttctataatggaagtgctaatgccgatgatttccattgcgatggtgtggatcatgacccgtaaaatgcctccgaaatatacattaatcagcatggtgattgcgctggctggggctttacttgtgatcacgaacggaaaatggacctttttcacacttgccggacaacatttactgccgctgctgcttattttcgtaggcgtcgtcggatgggtcgtatattccatgggaggcagccattttgcaggatggtctactcttcggtattcaaccctaacctgcctgcttggaactctcgtctccttcgtagtcgtcacatttgcctctgctttcaactggattgtggtgccggattggcaggctgtgtggtcagttaaatacgaaatgagctttatgatcctgcttccagggctagctgccctgcttagctggaatgccggaatccgaaagctgtctccactgaacggaattctatttattaactttgtaccaattaccacgctggtactcatgtacttccaaggttatgccattagccgttttgaactatatgggacagtgctagtcattttcgcactgattctgaacaatatgtttcagagaagttcgctgcgtccttccgacagctcacgggatgtccgtttccgtctggatcgccgcaagtccttccaacgttaacttctaaccctgcaaaccagaaattatgctaaaacattaaaaaaagcgcctggatacagagtataatctcctgtatccgggcgctttttatcattttaggattttccttcaacctgaaaacgtccaaccagttcgcgcaattcctctgccatttggctcaggtccgctgtagatgaagcaatctcctcgatagaagcgagctgttgctcagctgccgctgagatcgactcggtgttgctcgctgcctcgtccgaaatgtgggcaatatcgctcataatatctacgacgcctacagtccctcgtgccatttcctgagtcactccggtaatgtcattgatatgtaccatagctcgttccacggcctggctgatttccgcaaaggattgctcagacgtggttaccgaatcaatgccttccgtcacccgtgtccgcgcttgatgcatagcacccagagcatgattcatatccacctgcatcgcttcaatacgctccgagatcaaggtagccgagttcgctgattcctcagctagcttacgtacctccgtagcgaccacggcaaatcccttaccatgatccccagcgcgtgcagcctcaatggacgcattcagagctaacagattcgtctgtttggcaataccggatataacgctgataatattcacgatttcaccggagcgctcattgagggagtccatggcctgtccgagatcattaacggtctcatcgatgtcatgcatcttctggacagcctgcgtagcagccttgctgccctcctgagccgactcagcgttcatcttcacatgttcagatacgcccaccatacgctcggatacattcgctgcttgctgagcaagctcctccatatttacggagccgtgcttgacgctctccacctgacgttcgctgcccacagctacttcctggatagcaatggtgacatgctcaatcgcttgagttgtctgatctgcacctgcagccagctcctccgctgaagaacttacccgatctgtcgtttcgtgtacgcttcgaatcatcgtgcgcaaactatccaccatggtttgaaagtgagtagacaattcgcccacctcatccgtttttccagtttccaaatcgcccgtcaaatctccttcactgattcgttctgctgatttttgcagcttacgaatcggtaccaaaacagaacgggtaatcaggaaaatcgcgataagagcaatcaccagtgaggcagccaacacgaaaatggttacataacgcatggcagcggtggcatcgctaatctcagattgatagaaggtacctgcaattttccagccggtatccggattcgttacaaaggtcaaatatttctcacgaccttcatgcatatagttgaagttcccgctcggcgcagtatacaacgtatcaagcgaactctcctgaggagatgagcccgctttagccgtaggatgaactacgaatttcttcgtatgatctaaaatgatgatgtacccctcctggcccactttgatggaggccagtttacgtacactttccagattcagagagatcccaataaccccggacttgtcggaaagcgtctgagatactacgactacaggaatacccgatgaattgatgatcacaggcgtaattgcaaccttaccgggctgcttcatcgcttcgatgtaccatggacgtttgcgagggtcaaatgtcccttcatcctccttgggcaccccccggatcatcagcccctccggtgtaccaacaaaaatatccgtcgcatcttcgtgcaaacccttgtattggatcagcttgggctgaatcaaagggctgtttcgaccatttatcatcgagccgtccagacgctccgccaaataactcgcatctttaattttactggcgattgcgtattcaataatcgagttagctgtcgctaccccctgattcgcactcccgtgaagctgtttctccatagcattatatgatgatttataggtcgcaatggaaatacttaagctcggaatcagcaaaacaagtaaaaagcctaaacttagcttgttcctgagtgtccatatagtttttctctttcgcgttgttcccatgttttttcccctttgctcataaaacgatatatttgaattacattccgtgttagttatatcggttgaaagtagcaaatgatttacaatgaaatttcacaaaggggaaaaacaaaaaacgcgccctataagactaaggacgcggttatatgaacatttagacctgtacgttactgttttcagcttttttgcggccaaataactgatccactgccagaaaacgtccaccgacaagcgcttgctgaaggctggtgaacagaatcagcagatcaaattcaatcgagccaaaaggctgtccttttttagcggttagcaatacaccaatcataacaatggtcaatgccgctccagccagtcgtgttccgatacccagaaccagtgcaattcctccaaccagctcaaccgtagcgaccacaggggccatccaaccagggagtccaatactttggaagaagccggaggttccgtctaatccctgaaacttttgtgcaccgtgaacgataaaaataacccctgtaaagattcgtaccaacaataatccaatattcataagcgtttgattcatttgctcatctccttttaaattgtataaaaatcctgcaataaactacatagtgtagtgtattgcacattgagaatcgggagcgcgaaaagcgccacccgtaagaaacatcttgtccaactagattagcgccagtgcgaacataagtgtcagcatcactagcacatagctggaaaacataatcgaacgccaaggcatttgaatgaccggttcttgctgagggtctaaaatacgtgagatacgataattaatggacgtttctgcaaacgaggaacaagcggcggagtttaccaggcgagtattggcaggcgtcatactcaaaagcttgagcaatgcgctcccaatcccaacgggtgaaccagctcgatggatcgcttcgttatcagccaaaatttcacgggccgtcttataatgattggtaatgtggcgcagcaccggcaagtaaaacagctgtttagcacacacttgcagcaaccaggtcttcaacggatcataatgtttcatatgataggcttcgtggtatatgacagcctcttcctcgtgcttgtccagtacggacaatagtgcagaggacaatacaatgcgtggcttccataatcccatggtaaaggcggctggcttggcataatcaatgacccatatccgatcggtcccgagttcacgatatcgctcacccagtgcttcggtcagcgcaagatctcgcattcggtgcagtctgcgaaaagctgccctggtagccatacactgtctgactgcttctcctccagcaatagcaaaggtaacgaaaaccagcccgctgagcgcatctaccatgtagccaattccgtagtgctgcaacaaacttctgcaaatttgaaacacgttataattcaatttccagccgaaaacatgctgcccggcgtacatacccatctgtataagggcgaaacccgaaatcaaggcgcctgctgtaaacagtaatttagaacgtgttttccacatcgctacatatcctttttccattgtttaattttttgttccagacgttcgatcaacttcggatcggccacctccagagcatcaatcatatgattgacagcaagcgggccaaattcatccaccaattcgtgactgagtcccttggattgctcatccatgaactcttccctacttaaaactggacgatataaagacgttctcccacgtatactcttactcagtattcccttgtccactaaacggttcatcacggtcattaccgtattgaagttaaagtcccgatccccctccaacgcggtctgcacttctttgatactccgatccgaagtggaccataaaatatccattatcttggcttccagaggcccgaaaaatcggttaagcccggtttcgccagctttaaaattcagtcgtttcataagaagcacctcacactaccgattgtagtgtatatatccggctaaagtcaaccgtcacacctaatgtcagtttcttcatggaatcatatacaaaccgccgaatgtctccatccggcggaaattcatcggtattcataactttcaggtcaatctgccaatctgtatcctacacctcttacggttgcaatatattcaggttccgcaggtcgatcatctagcttcttgcgcaaacttttgacatgcacatctacaacgttactgccgcctacaaaatccgtctcccagatatcgtgcatcatttgctcgcgagagatcactttgccttgagcatcaatcagcttgagcagcaaatcgtattctgttttagtcagattcagttgactctcttctttatataccagcattttatctcggtcaatccagaggtccttgaacaccgtacgacggctggcttgcgctgcctgacgggaagcggcaggatggcgtacaatcatccgttcaatgtcatgcaccatatgattggaagccagcggccacaccagcacctcttctgaaggaagcagctcattcgcatgtacagacacccgatcctgaaccacgtacataaccggtgtgtctttcatgtgttctacctccagacgattgcggatatccagtaattcactctgtggttcggtggcggtcaaatcgtaaatcaatagatcgcttcccagatgacgctgcacttcaggctcccagcgatgaaataccatcacatcaaaacacgcatctgacaacgtacgcaccaacccgtgaactacacccggtaccgaactgattagaatgatacgacgtgtggtcggacaatacaaaggctcattggagggaacggtctgcaccgtaggtgtagagggagctgctaacatcgatgtccaactacccttcacccttctaggcatgtcagccactttgaaacgattcgttatctgattcgcttgctttgacattccttacacactcctccgaatacgacatgggcatgggcaatattataccccgtttcatgcgcaaccgtgtcaatccaatcatgtgggacttcactcatcacttcatctacccggccgcatacctgacaaataatatgctgatgatcgtccatccgtccgtcataacgactagcagcttcccccagcttcaattcacggattaattccttatccgtcaaataacgcagtgaattatataccgttccataggccagattatatccgcgctccatcaaccgattcataacatcggccgcagtaggatgatcgtgggcttcacgaaccacatcatataccgcttggcgctgcgaagttaaatttaaagttctcataccgcatctcccttaaccaacgcagattatattaattacaaacttacaatcataataaaaatcaatttagaataagtataaatcttaatttatttcaagtcaatgggatcggataaattgaacagctttgcaacacaatgtatacatggtacatctcagctcatacacataggaggaatattttatgaaaatactgtggatattcacactctttatgatgcttatgctcggcaccaatctgctagtgaactggctattcagtactcataccccgtgggaaccgatggcattggcttttagtactatgcgtccatccgaatatatcgtcttggcaggaatgctgcttgtattctttgtgaccgtggcaaaaaaacaaattaaatacggatttcacttcctcttttcacgatggtcccgttttctgaaattttccgcttcttcctcgggttctaactctgcttcgatgcaaaagagcggccaaaaagagcagcaagggaaagatgtaaacaaataacggatgaatataaataaacgataatcgtccaagagaaagatgctcaatcatgctgggtgtttgtacctgtgaccacagtaagacaatgatcccgacaaaaagtagtgttttccggtaggggaggttaaaaatatcggagatcccgagcaccgcagcatagaagaacagggcaattttaaaaaaatcgcccacaatcatcgtcatcagaacaatcacatccagacgctgtaaatattctgaaaactgtacattcccaaaggtgctgagtaaaggaaagatggagcgctgtgcaatgtcagtgcccataacagccacatttagtattgcggcttcagctaaaacaaaaccacctacgataatgcccacatagcctgttctggccatctgcgacgttttttccaaatggggcacgaacatcataaaacaaatcatttctgcgtatggaaatgccaaatgttcccgaatggctgaatgaagcacagatttaaagccatgctccatcaccggcgtcagctcatgcagatgaatgctgtccgataaaatcaacagtacattccccacaaaaatgacagtcaccactgcaataagcatgatttgtcctgttcgagctaatacttcaaatcctaaccaaaggacatacattacgcacaaaaccataaggaaggcaacgaccaggttgggcgtttgctccagtacagaaatacgaatcagctctgtctcatcgcgcaaattgccgcctgttagaaataaaaaaaataaaatatataatactcccatgactgttccacatgtatgaccgaccaattcactagcataggttgtaagaggcttaccagggaacgtttcagctgtgtagcagtacattcggaacaataccatccccagaatcatagcaacgagttgaataatccacgtgtcccgctccatataactatccatattaatggtgactgcgttgcctgtaagaaaatgaaacataagaatgagcaattgccccgtgctgatgtatgttttgttttcaagacgatgactcacgaggcatactcctttctttttttgttgcgaaactttttcagccatgacaccataagcaacaagaaaggaaggaacacagcaaataccggaaacacccatttcagtacaaactcgcctgttgcaagatgttcttgatagccctgagccatcaacacgcaagaaacaagcatgataagcccaaacggcagaatcagtttatggtatgaaacacgtaatacatcttcagcagccttaaccgctgcataatagaaaataaaaattttgaaaaaatcaaaaataatgacagtcatgaccccaattacatccactctatcgacgaaatctgatatttccaccttgctgatcatagaaagcagcgggtaagtggcccgtttgaatacgtcctccccaagcacaaccacatttgacagtgtaacaaaagacaggattgcgcctcccaacaatacagcggtgaccccaaccccgttggcacggtagcctttctttaatgtgggaaggatcatcgcaaacgtgaccatctcaccgtatggcaacatcaaggcttgtgaatagacaacctcccatatcggctgccagccatgctgggcaataggcaatatattgctcatatgaacaatacctgacaataaaatcaagatattcgtagcgaagcccagcagcagcagcaagaataaaagcataagtcccgtccggcctgcgacctcaattcccaaatgcatcacatacataacaagaccaatcatcaggacacagacgatagttaacggcgtatgctgtaatgtccggtcggcaatcagtattccagtatctcgaagatcgcgtgctccgccgtaaagaaaaaacacaatatataaaaaggcaagcacgctcccagcagttttgcccagaagcaccttgcagtactgtgtcatgagtaggtcgggaaagtggcggtgaaggctgccgtagcatagaaaaagtagggctcccaaacctgcggcgataagaatagcaatccacgcatccttgcccgcatctcttccgggaatagacatcatggacgtccccaactcaaacagcatcatcagggaaatcatctcttttgcgtcgatttgtatctttttcaatgccttccctcctttcccgatttcactgattggactctccctttgaataagggctagtccgtgcctgtgtatgcttcagtaccgaagtcacctgaacacgaacggtgctttctgcaaaatagcggttccactcaggtgagagttttttccactgttcaggatggcttttctccagtgcatggcctaggccgagtacatcactgcgactacgctgaacctccttaaccgttgaagtaatcactttttttgtttcttctccccactgtttctgcaagctatacataacctctggactttttaagtcaatcgagcactcggcttcctgaatcgtcccggtctgctccaaattaataacaaataccggcttcccttgctcgatcagactgtgtacatgtgttttagaatacaaggtttcgattccaatgatttcaccttttttgccgcagctcaacgcggtttcagcacttttcactttattgtttactatagataatccaatagctcggttatcgtccagccaatggacgagacgatccttacggaacacacccataccgttaatgcgaacaaccgcttcgggcaaaatagtatccacgttagccttaaggggagcctgctccaaattaccttctacttctacaccagtaaggacaggcccactacctttattggacatactccggataacatcgtctagactcactgcgtaatccccggcgtacatacgctgggacgcttctagcttacccgagatatcattagcaggaatacgaccgattgcagtcatggatgccagtacgttcttggccgtttcaccacgtgctaccagcattttcatcgttagtcggggctccgcagccctttccaaataatccaacgtatccccgataccacgtcgagccagcttttctccaaaaacgacaatcctcgcatgggccagagaaactacccgcggaatcttctgtgaagctttgcgaatcacttgaaaaaggttgcttcccttttgctgatacagcacaactggggtatttcctcgggctttagccccggcaatttcatccgctacgataatctgtagtgaaaccacataatcggattcaccatccgcatcaatgcctatagccgcgactactgcccgctggttcaactccactgaatcccagcagccagagagaagcggcatgactagtagccccaccaaactcagcatccatattctccatttaaaggttactgtgcttcgttcactctccttctccagatgcaccctgagcgcccccctcccgcattggtgaagttttatcggaaggggaaatcccgcttccatccttcattcgtgtctgatttgttgatgtaatacttttaggacgtttccgcatcatccaaaacggcattcgcaataccgcatccttttgactctccagcacaaaaggactgaaaggggccatgtagggcaccccaaaagagcgaagactgttcatatgggcgatcagcgcaatgagccccaatgtaatgccatacagccccataaatgcagccagcaccataaaaacaaaccggaacagtctcccggctaccgccatgttatatgtcggaatcgcgtagctggcaattcccgtcagcgctactacaatcgtgagtagcggggtgacaattccagcctccacagccgcttgtcccaatacaagcgcaccgataacggataccgtttgtccgcccacacggggcattcgaatacctgcttctcgcaagatttcaaaggtgatttccaaaataaacgcctccagaaatgccggaaaagggacggattctcgctgcgctagtatgctgatcagcagtggggttggtatcatttcataatgataagtggttaaggcgatgtagagagaaggccccaaaatcagaataataaagctgatataacggatgactcggatgacagttgccatgtcataacgttccgaataatcggaagaactttgaaaaaattgagcaaatacagtgggcatcaccagtacaaatggatttccatcgacgatgagtgccacccgcccctccataatgttgctgctaatcgtatccggtctttccgagttatagatcgttggaaatggtgtgagattttggtcctgtatcatctcttctaccatgccagattcaaatatggcgtcaatattgatggcttttacccgtttgcgaacttcatctacgacactagaatctgcaatatttttcatatacagtatggccacattcgtgagggacgtacttcccactttgaacatctccatcgtaagatcggagcttttaatccgccgacgtacaagagagacgttcgtgaacagggattccacaaatccatccttcggcccctggacgacagactgtgtggagggctcgttaaccgcccgcgtctctcctccgcgtgtgccgcatgcgatggtttttttacagccttccagcagaatgatcgtatctcccatcaagagttgttccatcatggaattccaatcatcgcaatcctttacttcacccagttccagcgcatgagcctgtatccgattgtaaagctcttctgcactttctacctcagcagccacctcggcagatgggcggctaagcaatgatttcatgacgagctcattcactgtatccgtcttgaccatactatctagaaatacaatggcggcagggacatccgcctttagtccgacattaaaacggcgaatcaagaagtctgggctgtttgacgtcgattccttaatttgctgtaagttggtatccaaatgagcctcgatctttaaagaacgtgaagaattttctttattcttgtccgcacccgactttttattatgtttgcgatagggatagcgaatcatgagcaaacctcatctccagtaaggcagcaatagataccgcccatttttccttattcttgtatctttggagtatgctcaatctattcccagttatgcaccaaacacgtggacgaaacgttatatgcgcacccgcgtaataaatttcaataaattcttcatttgcaagcttaatgtcagtttttttgataaaatgaagaaatatgcctctcgggagggttagcatcttgttcagtacgttttttgtaaatacctgtatccttgtcacctttttgtacataaccggccttatatcacaaagatataaaatccggctgcacaccttgaagcgtaagatacattggattggaggtgccctttttgggtgctacggcattgttatgatgtactattcaattccagtaggatttaatacgattgccgatcttcgtcatctggccatcgtagctaccgccacttacatcggcggcccagcagcgctcatggctaccctgtttgtatgtgtaggtagattactgctgtttggtatcaacactcaagccattgtaggcgctatttttatgatgctcgttggcctggggtgcgctttattgtcacatctgtcctggtcacgtttacccaagctgatgattatgaacgtttttgctttgggcattatattctgtccccttatgattaatttgaaaaatcttgatgatgttctgcacgtgtatccgctccaattcttcatttccatggtcggcggatgtcttctgtacctcattgctgaatctatcaacacatccaatgagctgttacttcgactggagcatacctcctacacagaccatctcactaatttaagcaacagaagacagcttgagttttcattggaagaggagctccctcaagctcgccaacgtcacgagcacttatctgtactggtgttggatattgatcacttcaaggaagtcaacgatacctacggacatgcggcaggagatgcagtgctgcgccagcttgggcagattttaatggaaaaatgtcgtcctaatgatgtagtcacccgcagcgggggggaagaattcaccgtgcttttgccgaattgtgcttttcgacaagcgctgcgcatagctaatcagattcttagtggagtaaatcagcacgagtttattttagcggacgatcttgttcttaaagtcacggtgtctatcggcgtgacgacctttcctggtaccggtgaagatatgtccggggcagccctgttggagcaggcagataaagcactatacgaagctaaaaatgcaggacgtaaccgggtttgctcatatgaaatataatttgaggcacgaccatttcatagaaatagccgatacaaccctctcttgagagtcgtatcggctattatcattttgaatcttcattatgattgcatttctccaccacgagtgatgtacgattggcaagcgaagccagcgtatgggacccccatacttctagcatacgttgttcgctctcggctaaaatttcggatacggctatcgccaactcctcacaaaaaggattggtttccggttcatgcatcatacccgggaaaatcggatcacatatttcaatggcgtgatatatatcggcaagtgtaatatggtcggccgagcgggtaagcacatagcctccctcacgaccttcgcgtgctgcaatcaaatctgcctgtacaagtcgcgtcagcaccctgcgcaccaaagtgacttcgcagtcaatggaccgggcaattgaaccgctggcacagagttctccgtgcttttccaaatagacaagcgcctttaccgccaccccaagccatttgggcgttgcggtgcgtagtcgtttttcactattcaaatgagatgacacccctaagctgtagaaacttcgttgaatgcattgtacgtgatgtcagaagtaagttcaagcctgaaagccggaatcctctgtagcattagcgcccaaagtaaaatgagctagccgcacttctccgctcaacaacaggtatacatcacgtgtgccagagactgaatgtaccgcttccgcgagcgtagtccatgcttgcgcccctcctgtattgcccacgttcacacgtgccacagcttcgttgtccggcgcatccaaacgcagctcaattgtggcataagcttaattaagatgataaaaagtttatttatgaaagcgttttaatatataatagctaaaaagggataccccggcaacaataccgaaaacatcctatactggttgaaagagagaccgcagcataaagacaaaaaaagttgtattttaccttcaatatacaaagctaaaaataatattttttggtataatcaggatatatcatggaaggaggaagcgctaatgaaaaataccggaatgacaaggcctctggatcaattggggcggattgtactccctaaggaaatgcggaccacaatggatatcaatatcggtgattcacttgaatttttcgtagatgaagaagggtttgtactaagaaaatacaccggtgtctcctgcaaattttgcggcgcggtggatcatttaacttattttcgcgacagctttatttgcgcagagtgcatccaggtattaaagaccgatgaaaatgtgcatgccacaagcaccgatgctatccaggctcaagaagattctaagccgacccgaaccaacacaacctggcaacccaagcaatctagagtgcaacaaggtgaaatggtaaaaaagctacgcaagctaattcaggaacacccgaacctgccacaaaaagtatatgcagaaatgctagatatttctcaaggccgggtgtcccagttgaaaaagctactctaaaccttctcaaaacaatatcccaagatcatatactatgtactcgcaagcctatcattttcatcgcaactacgatggccagatatagagtaaggtgcatatccgtggatgtgtcccttactctgtatctggcttttttatgctgcctgctcctaccaatgtgacaatagtcacatactctcaatgtatacgtatatacaatatatagatcgaaacaattggttaacacaagatatcatcaatatgttgtttttgtgaaaaatatatatattttactatatggagggttttacgatgaaggtgctggaggaacatcaattatacgacatcggcgagcgggtcattggggcacaagatctggacatgctgcgggagaatgcaaatttgaatggagaatcgttcagcggcaaaatgagcaagcttgggtccgagtatgccaaatggtatgcgcgcctgcgggtacttccgcctgaactgacgaacgcgattgaccacgggtatgtatatgttcacgatttggaccaatatgcactcggaactacaaattgtatctttatcccttttggtcgtttactgcgagacggcttcaatacaggcaacggctctgtgcgcacaccgcaaacgattatgtctgctatggcactagtcgccatcatattccagtctcagcaaaacagccaattcggaggtgtctctgccaataaaatcgattgggaccttgccccatacgttgcccggtccttccgcaagcatctgcgcaagggactccggttgttcgaggaagagatagaatccagtctgtctgaagacgaactacatatggccaatccccatttgcaagaagtctgccctcgttcctacgcattcgcacgcgaagaaacggaaacggaaacccggcaggctgctgaatcgctcattcataacctgaacaccatgagcagtcgggcggggggacagattccattcacttcactgaattacggaatgtgcacgtctgctgagggacggcttgttactcaatcgctgctggaggccactattcgcggcttgggcagcggggaaactcctatttttccacaacatattttccaatgtaaagagggaatcaaccaggcagaaggcgacatcaattatgatttgttcttacgggcggtagaatgctctagcagacggatgtatcccaattttgtgaatgtggatgccaccttcaacctgcctttttaccgtgctgatgatccagataccattatagcgacaatgggttgccgtacccgcaccatttctgaccgtttcggtagaaaccggcagagtggcaaggggaatctctccttcaataccattaatctggtgcgacttggcattgagtatggtatttgcacaggcaaacgcctgacacctgaccgtgatcgctttgatgcgagactagaagaagttatgcgcattgcggtagatggcctaattcatcgttatcaaatccagaccagccaaccggccaaagcctcggactttatgatgcgcgaaggggtatgggaaggtggagaacaactggcaccagatgataaggtgggaagtgtactaaagcacggtacgctttcgatcgggttcatcgggctggctgagtgcatgaaggcactatacgggaaacatcacggggaggatgatttcgtataccgcgaggcacagcgaatcatcacttccatgcgcgtgtattgcgatcgaatgagtgagtaccacaatttaaatattacattgttcgctacgcctgccgaaggtctgtcgggcaagttcacattgctggatcaacgtgatttcgggattattcctgaggtaaatgatcgagaatattacacgaattcttttcatattcccgtgtattacacgctcccggctgctcgtaaaatcagcttggaagctccgttccataacctatgcaacgctggtgcgatttcatacattgagctggacggtaatgcgcggaataacccggatgcgtttcttaaaattgttcagtatgcgctgtatcagaacatcggctacttctccatcaaccatccggtggatcgttgtacggaatgtggttatgaagggattatcgggacaagctgcccccaatgtggcacagatgaggagcacacacactttcagcgcttacgtcgggtaaccggatatctgacaggagattataccgttcgctttaatgccgcaaaacaggcagaagttcgagaccgggtgaaacataagtgaatttgtgtggctacattccggaatctctgaacgaaggatacggcctgcgcaccgttgtgttcattagcggttgccgtcatgcctgtcctggatgctttaatccagagtcgtggagcttccgtgcaggcgagccattcaccccccaacgacaacaggaggtcattcgtgacatcatggaaaatccgttgttggacggactgactctctgcgggggagacccgtttttctcagcagcagaatgctcgcaatttgtgcgtgacttccgcgaggcctgtcccgaccgaaccgtgtgggcttacactggctttgtctatgaagatctactcacagatccggagcgacaggaactggcgcttttgtgcgatgtgattgtggatggtcgttttgtagaacagcaaaaggacctgacccttcccttccggggcagtcgcaaccagcgtctggtagatgtaaaagccagcattcaggcagactataccgtttcattgacataaggcgatgcttacccagcaagcaagatgctatatctaatctaagacaagcccccatcatgggtaaggcttgtctttttttcatatagctaacagattccattggagtttctattgcgcatcctgtaagtttcacttatgatggtgaacaagtatacgagtgcataattattcgtcataccttaaccgcatagcttggagataggtgtctgttctattcagatcaggcttaaaagggaagccggtgcaaatccggcacggtcccgccactgtaaacggggaactttcagctgttcatatatccactggtccacagaccgggaaggaatgctgagcgtcatgatccgtaagtcaggagacctgcctattttaacaacatcgcaagtacctacggaagatagggaggtgttaagagcagtcgccgtatttttgattttttaatcacggaggcattctttcccctacttatttttaaccttggggggaagaatgccttttttggtacgtaaaaataaaacagctacccgctaggaggaaaagtacatgtccattattgaatggcctgaattgtccggcttaatcagcagtaatctgggatatccgcgtatcggcgaaaatcgggaatggaagaaagcactggaacgcttctggaacgacagcattaacgaaagcgaactgcagacggaaatgaaaaaattacggttggagcatctgagcaagcagcgcgataaggggattgatcgcattcctgtcggagacttctcctattacgatcacatactggatacatctgtgatgttcggtctagtacctgaacggttcaactatcgtcccgcaggtccgattcctctgtccgtgtacttcgggatcgctcgcggtcagaagggagcaaccgccagtgaaatgaccaaatggatgaataccaattatcactacatcgttcccgaattggcaaatgcagtcccggtattcactgaaaataaacccttacaggcttatcgtgaagcaaaacaggaactaggcattgagggtaaaccggttctcatcggcccttattcattcgttaccctttccaaaggctatgatcgtaaggagcttgcctctattataagaaccttcctgcctttatacacccgtgtcctgtctgagctagcagcagaaggtgttcagtgggtacaaatcgatgaacctgtcctgaccacctcattcccagtagaggatctggacattattcaagaagtctatgaagctttgacccaagctgcgccctccttaaatataatgctgcaaacctactttggcagcctagatcattatgagcgtctgtccgcacttccggtacaggggctgggtcttgattttgtgtatgatgatggcgaaaatcttcagcatatattgcagcatggctttcctaaaggaaaaacgctgggcgctggtgtcattgacggacgcaatatatggcgcagcgacctgaacgctgtagctgcactgctgggtcagttagcagaacagaccactgccgagcagcttatcgtacagccatcatgcagtctgctgcatgtgccagtcagcctggaggcagagcacaagctggacaaggagctggtgcaagcgctggcctttgctgatgaaaagctagaggaaatcgccatcctgacagctgcacttggcaaacacgatccatccgcactcaccaagcttggacaaagtgcagatgcggtagcccgtttcaacagttcagcggcacgcgtacagacaactgccgatctggccgacctgttggccaaagagcctctgtcacgcagcgttcctttcgccgagcgtcgtgagattcagcaaaataagctgaagttgcctccactgcctacgacgaccattggtagcttcccgcaaaccgccgagatccgcaaggcccgcctgcactatcgcaaaggagaatggtctgccgagcaatatcgaacgttcatccaacagcaaattaaggaatggattgatatccaagaggacattggcattgacgtgcttgtacatggggaatttgagcggaccgacatggttgaattttttggcgaaaagctgaacggctttgcttttacgcaaaacggatgggtgcagtcctacggctcccgctgtgtcaaaccgccgattatatacggagacgtttccttcgatcagcccatgaccgtggaagaaacggcattcgcccaatcgttaacttccaagcctgttaagggaatgcttacgggtcctgttaccattttgaactggtctttcgaacgtaatgacattccacgtagtcaagttgctttacagttggctctggcattacgggcagaggtagaggcactggaacaagcgggcatcggcatgattcaggtcgatgagcctgcaattcgtgaagggcttccgctgaaaaaagaacagcagcaagcctatctggattgggcggttcaagccttccttgtgaccacggccaccgttgagccagcgacccaaatccatacgcatatgtgctattccgaatttcagcatatgattcagtccatctccgatatggatgccgacgttatatctattgaaacctcgcgaagccacggagaactgattgtcagctttgaagatcaggtatacaacaaaggcatcggtctgggcgtgtacgatatccacagcccgcgcatccccgatgtatctgaaatgctaagcatgctccagcgtgccttgcgcgtactgccatcagatttgttctgggttaatccggattgtggtctgaaaacccgcaccaaagaggaatctgtcgccgccttgcgacaaatggtacaagcggctcaagcagcccgggctgcattggctgtatctaactaatttttttatcgtatccaatcgcgccatcattttcgccttatcctattcccctttccgacctttttgctaaaagccaggaagggggatttattctagatcatataatgtatatacgccttgaatatgctccattttcatctgcttcatatgtacgcctaagccatgttctcgatcccaggagcaactaaaattcaaatacagttcatcctttgccgatgagtcggaaatcagtatagacataagctgtattcgatccaacaattgttccggccgctccacataaggcgcatattcatctgggtcctctccccatgtactgtaagcattccggtacttttccactatgccagcataatgatggtgtatggactccaacacttgaggatgaatagttgacgaatattccatatactgctcccatgtctttttttgcaactgtgtaggttcttctatagtctgtgcctgttcttcggagtcggctcccacgataaattcgacttctacttccgagggctgcccgcaaaaatcaacatgtactacaccacgcagaacaatctcctcagatacatcccaagactcatcatcgtgttccagttccatataccagtgtttccaatccaccctttaccacctcttcataaaaagtaatctttaaccctattgaatactttacaatctatcattttaatgaatgaaattaaagcggcatcttatttgggcttccagccagatttcgaggaatttccaagtgaaactacttttttctacaacattcgctattcgataaagccttcaagaaagaaaatatacccatttcggcaaaaatattttattattaaaaatttagtaccttgcattaatcagtacatgatgttaaattatacctgactactgttctataattagtacccgtgacaaattatacacaaacacacgtttcttccccttattccgaacgacacctatgaatcattgataacatccaggaagggagcaccgctcgtgaatgtgaacatccaattcaaaaaaggggtactggaactgtgcgttctagttctaattggacgcagagaccgttatggctacgagttggctcaagccgtctcccgtcatattgaagtagctgagggagccctatatccactgcttcgccgtctggtatcagaaggatactgcacaacgtatttacaggaatcgaccgaggggcctccccgtaaatattatcggctgactgatactggaagccattatacaaaaatacttacgcgggaatggaatgattttgtccatcatgtcgcaagcctactggaggaaggaaattccgatgaatagaaaacagtttcttacagaggtggagcagcgtctttctcctctccctgcagaggtacgcaatgagctgcttagtgatttgagccagcattttgactacgggttggtcaatggaaaaagcgaaagtgagattgccaatgagctgggtaacccagaggatattgcccgagaagctttggatgatcccaatgcagcctggaacgcttctcctccgcttcgccagggaagcttcgcacgcaatctttttactttcttaggactgctgtttctcaacttgctgatctccatcccgattatggctaccctatgggtagtatgggtttcattgaccgtggtagcggtcagcttcattgcagccccccttctcgccgttactgattatgtgctgaacagcaccttttacccggccaaattctttttctctatcacgttgacgggtataggtctattgctgctgcctggagtacgttatctcttactccttatggtcaaaggcacagtacgatactggaaatggaatcagactaccctgaggggagcttactaacaacatgaataaaaagtggtttattgcagcaggtctgtgcattgtgatcggtgtagccggaatggtggcttacggtgccccatggagtcaacaagtcatgaaggaaacaactgcgattaacaaaaaatggacgttcacacgtggtcagctacagaagctgaaagtggacagttctgatgatgtctctattttgtttactcccggctctggcgaccaaggtacgatacgcattagtggagaagttcagacaaaggtagccgaccaaattcataatgcccgaattgagaacggtaagcttacgattcaatcggagccggccgcttccttgtcatttctttcgatcacccctgatttagatcaaacgattaccgtagagatgccctccggcgaaacactaactgatctacaggtagatgcgcattcagggaatgtaaaacttcaagatgcctccgtgcagaatacttccatcaccgctacttcaggcactgccgagattacaaacctccaaagtacccacctgatcgcaaatttaacatccggcaattttacagccagtcagcttgcagcagatctggagttgaagcttacttcaggcgatgttaccatccgcgattatagcggtaatggccttatttccctaacctcaggggagacaaatattacgcaacgtgccgtagccaacttggaagtaaatgctgattctggtgacgtgaagattaaacaagctcccgattttaaaggtgtttataatgtccactctgactctgggagtatagatactcccgaatctgttcccggtagtgtgaacgtgataaaggtagaaaccacctcaggggatattaatatttccaaataggagacctctagatgaatacctcagcagaggcgaagtttggttcaatgagtttaaccttgtataatgtaaccatgtgctcacatgcacaatcacgttatggagtgaaaaggaggagactggatggaacttaagaataaaacagccattattacaggagccagcaaaggaatcggtaaagcaattgccgaaactttagccaaggaaggcgttaacctgggattaatctcacgaacattgactgacctgcaaaagctgcaggattcgctggggagtacatacggtgtgaaagtggtgagtgctgttgcagatatatctgatcgcgcacaggccgctgccgctgtagcttcactggaacacgagttgggcgctgtcgatattttgatcaataatgcaggcattgctacctttggcacagtcgcagatatggaccccgaagagtgggaacgtattattcgcgtaaacctgatgggaacctattatgttacacatgctgctcttccaagcatgctggcacaaaagagcggaaacattattaatatttcctcgacggcaggagaacgaggttttgcaacaggctcggcatattgcgcatccaaatttgctttgatgggcttcacggaagcactgatgcaggaagttcgtaaatccaatattcgtgtcaccgcgctgactccaagtactgtcaatacagaactggcggcaaacgcaggattgtctattggtgatgaggatcgcatgcttcaaccgcaggatttggccgatctgacattagccgcattgaaactgcctccacgggttcaattaaaagtagccggtatttggacaaccaacccacagtaattcgacatgacatcttagattcattggctgtacaatgctccggcagacgtaattgttcgtcatgccggagctttttttttcagcatagctataccaaaacaaactgtaatataagcgctttgtacttccagcatatatacatacaattcctacaactataagcgcatttcaggaaaggggaaaaatgatgaagaatacaggaatgacacggccattagaccatttgggccgcattgtgctgcccaaggagctgcgcaattctatgaatattaatattggagatgccctcgatttttttattaccccagagggactgatgattcgcaagtatacgggggtttcttgctatttttgtggtgccgtagatcatttgagctattttagggatcatctgatatgtaaaagttgtattgaaaatctgaagagcgataatccttccagtcatttgaatgaatcccgtcctgtccagcccaagaaaagaaggagttacagaaatcagaatgatctcctgaataaactaaaacagctcatgcaggagcatcctaatgtatctcaaaaagaattagccgaaatgctcgaactatcccaaggacgcgtgtcgcagcttaaaaagctacttctttaaatcatccgacccgatctcgtatgttctaattaacaaaaaaagagcctgacggctcttggatcatcatcgttacgcaatgtcggactgctctataaccgggacccgataggccagcaaggactcgtctattacggcagaaataaacgttgcttctatttcaggcaccaatctaagcgcataattccatgcgttttcttcaatttgcagcgcaagtcgttgccgggtccctatcccgttctcttgctccaacgcatcggagaggtccactaattccgtatcggcggcgtgcccgatctcatgtgcaagcacaaccgtaaaatactcctcaactcgatcaacgctgccgaacatctgtacacactgtgtttcgataacgtccgtatacatggtaatggcgtgagcattcatagcatatttgcccccaatcagccttccaccagaaaaacgtttctccagcttgactgtcacacctatagcagcccgttccaacagctcagcgacaatgcgctctgcctgatttctttccaacttagcttcgctcctcaaaccaggatatataaagttatatttactttaaacttatgaaatcatggatgtgttcataccatatacagtacgatattatacctttttacaaaggagaataccatgtcagaagattattatataggttggggaacgcttgccctgattaatgccggattggcacaatccaaaaatcggagcgggctaaattggtttctgctctccctattaatagggccactggctaccctatttatcgttgcatgggataagctggagtcctaatccagccattaggtcattcccatcgttatccggaatgaaaagggcagccttggcgcttctgctgaagcactgtgtctgttgctgtactagtagcctgtctcgacgtatacggcttctcttgaactccgaaattcggcttcacaagccgattatcataggagctatgaaaaatatgcgttgtcgccggggatagcggggggatcagccatgtccaattgcctgtcagcgcgcgcccagccttggcttctcgttcctcaaacagctgaaattgtgccgctgcggtatggtggtcgacaatgctgactcccgcttttttaaaagaatgcagcacagcaatattcaattccaccagcgcccgatcacgccaaagcgttgtttcactcgtcgtatcgagtcccatcagcttagccacctgtggcaacctattatagcggaaggtatccgcaaaattacgggcgccgatttctgttcccatataccaaccgttaaagggagccgctgtatagatgataccgccaatctccagcgtcatgtccgcaatcataggcacggcataccaacgtagtccaagggaggctatacttgagagttctggatgctcaatgggcacctccattaccaaatgtttgggaatatcaaagagctggggaggctgcccaccggcttccacaaccagtggcaatatatcaaaaggagtcatcgccccttgccagcccatgtctttacaagcattggtaaaatccaccgagatcgggtctccgataatcccttgatcggtttcatatccagcgtaacgaatgagttgatggttccagatgcggatattcggctgccctggcttggaggcgcgaaatacagtaagcgttggcttaattttaccgccattcgttcctatgcgtatatgttccagtagctcgctgaccacctccgtcgcatctgatgcgccccgcgcatccctgactaaaagcttgtcccaaaataagcgcccgatgcaacgattgctattgcgccaagccatgagcgctccgtgttccagctcttcgtaagtatgatcatacgttcccgtagcctctatgtcgtaacgaatattaagaagccgggcttccgcttcatcgcggcttcggcccagctcctcataacatgtatatataaactgctccgcttcatgcaaaagctgttgttttacttccatatcatacaccccatcccggcagctccatgactcgagagcccgtggtcttccacgccttctcgtcattatactcctgtggcagactggaaccaacgggatgtgtatcttgttcacctgatctccatatacatggaaatatacaccaattaattatcccaaatacgcactcagcatccagatatgtttatccattgcttctctcaagccgttaagaagatcctctgtcgctttatcctgtgctgcttccgctgcttccatcccattagccagttcaacagtgatggttttaaaatcagcaacaacggacttcaccatatcgtcagctgtctgctcacccgcagactcctgaatagctgaaagttgcaaatgctccttcaaggtcgcagccggacggccaccaatagccaacaaacgttcagcaatcgtatctagattagctgttgcttcattgtaaagctcttcaaatttagcatgcagtgtgaagaatttaggtcctttcacataccagtggaaataatgcagtttcgtatacaatacagaccaggtagctacctgacgattcaatgccttgtgcaattcttgaatagcctcttgtgtaggtgcgttcgtatgatttaatgtactcatgttaaaatcccctctcgttttcattcaaaatatagttggtgtaaagcttggatactcgttaacagtagtgtctgattttcttcaaaatcccatgcgtgaatccaataaatatttattaattaatttagacttaatctaaatcctgttttaattataacactatgtcgatgtttttcaagactttattcggttttaatcatgaagattacgtgaattgattgtaaatcaaacaactctataggcaataggatatccagaccaagacttatttatcttttatacataggttacatcaataggagtaaagaagatgttaattttgtctgctaaagtatctgtattgtaggcaaagtccataacctactacctcatacctagccacgacaaaaaaagagccggcccgtaagtgaagtgcaccccttagaatagacattggaataaacccctggtttatccgatgaatttctagggggtgcattttttatgccagcgaaaaaaggacagaagtttaaagaatatacgtttgaaaccaaagtagaggccatacggcttcatatcgaagaaggttggacatatcgtaaactcatggagaagttcgggattgcagatcgacatcggttgaaagaatggatgcggaagtacaaggaactcggtgaattcggacttatggaccaacgaggacgacggaaggaatatatggaccaggacaggtacgtccaaaagttaaaacgggaaaatgatatgctaaaaaagtgtttggaaatctggatgcaggagatgaggcgcacaagtatgtaacgattgagaaggccgctaaagagtatccagttagcgaactctgtaagctgtttaaggtctctagaagtggatattacgccttcttaaaacggagaggaactgatcgggatcaggacgcgaaagctcttgtgaagaaagtgtatgagcagtataacggagtctacggctatcgccaaattcaactatgtttgcagcacgatcatggagtctggatgaaccataaaaaggtactccggctcatgcagatcttggggatccgctcacaaattcgccggaagcatcgctgcaattatgcttcttctacggaaggtcgtgtggcgaaaaatctgctaaaacaggatttcaaggcggccaaacctaaccaaaaatgggtcacagatatcacgcaatatcgtgtgggtgattgctggctatatctgtctgcgattaaagacttgttcaataacgaaattatcgcgtaccagatgagccatagaaatgataacgaactggttttacagacgtttcgacaagcctggaaacagcaaaaagacgtgactggcctcatcgttcacagcgaccagggattccagtacacgtcccatgcgtaccacgacatgctgccaaaggttggcgcccgaatcagcatgtctcgccgaggcaattgttatgataatgcctcgatggagagcttcttctcgcatctcaaaacggaagggctctacccatatgatatccgaaatatggacgaggcacaaaggagaataaaagaatatatccaattttacaaccagtgtcgaccacaacgaaagttaaataagctgcctccgaaagagtatcggaagcagcttatagcctagggtctttttttagtgtctataaaatggggtcttgaccataagagggtcggctcttttattattcttgcatctctgaaggttccacgattaaggatacaaccttgcctgcatttacatcaatcaggccgtgatcggtaatcttcaaggccgggctgaccggcaaagaatgcgtactcagtgacatgattggattgtaatgacggtagcccagcgacagcaaggctgaacgaagctccttcacatgggctgcaaccatttccagcggtccttctgttaaaatcccgcctacggttaacggcaaatgggacagcaccttgccattttcaactacgcaaaagccgccttggctggatagaaccgtattcgcagccagtatcatatcttgcttgttatgccctacgaccagcaagttatggttatcgtgcgaataggtggttgccactgccccacgtttaatcgtatctcccccgatcaaaccgtaagcacggttgccattctttccataccgttcaaacgtagcgatgagtccatgttcaccatgttcccataccagttcaccctgctccacatgtgcaggtgcaatccgttcgctcgtaaaagttgagccatccttgaccatcataatacgacattgatgtgtgccatcagctacatccatctttaccgtaaaatcctgctccgtgagcggattgagcttcacactttgataaaaatgggcggggaagcggctttttatcggtgcttgatggtattcctcgaacttatcgaataccttgagtccgtccttatagacttgctccacatcaaattgaccaagatcggacagcagtacaaagtcagctatttttcctggtgcaattgttccgcggtcatgcattcgcatccgtgcagcaggagtaaacgtagctgcataaatagcatcctcaggcttcatgcccattccgattgctttacttacaatatggttcagatgccctcgctctacgaaagagtctggcatgacatcatccgttacgaagcaaaaatgctgtgccacatcttcctgaataagatagtccatcacttcaggggtcatggacttttcttggatttcaataaacattccggcagccatccgcgccttcataccttcaatactttggtgagtatggtccgagcctattcccgcatagatcaactgatgcaggtccagatcaagcagctgcggcgtatggccttcaatgatcagctccgggtagtgctcacgaacatggcgtaagatgcgattcgtcttgctctccggatcacgaatgacatccacatagttcataatttcacccaggcagatcatttcgccggtttgcagtagcgcatcaatctcgggaataccaatctcgccccctgaggtttcgagcggcgttgccgggacagagcttggaatgccgtagaacatatcagccacgcaatctttgctggcttccatcatttcctggatgccttccaatccgaaaacattcgccatttcgtgcggttccggtacaatcgtcgttaccccattgcgaatcagcccataggaaaaggttgccggtgtcaccatggtactttcgatatgcaaatggatgtcgatcaggccgggaatcatatatttcccgtgcccttcgacaatttcagcagcctcgaaagactccagaccacgctgaccgatatacataaacttaccgccaagtatagctacattaccttcttcgaacgtcttgtagtaactgttatacaccttaacttgtaaaatcattttgtctgcacgcatgatgtatctccttcatcgaacccgctgattattggaccagcaccattttatctgccggaaaatgtagggtaacccgctgaccactcaggtaaggcgtatccatttcctgattagccgtaaagttgcctttcgccgtttctaccacatactgatagctacgccccaggtaagtacttactttaataataccgggaagctcattttcccctgtctcgttgccttctgttcgaatgaccaaatcatccgggcgaatagcgccctgacgagcacccggttgggcagtaccctgattacgcgctacgccgaacgaaagatcgcctgtattcagtcgaatacgatccccttcatcagtacgctcgtcaaagcttagaaaattattaaacccaataaaacgggcgacaaattcggtcgtcggatatttaaaaatggtcgatggagcatctaattgttcgatgttccccttattcataatcgcaacctggtcagaaatcgaaaaacattcctcctgatcatgcgatacatacacagtagtgatgcccagttcctgttgaatacggcggatttccacacgcatatttacacgcaggttagcatccaagttactcagaggttcatcaaacaacagcagatcgggttcaatcacaagcgctcgcgcaatcgcaacacgttgacgctgtccacctgacaattcaccggggaaacgtttttcgaatccccccaggctaaccgtatccagcatggtcataacgcgacgtttcacatcatcttcctttaccttacgtaaccgcagaccaaaggcaacattatcaaaaacggacaaatgcgggaagagtgcataactttggaatacaaagccgaagttccgtttattcaccggaacccgagtataatccttatcgccaaacaaaaatgttccttgtttagcttcgagaaatcctgcaatgagacgaagtgtggtcgttttgccacaaccactcggtccgagcaacgagagcaattgcccccgttcgagctgcaaatcgaaattctgcaagatcagttggttgtcataagcgaccgatacgcgatccagagtaagcagtgccataaggttgaagcctccattaccttttagtgaagtaagacaatcccatcagtcgttcaatcaagaacatcagaataccggtcaaaatcatcagcataaccgaaatcgctgcaatcgtcgggtcaaaataattttcgacgtaagtcagcatttgaatgggcagggtgctgaagcccggtcctgtcatgaagacggagatgtcgacattgttgaatgattccagaaaggcaatcaggatagccgcaataatacctgagcggatgttgggcagaaccaccttgaaaaaggtttccagccgtccagcccccaaactaagcgctgcttcctcaatcgcaaaatcaaagttagacaaactggatgcaatgactctaataatgaacggcaacataatcaccgtatgtccgatcaatagtccagcatatactggtaaatggtaaacaatgatcaaatagcgcagcagtgtaaaaccaagaacgatacccggtataagcaacggggaaaggaacaaagcattcagcgcatccttcccgcgaaacgaaaagcgactaagtgcataggcggcaggcataccgatcagcagtgccaagatgttgcctagcagagagacgacaatggacgttttgaacgtggacataaacaaatccacttcaaaaatattttcataccagcgcaaagaaaagccctgcggaggaaattttaataccgtgcccggctcgaaagaagtgaccgatatgatcaacagcggaccgagcagaaagatgaagaccagcaggctaaagaagcctagtccgtaatgtttctcccgcatatccacctaccccttcggattgagtttatgggccgccttatttaagagaccgaccacgataaatgtaataacaatcataattgttgcaataacagaagctaaaaaccagtcgtttagcgtcatcgcgttctgatacaaaaatgtagcgataacccgctgttttcctccaagtagtgctggtgtcgtatatgcagtcaggctgcctacgaaaacgagaatgcttccaatgatcaggcccggcacagacagcggaaatacgattttacgaaatgcgctgaatctggaagccccgaggctctgagcagcatgaacaagatcaccgtcgatattttcgagcacaccaatcagtgaaataatcatcagtggtaaaaacaaatgaaccagaccaataatcatcgctgccggggtgtacaaaatattcagcggttcatctacaagtcctaaaccgatgagcacgttatttaacagccccttgcgacccagaatgaccatccagctgaatgaccgcaccactggactcgtcaataagggaaagatagccagcgcaagcaaaatacctttacgacgcggggccttttgcgaaatataataagccgtcgggaagccgagtaatacgcacacgagtgtcgttacgacactgacttccagcgtagtcagcaatattttcagaaaataagggtccttgaagaaatggagatagccttctagggtgaatgagctgttctgtacgaaggtcgaaccgatcgtcaacacaatcggaatgaccatgaacaccgccagaaagagcagacctggcagcagcagccaatacaagtatgttttcttcatgggtagctccttgcggttatcgaaatgttattccttattcagcacctggatgaacagctccagaaaagctttgctgtccacctgttcgcacacattcatattggggctatgattgaggcggttctgcacatcgcccaccgtttgtccgtcacatatgcgactggaggtttccacgtcgacatacaacgacgaggtatctactaacctcgaattcaatgcgacacccacggcaagcgggtcatgaagcgcacacgcttttaccccgttgcgttcttcataacgcttggtataaacggccgtactttcagctacataattacgaattgtaggatgggacagacgagcaatatgatcggcagtcagcagagccttccgtgttacatccagtcccacctgtatcaaccggccaaatcctgcatgaaatacgatccgtgcggcttcagggtcagcatacatgttgtactccgctacaggtgtaatattgccgcacccgtgaataacaccgcccataaaaatgacctcatcgacgtgatccgtcagttcgggacacttcagcagcgccagtgccaaattggtgagcggaccggtgcaaatgagcgtcacttccccccggtgagccatcacggtatcaatgatgatatccggcgcaaaaccttcggatgcagacatcgctgggactactccactcaatgcacctccaatgccgtcttctccatggacacggtgctcgtgcagacctttacgtattaagggagcctccgccccccgataaaccggaatatccggtctatccaaaaggtcgaggattttgcatgtgttcaatgttgcttgtttaagtgagacattaccgcatactgtagtaatcgcttggatatccaactgaccacttttggcggccagtaaaatccccaacgcatcatcaatgcccgtatctacatctaatataacctttttcattactgtgctacttcccggttccagcgatctgtccatgccttgatatgatcattaacgaacttcatatccagcttggtcaacttattcactacatctgtaccgtacgtaattccttctgtatccgcaccggacagtaccacctgcgtgttcaccggagaatcaactttcgccttggcggatttttcttgaacttccttgctcagctgccagttgataaattcctcagccagctccttctggtcggagcctttcactacattaatcgtgttcatgactgcgtaagcaccttcactaggagctacaaatttcgctcctggcacagccgcctgcaaatctttgaagtacatttccatgatcggaccgcccgcaatttcttgttgactaaacatgtttacaaactcggacgttttgctataaaacttaacgatattcggactcagctctttcagttttccgaaggcttggtcttcattaaactccttactacccgctaccttggaggctgcatctaccatcatcggtccggcagtcgccgtaatattcggcaaagtcacgtttcctttgaactcagttccccacaggtcagcccaagaggtcacattctttttcaccagctccggattataggcaataccgagacgcccgaccgtataagcaggaccatactcctcacccagcggcgctttggcaatatcataaatttggttcaggttcggcaccttgctgcgatccagcttctcaaacaatccctgttggattccctgttgagcataataatcagacagataaatcagatcgacatctgtgctgccttgactgattttgttcaaccgttccgcgttatttccaatttcgactacaatgtcaacgttatgttctttttcaaaaggctcgtacacttctttgttaaaaaaatcctcggaaaagccccatgtggaaataactagtttctttttcccatcagctgaaccatcttttccatctgtctgaccgccagtagcattgctgccgcaacctgccagtaccacggatgccaaggtcacagccataaaccctttaaaccattttttcatatgaaactccccctatttttttattatgcacaccttatgacacaaaaaagaaaagtactcttgtaaaacaagaatacttttcttcgtaaacaaagaataagttgatcccgctgcgcgttataacaggttctcccctcagatagatccgaagcgaaaagccgaatatccaattttattaggattctttcagtatgatgttcgtaattgcccactgcgttgctgaatcataatcacgcagtaaagcttctatatcgagctccatatcctcaatcagcttctcgcgaagtctcttcttgtacagcatggacattcggaaatccacttccagcttcaagccgggggcttccacttccaatgccgccgagcgtggagaacgccggtgcttcgccacaaaggtaacaatgttgttctcaacggtggcccgcagcagcgtggtcccgaagccgaacagttcctttgaaacttcattgtaaatctggcacatccgcttcttgctttcgttactgtcgagcagcgtcatgaacccaccctcatcagcatattacgtacaatcaatctttcaacacgatagattatacataaatatacgataaatagcaaacgaaaatccctaatctaataacatatgatgcgaaaaagcgaacaatatgtcgaactttgtagcttttcaacatttttacactttttcgtctaacccttaagtttccgaacactgctatattccccgtaggaaaattaaagtagaatacaaagtcgttatcgtcatcactctgggagaatatttttttctactactatatatgtagtttttatttaaaagcatttaaccgtaccccgcgggagttccctagcgattgtacggtttttttatgttatgtagctgactggcagatgggaaccccttcaagaaaaagccgattgaatccacgaggacactacaagagtagctggccacagcagcataaagttagctatgatatacgccttcttaaaagcataacgatgataaaaataccaacagctccatgaaataaatactcctatcgggtagctcattatgacataggcaaaaatataactgatgagataatctccagctgttggtgcatcgaaagaaaatacgaccaccatcagcatggccggataggcaaatagcgttaagccataaacgatattcaatataagtaaaatgacaaatgcattttgatctttcatgatgttctcctaactattgcagtccgcctgtatcaccattgtgcagcccgtttgcgtctctcctcacgccgatcagcttcttccattttgcgaatataacgtttcaactgctctttatgatcgtccaattcctgtattcgtacagttgtaccttggagaaacgtctccattttacgtgttaattcagcagccgattcgcccctccagtcttgcagacgaccatatatattcctcatctgctgctcctgacgctgaagtctttgctttagctgctcgcactgctgtacagccctacgcagatcccccaggctcaaagatattctactcatctcttttgcctcccgttgtgttcttccagctgctctttttattgatccaccatcgtaaattcctggcccttgcgatctatatactctgctatctctgtaatcgattcctgataccagcgattgatccgatccagtgttgccgttgcactatgcgcaattggggtcaaagactgactttcacttgtcccgatatgagcctgaaataactggatggatgctcgggtatcgctagaaaatccatgcaggctggaacgcatctggttagccgcatgctttagctcctcaggtgttaattgaattgtgcccccatttttgttgcctacaaaatatgcaccgccattggagcgaccattctgttgtcctactcccaggatattcactcccagtgcattagcagcaaactgcccgaaggcccccatttgtccaccgtaacgttcaaccagatcgcccatgacttccttgagctctgctcgcgcggccagcatttgctcgtatgcctgcacccgtggattgccttccaccaattgaccgtccatggtgtacagcggattgctgatattgccattttcatcaaatgtaaatttttccacgctatgagtgtgctctccacctaatacagaattatagaatttggtgaatgcatcttgctgtatcataggcaatgtaatcggaacataaacaataggagtccacttggggccaagaaaaagtctttccaattcggtttttctttccaagggaattgaaacaggaatagtaaacttggctacattggcagtcttataatcactcccaatatgatacgtttcccccacatgttggttagccttagtggctcccccaccaacgctatctccgggatgggcaaaagccacattagtcttcttgaattctcctgcttttaccctcttttgaagatcttcaggcaataaatgtacaatgctcggagcagcaaaactcacagatgataaaccattcttcactgcaacatattctgcttctgcaccgcctaaagaatgacctgtcgtagatatttcggcagcgggatacttcttcttcacttcgtcgtacagtgtttgagcttttgtaaattgattatcctgatactgggcctcatactgatgaaatgaactttgtacctgtgggggggaattttttatctcttcttgattatttacataataatcgtgaagttgatttaaattttttgctcgtccgcccacgacatcgctaatatccgttcctatgtccatcgctctactccatattggtcttcctcctggttcagttcccctataccctataatcacctgattgctattctcattgtgaaaaacggtcgcatcgaatccagaaccattcgtgtcatgtaatagtttttcgtctaaatcaacaaccttccaaccgggaatatcttcatttttataagtctttggatcaatatccaataggtaagcctcatctgctatcttccagtatgttttttcgctaatatactgcaactattaccccaccttgtctaatcacctaatatattataaagttagaaaaagttgatactttcaaaaaaggagcatcaaaaaattgaaaaagaaaaaattttgggttactgctcttatcttattctgcatcctagtaggagctctctattacatgcagtacgcatcaaatgtaaaaaaagaagaagccgttagaacaggtatacctattggaaaagagtacatcaaaaaatactatagggctgatttcatatttaagagttatgactatataggtagctatgttaataatacagttcatctaatcggctatataaaaggacatgaagatcaatcgatatctatcgcttacgattttgaaaaaaaagaagtgcttagtgtaaccggaccggattggttcattgacagtcgataccctaaaaagaatgttccaccattttaaatatcaggatttgtatgcaaaaaaaaagcacacatgattcatttcagttcaagaatatatttttccaatctaaggaagtaaaatcattataatacttcctatttacttggggtatagttgaaagtaaaaataagtataaagtcgttggttactgcatttctggtcgcggttcatacctaataacgattaggactttgtaactgtatgttagaagagatttgcgtatatgaacacaatttttaaacgttgtaccgagctaatccttttattaaataaatgagctatcctactattattataaaaagcaataatgttatgagtttatagtcaggagatactaaggagaagaattcaacttgaagaagaaaaaggattggggaagcatctttatagtagtttcaatccttgtaggaatcttttattacatgcaatatacggaggatgtacaaaaagaagagtacgtccaatccggcatacctatcgggcaagactatattaggaaatactataatgctgaatttatataccaaaataacgactttattggtagttacgttaactctaccgtatatctccgtggctacataaaaggacatgaaggccagataatctcaataaattacgactataagaaaaaagaggtgctctacgtgactggaccggattggttcatcgacagtaggaatcctaataagattgttccgccattctaaaatcaagtctgtattcaaataattagtcccattacagatgattttttcctaaatatgaggaaatagtatcattataatacttcctgttactgagagatatttgcaacaaaaataagaaccaagtcattgttcactgcattctggttgtagttcacattaaattataaatagcatgttaggggaatgttgcgtaaatgaacacaatccttaaatgttgcacagttctcatcataatattaactattctaggcggttgtggtttttctaccgctcaagaggaagagatagtggagtctgctactactgtcagtatcaaatatattaaaactcactataatacggatttcgtattaaaaaattacaatattgaagaaaacagtgtctttgcaagagtacatctttacggctatataaaaggaaacgatacagacttaagctaggatatcctatgacttggactcaaaagaaatcgtcaatgttacgggacccgattggtttattgatagtaaggttatagataagaatgctccttattcctaagaaagcgtgtagcatattcactccccattctaaggagaataattcaacttgaagaagaaacaattatggctttttgcctttatattacttgtcattctggtaggagtcttctattacatgcagtacacatcaagtgcagaaaaaaaagaacttgtccaaactgtcgctcttcctcttgggaaagaatatattaaacaatactatagcgcagacttcatattgaaagattatgtaatcaatggcccttatgttcactctacggtttttctttatggttatataaagggacatgagggtcaaacagtctccatcacctatgactataagaaaaaggaaatcatagatgtgagtggacccggttggttcattgatagtcggaatcccaaaaagaattagaatattgaaccataatgcagaaaaggctccttaggagccttttccactcgttgctaaacatatttagtgctcttcactttgggtgctatgcttagttacatgaataaagggatattcgcctttgcttattttacgtttccattcttgaatcatatcctcttgggtaggcggtttctcattcacgattgctcctgtagttactttagccatattctttaccctctcacgatggattagttattgcgtctttatcttttctccagtcattttaatgttaccatccatttctaccaaactcgttttacattttaacccgatggtatctttcgcggtgacttgtattgtgttacccgcattgaatactaagtttccatcagccttaacacgtatgtcctttttactccgcagttcaattccatggtcatccagcagtcgaatcaccacttcatcgtcattccccgtgattaaaatttcatttttctcaaatataatggctttgcggtacttggtcataaagatcttcgtcgatgggtccttaataaagtcgccccctttggatcttttgcggatcgagtgagttacaatggcgtctttttctttagcggttggaaagtagatatctacaaagtcaaacagctccggcatgcagtaccatcccgtattcccttccgatgtataaaatgtagccgttggaaaagcgcaggtttccttgacgttaggcttgaccttgtccatttcataaaagaaaacattcacatggtcctgctcgattccaataaccttcgattttaacgagatgccacgaatactctcatttacaatcaaatcctgtttcattccatccgatgtggtcagcacatattcatgccacaagacactatggcgtataaacgcaacagactgcaggacgtataaggttttccctttgaatttgacctctgcgccaatatgcagcagaacatctttggcccctgtcgtttgtattttgtaatacaaaaggttgtcttccttgctggcccctggcttggtttttctggtcatcgagtagttatactgtttgagctcaccttgattgacaccatccggtaatccaaaataaaactgaggtttttcaccaatcggatcaggtattagtccccaaccaagccgagacgctatacgttttagaaatgaccagtccgtttcgtcgaattgcatcgtaaattcctgtagaagctgatcttttaagcggctcgtacaattcgctttgggatatgatttgagtacatgttcaagcaatgcctgcaccttcatcttcacattttgaaaggattgtctatgaggtatttcatccatctggcatgtataagatagagcttcgacaaccaaatgagctacattggataccatcttgattctgaactgcgtgactggccctcgaaatagcacactctggttatgatcgtcattcatataagaaacaactaacttcgcccctgcttccatatgatctgtatattcttccatttgagcacccgttaacacacctgtcaaaaagaccttcacatgctcattcattttctgtacaactttaacttttggatttttaagagataaaactgttccattatacttgatgattggatatcccatgttaccgctcctctatgtcggttagtttacgtttatccgttgtttgcttacgtattgaatgacagctttaatggtttgattatgcccctgatcgttaagagcctcatctaatgcagagagcgtggtaaaggttttatttttcttttgaaaatatatgtctgctatagggaattggtcaactctaccaggtccatgaatcccgttgtcaacatcggcaatgatgataacatccttcaatccatccttattgacatccttgaaggccactgcttctactcctccgtaacgtgcaacccactcacggttcccgtagaaatccgggaatggatacagaatatgtccttggtcatccaataggaagaaaaagaatttacgaaaaccttccgtatacccatatgtcgatacaaaccgtactttcccaaagccttcgagagtagtttgaaaagactgcgactcttcaatttcatattggtcagtattcaacttttcaccgccaactgtggaaacagactgatcctcaacggaacttaactcactccatagttcctcattttgcctaatattctctggaatttgtgcaaaacgaatttcatactccgcatggtcccctactacatgtgccataggtacactcatccccaatgaatcatttgtgaaataactaaacgattccatttctacttccgcaagcgaacctttggttacatccgcatttgttaacaattgaatcaaatcatcttttgtgaaatcaccaattaatccttgttgctctggctgaacagctgtaatcttcctgctttttataagctcaataaaaggtttctcgacctttaccaaatctctcaaccttattcttaaaacctgcttcatatccaggttcgtcgtataaaacatatgagtaggataggctgcgtccttcacataatgaatacccgtatattgaacactcaagaatcgttcactttgtcgtttgatctcataatcaatttcgacatggactccagcattggaatccgcatagttttgtaatccttctaaagcatcagtcttaagaatttggtttaaagatttctgctttgcaatatccttgagttttataatttgagggtatttaatcacgatcccattttttgaatattcctcttgaatgagttcataactttgccgttcactatgagtatttgaggccatactatattcagaatcaatacgaacttctccactttttgagaactcaatgataatgttctgttcagaatcatcactgcttattaagaaaccatcgccgtggtctaatacttcgatactcatgctatcatgttgtcgattttctaaaataagctcatccacatccttggttaattcccacgaattcgggagcttcatcttacctacatctatgcttttctgcgtccatttttgtccagacaacttccacaaatcaacaaatacggggtatggatgataaatggagacatgcccccctaaccacaactgtataccgtgctctgaatctcgaaccacaaaatctgtagttaattctgccccgccatcctcaagcatctgagcgtgtacaagctgcttcgtactccaccactgaataaatgtgtatttatctccgattgtgcctgtcagcgtcgtaggtgctctgtaatttacaactctaacgtttagccgtccactttttaactggaacgattgtgttatcacagtaagtttgttatcaaacttttctgcaaattctccgtccttcatctctacactttctggttcatttagcaacaaattaagatcctgtgtgaagtcctgtagcttgttttgtctgacatcagaattcatattctcatcgttaattatatgaagtgtctctagcaacgtatccaactttttagaataggaaatcgttttggcttcattttggagagaacacgtatgatttgttgctgcttttgaagaatcatttcccttcgtacatccgttcattactaaataggaaattagtaataacagcacgtaacaaattcgcccatgcctcaagagactcacgctggatatcacactctctacaatttatcgttcatctctatactcataatcttccacttgtctgactgcttttctaacgtaaatacaagtccttggtttgattcctcttcttctgagttactctttaccaaaaacgcccgctgattagccttattagcaatctcttttatatttagatctaatcccgtatagtccatagcggaaaaatctataatatcttcaaaattattttttagacttgctgacaaagcagtgaattcctccatttcgggcaagtgtatcaagaagcgattcataagataatgatcttccaaataattttgaataatatctttaggaaccatggggtatgcaaattttttagtttcattctcatatagtacttttgttttttctggtccggtattgtcgaatttttgataagtcattatcgtatgttgttgagtatcctgaaaacggtagtaactcacatcctcaaaaacaccatctttattaatgtcctctagcttcctgctcccttgccctgttgcttctggataactgtaattaaggttattaatttggttatggtccaaagcaaatatagagaagccttctgcctcattcacttcgctagttgaatatactacgataaatttttgttctgtttgatctaattccataatttttatgtctgtattaagatgcgcaaccataactgggtcctctaatttaccaatgatatgatagccagcatcctcacggactacaaatatgttgtcattttcctctttttctaatccaaatgcgagtacgtattccatctttccatcaaggtccaaatctgctttcaatattttctgaaggtgctcatccttgggttgaattttctttataaactgatctaatgtgtcagaatctgtagcgcgagcactacttattttatttattggagcaacaatattgctattttgatctagttcttgagcagcaggctctggttcagtcacagctttttgctctaccacttgagtgctaggtttgatgggatcaactgcctgctgcttctcattcgtagatttttccgaacatccattcaatagcaggctaaataacaatattaaagataatattctattttgttttataaagttgatttcaaaaaactcctctctcacattgttcattgcacgtttatacgttgtttgcttacgtattgaatgatattttgaagtgttcgattgtggcctgtttgattgatattcttatccaattcagatagggtagtgtacgtattgtcctttttctgaaagaaaatccccgcgatagggcgcgtttctattccgtgcgcatttacccctgtgatataatctgcaattatgacaatgtccgtacgcccgtcatgatttaaatccttaaagcttactgctttaatcctgtcaatcatcctaccgttgttaccataaaattcggggaattcgtataaaatcttattatccccatacttttggctgttaacttccaaaaaaaactttgcttgtatcagatcattcgtaccctcatctttcaatgtggatataaactttacttccccccttccattaagagtggtggtaaacgattgttctttttggatagtatatggttccagatcaggatcgggctgagcatcttcttctacataatcagcactacgttgctgctccacggatttctccatgttatattcgataaaaatattatctactttctctgttttagtatcccaataaatattcaaatgtaggccatttttggagtaaaccagacttctatttgttatgatacttggttgaccgtaaagttgtagcactttaccaagggtatcaccaatcttcaatcctcttttggttttaaacttgggattttccaagctcacggctactagataactttcaccatcaactagctcctccccttcaagttcaattttagataagactacaaaatcaatttctggatcttcatagttaggataggacagactccatcttctataggtcccattcccactaacatatcccctgttgttagcttcaaatccttcactgtaaccccacttatggataagttctttaatatccgtattcttatcaatcttatgtgatcgatatgagacttcaaagtcgtcgtcctgaagggactccggatcggcagatgcaatattctgggctttttcgactttttcacctcgatagttccctgtgctctggtctttgacgctaactgttttctcacttttataattattgatatctgtggaaccgcacgcagttactccaaaaatcattataagcattataatgaaataaccgtaacttggtttgtacacttcttttcctcatttcgaattgtgatttatctttcaccgacgatactccactcactcgtatcattttttctgctatcgttaccattttgggtaggtttaaatttaaaattaggaagcttaataccctcggatgcagcaattttctgagttacacttttatcaagactcaacaggtattgttcatagttagaagcttcattcccactaaaggtattgtatattttccgcacattctcaccccaacggttatcgctagcgtatataccacattcaactcgcttagatttcattctaagaatcggcgtgaaccaattacagtattgaaaaacgtctcctttgcctgtaataccactcaatttattgttttttactactgcttgcctaaatccctgaccataatatatatagcccaatatttttccaaatattaagctattggctttcatcaaatctttagcataattagtttcagcaccatgctcaccatcggccgccctatttgtactactagtgttaaaactgccagttccttcttgaataataattgctaacaaaaaacggggatcaatctgaatatcatatgtttcttgtatcttctttgtagcttcccacaaaccatgcaacttttcctgattccatttcattttggtgaaatttaatgagcgccttttgaatgttttttcagcttcagaactaccgttatactggaattcagcaggtatccattttccagccggagtctttacgttcgtttttgtagcttcatctttcgattcggtggtaacgggtacttctggtggtgctttagtactcgtatcaatcagacctagcttctcgcgtatagctcgtcccgccttctcggcagccagcttttccctgatatctccacttgcctccgcagtcatccaacgaacggtttctttttgcatctgctcctgtgcccacttaggcatcgtcgccatttcgcggagcttgctacgaagtccttctgccagcttttgcgctttacgcataccaacctcgtcaccattgacttgagcaatataccaatcttctttgtatttacgcatccaggtctgggcccagtcgggataatttagtttttgtttcttttgttctgctgcaagatcaaaagcctttgctttcctgtgtgcattagcaattgttaaagttttcaacataggtgttgcaccaaacgttggttctttccacttcatagcctatctccttttttaagaatgctagaaaagtcttagatcagatatacatgtatcctgatatttcgttccacgttcaaccgataaaataataagtttaataaatgaggtatatatgggctttttaaaatttttgcgtgcgttaaattcattcaataccagagaggagccgtctgagaattgcaactttagtttctgaactcgattgttttcccgataacttttttcagacttagcatatccattaataatttggatgccatttaccttgtgtaaagagccaagatctaatactattgtttctccttccccgttgcccttcacgccttcacaccatgcagtagctttattctcatccaccagatttttggcatcataagactggctaccttcacttgatagagtggatgaagccttgatttgatgcacttttatttcactttcatatttagaaaagtcattagcggtataaaaccactgcacaggtgttgccatacttccatcaattgtagtgatgggtgcagctttactttcgaagcctgtatttatattcagtttataattggacggtgagtctaacttttcaaaccataacttcgacccatcacgagacattaaaggtcgttccatccctttgcctaaaaggcgctcctctccattacttacatttaacaggtacgttttagttactgacatagaatcaagggaatagattattttatctttctgaacccattggttaactatcgccataccagaatctatatggattttcttaatgattctatattttgatacatcaaatataacaatattctgctgggtgtcagtaaaacagaactgggtactgtctggagaaaatcgtccttgattaatgtcatctacatctatagaacttccatctaatcgaatagctgttgattgatcagttaacgtgtcatatatatacgctttatcttttttctcatataaatacttagttaaatcagaagaaattactgggtggttataaggcaactcaaattcatttgctttgttaccggaatctaaatcataaatttgtattattaatcttgcttctttaaataaatctaatacgaatgcgatttgattcccatcatctgtgattctccctacacttatataggaatctcgatatttctctttatcctccttcgactgtaggagactaatcagtttctcggcatttaagaaccgttcaacttttgcaccttccaactgaactaaaaatgctgctggatcttctttgccttcttctatcgttaaagcccattctttctttctattctctttagcaagctccgttttatcagatgatttcaccacttctgaggccacatccaccgttttcgaagaaaaggcagtagggtctttggcaaaagcattacacgctactaacacgattaaaaaaataattattaatatgtttctaataatcttcactttgatctatccttccgatcaagaatagctagtccttttatatcattaggatgatttcccaatgagtcctctatcacacctactgaaataagaaatcttacatactcatctttatggactgtaatacaacctgtcgaagtcgctctacctacagtatcgttattgttgcctttgtgtatatttattccatctgcagtacaatcctttttttgacttcccttggtagcaggaactattccaccatttcgaatacgcaaagcaggataagtatgccgatgtcttccccctagaaattcataaactccatctttaacagttttatccttgctctcgtaatctggaagcgtactagcatttttacttgtgtacttaatctcgccgtctatcaccacaatagccatcgctccataccgaccttctggatgatcgagttgtttgtgactataagaaccgtctccttcaaagaaaaacacaaggggtgccttacggttcgatgacagtttcttttgaacaatgctgttattcgtgtaatcgtttattctgtacagagctcgagcctgattaccttttatacccttactacttatatagctttcaatctttttcaccgctaccaatccatctttataattctcaggatctaatggctttggttcctccttcgacggcttttcagaagtagtcggcggcttcctgcccggctccgttttcgttgttgttgtcgttgctggaaatgttggtgctgcagccttattaactttaggccatgaaagaataccattggctacttgatgcaggtatacggccagcacatcacgaccataacccttattttccaagccgtattttttcgcaaaatcatgcagtgcggcgttaagctcctgatcccaatcgcctgtagttggtagcttgtacgagaagctgtctggatacttctgggcaagcttgttcaaattatctctggcaagcaggctgttcacaccatacttactacgcagagcagccgcttccttagcaatagccttttgatcagcaacggtcagcttatgggctgcatctgaatattgcccggacagctcctccagccgattcgcatccagataggatttggctgaatgcccacgaatcagctcgttgattagcacattgtcacgcagctggttcgcgagaagatgcatctgtttttgcttggctttgtcgttggctccatgcgcttcccaccactgggacgtgtattcatgcatttgcgctctggcccaggcaggcatacgatctatttctgccacctgctgacgcaattgcttggccttggctgctgcttccttggccccctttttgtccccggctgccacggccttgtagtagtccgttttatattgaagcagcaagtcctgtacccattgcggatatcccttccctttcaattcttgaactagggatttataggctttcagctctgcatcaggcacctgatttttcatgagcttactagccttgatatgaagcgttccatcggttcggatatagctgcttttgcacgtcagagatatttcgcgagtagcggtcatttgtacctttttgccatgcagcaccaggtctgtatcggcgtgaaatgtaagatcgtgatgactatagacgtgaataccggaagctggattcaagcgcacaagtatcttttctttttgagtggaaagtgccacttctttgtcgtcgaatctcgccactttttgagttttggtatgaaatagctttcttgacggcttgctgatttcatctcctttgtagtctctcttacgcagagattggactacacgagcttccttttctttgttagatggaaaatacaaatggacatgatccctagctcaggcatgcaatgccaaccaattccatctccggtatacatggtggggtatgaaaaccagcaaccctcaactttggactgcatagaatccacggacaagtgaagtttaacggattcgttttcactatttaaatcaataactttcccttcaatagaggtacctttgattaacgggttatgtataacctccctcggaatgcctgctcccggaacgagaacgtagccatatgtcataatgccttgcttcatctctgcatgaatctgatcaataacccaatgctttcgttgaaacacgacgacatctccaagttcaaaacgcttcgtatcctccacttcagcatatgtatactggggacctgactttgttttttggagggaaaagttaatgctgcgtagttcacctttcacctgttctttcgaggtacctaaccatagtctcgggaatacggatgtgatctcggcaatcagtccagtttgtagatgagaggccattctttttagaaactcccagtcactctccctatactgaatagtaaagccatctaacttttgattgctgtccgtcaggtcaataaaatccccatgtggataagcatctataagttcccgaaataattgataatacgtcaagttgctgttttgaaacgaacggtttttccgttgttgatccaataaatatgtaaaagacgcagcctcaaggtacatgtgatatacaccatttttgaatccaatgctaatattggtgacgattcctttaaaaatgctaactgtccctcggtcttcatccacctcatatacctctagcacatcctcatcatgcgctaaaccgtcatacttcgcatggtcctcatccggtatgagagcagtaatgtacaccttgccgtgctcatttatcttctgtgtcaattcaaaatcaagtagccggataatttcatacggtgcattcactctaatatttccataagtcagcatagttcctgccagtcccatcttactccccccgtttgcttttcatatgatgcaattcctacaatctgttagctattcctgcccatctgtcgtgaatgaaattttgccgcaccacatgcataagttcgtggagcagctcatcagagccggagattgatctacgtatacatccttttttccattcaaccaaggcatagaaacgctcggtttgcagggctgcggaatgatttttccggaatttcctttgttagcagaagagactgcaggattatacagactacggcactttccgaaagaagggatatgcgtctgcgggtgaaaatcctgaatattcccttgcagtttgtcgccaatactaatccccctgttagctgaaacactaaatcttcccgtatgacttccatagctacaatgtatctgtgccccatccactacatagctctcactcattcttggactctcctttgtatagatggcccctctgtatcgaccttttgtaatttcaagcctgccagattgaacttcaaaatacattcagccacatcaagatctacaatgatatgatgattggcatcctgaaccttgaatattttatgattctctactttatattcatctagaaggattttcttcagtgtaccgtccctatgatattcactacgtggtgataaacacatcaggctaggcggatttgccagccaataccttgtttgctgcattcgctgcatatcggcaaaaacaaccaacttccagcttaatccggcttgatatatatccaagatttcctttagttgttccgaaacgatggataccggatgctctataaaatcaatatagtccgcatcacctgatacataaaattgtaaaatagattcttcatcggcacatgatgggctttctgcccattctaacaactgcctgcgatttgtctctactggatacatatactccgtaatacgattatcctgttgaatcatgtagtactccataagctgttgaatacaccacctcactgattcctttatactcccctattcttacttccaaatcattctcacatttcaacgccttgaattcaggtaagtgtacagcctgctgaatagcatctttcgctaatttcagaatatattgatgaaattcccttgcagcctggagtacaaatcgctccacatcaggctgaaaaatcttattcatatagggttttcgaagctgattcaattcatcctccaattctgctaaaaagctgaatgcccagcctgcatcatagattccataacaaggttgaggatcaaagaaccaatttttatcataggcttcgacgacatagttatagttacgatccatcagatacgtgcgcctcatagaataagtaatgtatccgatccttgtcttggccacttctgcagaatgggcttgcaggcagattgattgaaaggattgaataaaagaaaaaatgagttcctcttttctatgctcatataaagacgctgcctgatgtaatttctcattcagtacatcttccgcataggtcttatggaagtgttgtagggcttcctgtctattcataatcccacctctgaacctattatatagaatatttacatgatattactggttctatcctcctattttattacacaattttcatatcatgagattacatatgaatgtatgaaaacagaatgaaaataatcacattttttcgtgaatgtgtaataatatatgcaaaaattatccaagaaaggccaggattagacctaaaaaatgaaggtttgtgcaagcgaataggtaaatcgaagtagaagactcaggtttataacgaaataatcatgtataattaataatacgctccagcaatactttcagaggactaggaatgggatacacaaactattagagttttgttaaccaccactttgcatcaagattggagacatatgactacttcacctacaggtttttataatagtattcaagaggctaccgcgcatgtcattgatgtgttgagtgatattttacatgttaataccatttttattgccgctaatgatggggttacaaatgtaattgtagattcatttaaccgggaagaggtgctggttcgtaatggagaggagcttccttttgagcttagctattgcagtctggtgctgaaccattctgcggattacctcaccatttcggaaacgtctactcatccacaaacacgtgatttagatgcgactaaaaccatgggaaaccactcatttacaggaatccctattcgcatgaaaaatggtcaggcttacggaaccatttgtatcttgaacgcgccatctgtacatttgacagaatcagaactgaaggcactacaggctatggccgtatttctgggttatgtagttgaactggagaaaggcaagatcgatgctgaaatatcttccatgagcaagctggatttgatatcttccctgagtaataaaattcggttttcgctgaccgaaatatggggagccaccgatctcatgctgacgacggagttaaccgaggaacaacagcaatatatgagcatcatggagtcgagcagtcgctcgctcatgacgttattgagtaatattttggattacagccatatggaatccagacagattgatgatattgaagatccatttgatctgagaacgatgatggaaaatgtgttgagcctgtatgcagaagtagccgcgcagcggaatctagagttaaagctcgactggaatctcaccagctcgcctatttttatcggggatgaagctaaaattcgccgtatgctgattaatttggtagataatgcagtgaagtttacaagcacaggagctgtcatcttatctgcaaccgcccaatccgtgaccgatgcacctgaggttgaactggaattaaaggtgaaggatactgggatcggtatatctcctaacaaactgaaattgtggcttgagcatgaccgtgggaactctccctcatatggcaatccaggattgggttggctgattaccaaacatctattaaaacgaatgaatggtaaaatgactgggatcagtgaacctggtagcgggacagaaataacgctccagttcactctgaaaacataccaggagtcagcatgaaatagggactaacctgttataaatataggacacatcatgtaatagaagcccgtgacgcataacgtcacgggctttatgttatggatacgtgtcattaggcagtattatcaccctatgccgcacgtttgtgcatagtcagacttagtaacgtttgggagcagccagcttggccaaatccgccatatacgtaaaaaaggcttctggatctgtatcgtataccaggttcacaggacgtccctctgcctgttccaccgttctgccctgacttggaccttctgcgataacgctgcaatgcaccgtctttttcttgacaatgtccgggcgtcctacggatgcagtggtcagtacatcccacaagtagtaggttgagttcgtttcgctatagacgagcggcggacatccagcatagcaattacccaagaaatccacgccttcatatcggcgctcggccgcccaacgattgcgtactgctggagttaatggcactttgcttgtgctttccagcgctaccagatcaatcgtgatgccgctttgccacacccgatatgccgcttctgggtcccagaacacattccactctgctgtgccgtcatgctccggctcctccacattccctttttcaaaggtgccgcccatccataccagcttttcaatctttgcttcaatatccggtgcttcatccagcgcccgcgccagatcggttagcggtccagtgaatagcaacagcgtcttaccttcagctccgcgtaccttttcgatcagatgctgatgagctggcagggatgaaagcggtgcttccattcgccccgattcattcagtaccggtaatgcatccacatagaaggaatgtaaacgccaagcagcaggaaacggatttttaccgcgtgaattagactttgcgacttccacaggccctttattttgtccaaaacgatcaataattttacggctggcatccgttgcaggctccagataaccatctgctggaatcaccgatactccggtcaaatgaatctgttccatctgaagcagcataaacagggatactagatcatccactccaccatcatgattaaaataaacgtttgtctgactcatctgtctcttccttcctttatccccgtaaaacaggcttgttcttatcggcaaccacccttcattatgcctgatcgcttcacaggagtaaatgtgcgatagtgtgtggatcagggattttttgcttactccatgcttaagataggtagaaatgtgtgtaataacagggtagaatcatgggtcctaatcggaagcgtatgaaggagagatgcatatgacagcccgaacaatagaagagttggagcagatccgtagagagtgtaaatccatggtgacgaaaagggctgcggcttctggtggagcggtattagttccagttccaggggctgacgttcttgctgatgttggcattttgatgcagctactgccagccattaatggaaaattcggattatctgagaagcagctggaaggtctggacgcagaaacaaaatccatggtgtatggttttatcacctcaattggcagcaagctgatcgggcgactcatcacccgtgaagttatcgtgcagattttgcaaaaaatgggcattcggatcgctaccaagcaggttagcaagtttgtcccccttctggggcaagggctagccgcggcaattggcttcactgccatgcgaaccattggtaatcggcatgtcgatcaatgttatgaagtagccaaacgcttgctggagcagcgaactgccgcggataccgcgcgcaactggacagttccacagcagcctctagagcctgtgggagtggatcatttgccaaaccgggacccggaagcagcgattccactactgccggcaccccctaaagattaagtttcgcatggggtaccgcagatcgagacgggtcctgtatcccatgctttttagccttccaccttggctccataggagcgggccaccgctactgcctgctcgatatccaacttggctccggtgatgtccagatctttaaaattcacgccatccatcttcgcaccgcgcaggtctgttccttgaagatgggctttgtgcagtcttacccgggtaagatccgcctcccgcaaatctgctttttccaaattgcattcggataagtcggcttccttgaatcgtatttttcgcaaatcttgttttcttaaatctgcatgacgcaaattcgtataagaccagtctccgcccgtaattgtgataccatccatattcgcccccgcaaaatctgaacctaccagcttgcagttatcaaaccggactacaaacaaattggcgctggtgaacaaacaattcgtaaaagccgactccttgtagtgagatgcattcagaatggctccggtaaaatcacagtccacaaaagtacagccttccacgagggactcattcatctccaccccccgaaagcgacatcgggtaaactcacaatttctccactcgccttctctggcatccattgagccaaaatcacgggcttcgtagacctcatctgtataaaagaacatgttctctctcctattccttattccctatattaggaactcagcatttcggcaaagaccgctcaaaaccgcccttcatttttcccagtaaacccttcatcatcttatggtcctgtggcgtaaactcagacatacacgaccgaatcaacttcgtataataagggactatcttactcaacagctctcgtcctgcctcttttaatccgacagtcaccatccgtccgtcactctcatgagccacacgttcaatcatgccatctcgctctaatccgtcgatcagccccgtcatggttccacgcgtcacatcagctttttccgccaactctgatggtgtcatgcgatgcggcgaatggcaatgcaacaggctaagaacaataatccgaccctgagaagcccccaacttgctaaaatccgtatccatttctctgaaaataccattagccaagcgcgcaaatgtcacaaaagtctctatattatccacttcggcatcttcatgcccaaagctacgcagcaccccgcgtatggagtcattatgaaaattaaaattcatagtctatccattccttccttaatcccgcttgttccgtcagacggtagcttttccattcgtcaggcagcaaagaagcatatggttccttggcaaaacgatcatctaccaggaccagcaatccttcgtcgtgctccgtgcgaataagtctgccacctgcctgaagaaccttgttcattcccggatatacatacgcatagttgaaaccattccgtccctgttccaaaaaataatcccgcagcacatcccgctctgctccaatttgcggcaagccgacgccgacgaccactaccccatttaagcgatccccaggtaaatcgacaccttcagcaaacacaccacccaatacggcaaagccaagcaaggtgtgctcttgcccaggctggaaggcctctagaaattgatctcgctctggttcggtcatccccggactttgtaccaacgtatttgcggacacgtcccgaagcatgaattcctcatacacctcacgcagatatggataggacgggaaaaatacaaggatatttcctttccgttccacaaccaatgcagccagcatatccgcaatcgcccctttggaacgctcacgatcccgataacggatggagagcggcagcagacgtacatcccactgctcctgatggaagggcgaaggaacctgtaacgtataatcttcctcgtttgctccaagcatgtcccggtaataagcaagcggtgtcaacgtcgcggaaaaataaacggctgagcggtagcctttaatagcttgtcccaacaagtgagaaggatcgaggcagaacagcttgaccctcacttcactgcgccctgcttccacataagtaacgtaccgttcatcatataaagcagcaatttgcagcatattctgagcggtaaaatacgtatctagaagcaatgcataatccgtaccctcaccgcttgcatggcttgtactgccccccgttaccagttcacgttcagctgcttccacaaaaggcaccaacagcttcagtacctcttgcggtgctgctgtctctactgcttttcctgtatctgcatattgcttgcgcagcgtaatcatatgtgcgttcactgcactcgcagccgcagcaatctctgggcttagcaacttaaattcccgtttcagttccaaaaaagaagatttcaaaatttccgccgaaaacatgtcccggccacgttctaccagattatgcgcctcatccaccagtacgacaccttttcgcttgtgctcctccagcaatcttttcaaagaaatccgtggatcgaaaacataattataatcactgattataccatccgaggcatacgccacatccagcgaaaattcaaagggacagaccttatgcttgcgcgcataatgctcaatcaccgcccgggtcattaacgtctcattcgccaaaatatcggaaaccgcaccgttgatccggtcgtaataaccctcgcacatgctgcatgatccagcatcacaatcattttcatccttgaagcaaattttatccttcgcagtcaaagtcaccacatgcatgtgcagcccttgggcctgcattctggcataagcttcttcggctgctgtccgagtggtggtacgagccgtcacataatatactcgtctcaccaacccttcgccgatcgccttaatcgcaggaaacaaagtggataccgttttaccaatacctgtaggtgctttggcaaacagattacccccttcggcaatcgtcttgtacaccgaacccgcgagcgttcgctgacccgaacgatacgtgtcaaagggaaagttcaacatagcaatgctggcatcccgcttttccgcatgtgctctcagcagaaatgcatacggtgcataaccagcaatcatctcctgtgcaaaagcttctagctcagtaaaggatagttcccgtctgaatcggcgaatgtcttcactgtgtgcctgtacataagtaagctggacctgcatcgaatgatgttgttcctcacgagcaatcatataggcatacagaaatgcttgtgcccagtgtacaggttggccgtcaccctgaatatcttcgagtggcaaagagatcgatttaatttcatcgaccgtccatacgccatccagctcaatcagtccgtcacagcggccttcaatgataaacaattcatccttatacggaatttctgtacgtaaatgtacctctttgcggtcatgctccttgtaacctttctggataacctgatgcacgcgagttccttcgagcatactgctattcgatcgaaagccgctatgaatgctgccgctccgatgcacatattccacaagtggacgcaccgatatgtgaattggttccttcatacgatcacccgttccggtcatagtcctttcactgtaccacgtagatagacgaaacgtaagggacataagaatcgtttgtattcaattggtattcactcatgcctactttttaccgaaatatagaaacgaggccttttgctttattccccacgatactacaactctcattacagcataaaggatagggatatgttaaaagaattaattaacaattttgcgttattaacaagcttcttattctttggaaatttatttttccggaaatatgaacgttacctaaaaaaacatatattcatttatcgggtaatgaacggtttaatgctgggtctgtttggcattctgttaatgatgactggtttatgggtccgtgggcactttgtggtcgatctgcgccaattggcgattatcatatctgtttatatgggaggatcggtatccggtctgctgaccaccttgatcataagcctgtaccgtatttacatcacaggtggttggacagatgtttctctgactgctaccgtcaattgtttcatgacactgggcatttcacttatctttattcgagaaaaaagcctaacactccgcaagtggatgtcggccgtacttggagctgctgtagtgtcgctgttatctactttctttgtagttaaccctcctgataatgaatctattataataatcacaactgttaagttgctcggcggcctgttcacttattttatgatgtcctatatcaaaaaaacagaacgggctgtccatctgctggaagaagctgcaaatcgggatcatttaaccggactctacagtccacgtgctttcgatgcgctatttgaagaggtctttcatacttccaagactacaaaacaaccctttggactcgtgatgctggatattgaccactttaaaaatattaatgatacgtatggtcatttgaacggagataccgtcttaagccaattgggaatgttgttaacccgggaatctacaacgagggcgtacccctctcgtaagggcggggaggaatttgccattctgattggaaattgtgatagtcagaaagcagcaagctttgccgaaaaaattcggaaagctgtggaaaatgaacgttttcttttgaatgacggaacctcgatctcgctaaccgtatccatcggagcaggcagttcacctgtcattgcatcgaggcacttactagaaaagtcagatgaggcattatatgaagctaagcgttcaggacgcaatcaggtgaaactggcaaaaccatagatattagtcgctaaatgtcaggaaagctggattattgttaataaaaagtggtaaaatggaaataacatcgttatcaaaaaaacttctgccgctagtggagacatgccttacaatcgacatggggggtgggctttgtgaacctcgaacaattggaaaaactcatggaaaaagaacgccgtgaactgaatcgcatggctgacttacacggattaaaagatgaacgtgtattggacaaatcctccagacttgaccgtattatggacaagtaccttcacaccaagcgtgcaataaaccaaacacactcatagaagcaagctacatcgctgcccctcagggcagcttttttatgatgtaagcagtattcgtcctccttcggtacacatctgcatcgtactcaccttctcgcggactgactacttcccgccatattccgtccgcaacaattgctgtgtgaacgatatccattctctggctgcaaaggacagataacgatcgttccgccagatcatccccaaatgccaaggaatgacggggttcaccaatggaagaacacgcaagcgctcagaatccagatctcggcatatagcctccggcaacagcgctactcccaggtttgcagcaaccatttcgctaatcagatcccattgtgagctttcgtagactacacgcggctgaaagccagcccgtacacattccgcaataatacggtcatgcagcgtaaaatcctcacggaacagtacaaacgcctcctccgccagcgcagatagcggtacctccttgcactctgccaatgcatgcgtaggatgaacgagcaagttcagcttttcctccacaaacagaaatgtctcaaacatatctccaaccgcaggcagcacaatcaccccgatatccaatgcaccggcttctacgtcctgttccactttcttcgccccgtcctcaaataattgaatggtcacatcaggatatgccttatgaaattctccaatgacacgcggaaaaaagctcgatccgaccatagggggcaagccaatacggatatgtccttttttcaggttcatcaaatcactcagctccgaggacaggctctgaaaggactttacaatcgcttgtgcttgaagctcaattaccttgcccgcgtccgtcagttcgattcttttgccaattcggtcgaacaaagcgacccccagttcatcttccagacttttaatcgtcttactgatcgtcggctgggtaataaacatgctctgggctgcctttgtaaagctacgcaaccgcgcgacttccaaaaaatattgtaaatgtcggatatccaaacctacaccttctctcatagacaaacggaatagatcacattctttatatgcattttactcatgaaagcttgtgatgtaaaatttcattacagtttgaaaataaccgatctcaaagataggagccattatatatgaaaagcttcatacgcggtgtcctccagatcgccgtcctgatggccttttcgctcatcctgaacgcggtagtctcctggctccacctgcctgtacccggtagtatcattggtatgctgctcctttttattctgctgcaaaccggcttggtccggctaagctggattgaagttggcgcaaactggttgctggccgagctgctattattctttatcccctccgctgtcggcgttatgaattattggccgatgctggaacacgatggtatgagcatcatgctggtcgtgttgctcggcacctttctggtgatggcctgcacaggtatggtcgccagtctgcttggtaaacgaaaggagcataaatcatcatgaccggtcttctatgtattatattgacactcgctatttactggatggccaaacgcatgtaccgcacactgcccaaggtgtatttgtctccattgctcattacacctattgttatcattttgattttgacgctgacgggtgtgaactaccgttcttataattcgggcgcccacttgctgtccatgctgctacagccagctacgattgcatttgcggtccctttgtaccgatatttccctgtgttaaaaaaacacgcgactcaaatcgtgcttagcgtgctgtctgggtccgttgtagccgtgttgtcctccatggcgcttgccaagtggatgcatctgaattcttcgctgctgagcagcctgattcctcgctccattacgacacccattgcgatgaatgtatcgcaaacgattggcgggaatccgacggtcacagctgtattcgttattctgaccggattgagcggtcttattatcggtccgatgattgtaaaactgttccgtattgaaaatgaagtctcacgtggggtgctgctcggtaccggtgctcatggtactggcacttccaaagccttcgagttcagttcgctgacggggacgatatccagcatctcgatggtgctcgccgctctctttaccttggcagccgccccgttcctgttccacttgatgctgtaagcaatatgtatacaaagaagcagcgattctcttgttattggagaatcgctgcttctttgctttcattccatgccgcgaagcgggcgcaacagctattggaacaacggtccgttcgcggagcgtccatctgaagtaccgacgaatatccttctctaaagcaaggagacgctcaagaaaacgcacccttcactgcactcagattgccttaacgacgccagatttcttctctgcctctgcctctacaggcgttacagcttcatacaggtaagcatccagctcagccgtatattgtcgtgcttgcgcagcgctccagcctgcatgttcggacattaatgcaatggcgggctgtttccagcgcttcacctcgtcaatttggaagaacagcgccccggttcggcgtatgaaaaaatcagacggtgtcaccgtcatttcctgttccatcgcatacaggagcgggacacgcacttccacagggagcgccgcttcctgctcggtagcctccttcatgctccgtaccgctatggcaaacagccgctctgtgttggagccatagcgggttgcccatgctctagccgtttccggcgacaggccgagcgcaatacccgctgcggtttgcttgctcacgaaggcgtcccagcccgccgagccgcctacgccgccacccgaaatcgggatatgtctggtgcggcatgcccggaagctttgcccgtgcaagcgtcccagctcccgtaccgcacgatccacgacgagttcggacattttccggtagcccgtcagcttgccgcctgcaatcgtgatcagacctgaacgggattcccaaatttcgtccttgcgtgaaatttccgaaggacttttaccgtcttcataaatgagcggacgtacccctgcccaactggattctacatccgtaacagtcagtttcacatccgggaacattccgttgatcgcttgaagcacataggcccgatcttcggcggtcatccgaggatgcgccgtatccccttcatacaccgtgtcggtcgtacctgcataggtttttccatcacgtgggatggcaaataccatgcgtccatccggtgtatcgaagtacactgcctgtttgagtggaaagcgctcagcatcgaacaccaggtgaatacctttcgtcaggcgtagcaccttgccctctttagagcgatccatttcccgcaacgtatctacccatggtccggccgcattaataaccagtgaagcccgaatttcgtatggctttcccgttacccgatccgttacgcttgcgccgcttattcgtccgccgtcatacagcagcttgtcagccttggcatagttcaccgccagcgctcctcgtgtaacagcttccttcatgacctcaatcgtcaggcgagcgtcatctgtgcggtactccacgtagctgccgccccccttcagtccatcacgcttcagcaaaggctcgcgctctagcgtagcctggatgtccagcatccgacggcgctcactacgcttaacaccagcaaggaaatcatatactagcagcccaacagaggtggtgaatgcgttaaacgtgccacccttgtgaaaaggaagcagcattcgctccggtatggtcacatgtggaccattttcgaatacgatggcccgctccttcccgacctcggctaccatcttaacttcaaactgcttcaaataacgaagacccccatgcactagcttggtcgagcggctggacgtacctgctgcaaaatcctgcatctccaccagtgctgtcttcaaaccacgatccgccgcatccagcgcaatccccgcccctgtaatgccgccgccaatgattaaaatatcaaaatgctcatctcccatacgttccaaaacagcggttctctcctgcgcagcaaatccctgttctcccatcatgtatccctccagctttgtatatattcacgatgcaatctgccaactgaatcatcataaggtacaaaaaaagaccacgaacatcgctgcggcggatgccgagcggttcatggtctctccaagtctcctgacgagtattaacttatctatatcgtagcacacacaatacgctatgaaaagggaaatctgcctgttgccagatggttgccttctatcgtaaaaccatccctacttgaacgccattgcggcatgaactgcctttttccagccaccataaaggtcagctcgcacgtcctcactcatggacggagtaaaggtatgatcactttgcgcatatccccggacttcatccagactgctccaaaacccgactgccagtcccgctaaatacgccgcaccgagtgcagttgtctcgttcacagcaggtcgttctacaggcagatcgagaatatcgctctggaactgcatcaggaactcgttcatcactgcacccccatctacacgcaatgaacgcacaggtacacccgagtcgctcgccatggcagttagtacatctttagtctgataggccagcgattccagtaccgctcggataaaatgctccttggtcgttccccgcgtcaaaccaaatgtcgcgccgcgcacgtcactgtcccaatacgggctgcccagacccacaaaggctgggacaaaatataccccttccgtcgaggtcacacgcgccgcatacgcttcactatctttggcttcgcggaacatacgcaacccatcacgcagccactggatagcagatccggctacaaaaatgctgccctccagcgcatactttacctgaccattcagcccccatgcaatcgtcgtaatcagtccatgctccgagtcacagggttcatctccggtgttcatcagcataaagcatcccgtaccgtatgtatttttaatcatgcccttgtcaaagcacccctgaccgaacagagctgcttgctgatcacccgccgctccggcaataggaatttcctgcccaaaaaagtgataatccaccgtatgcgcatatatctcagaagatgatttcacctctggtagcatagacgcaggaacgccgagaatatccagcagctcctcatcccattttagctcataaatgttgtacatgagtgtgcgggccgcattggagtagtctgttacatgtgctttaccaccggacaatctccagattagccaggtatcaatcgtacccaacagcaaatccccgcgctctgcttgagctcgtgccccttcgacgttgtcgagtatccatttgaccttggtgccagaaaagtagggatcaatgagtagtcccgttttgctatgaaaaatatgatcaaatccacggcttttcaattcctcgcagatcccagctgtttgccgtgactgccataccagcgcatgatatacaggcagacccgtatgtttatcccacaccactacggtttcccgttgattcgtaataccaatcccggcaatttggctggcttttacacctgattccgacaagcaggaggcgatgacggccaaaatagagctccatatctcatttgcgttttgctctacccaccccggctggggaaaatactgtgggaactcccgttgtgccttgtataccacttttcccagccgatcaaacaagatggcccgcgaactggttgtgccctgatccaaggcaagaatgtattgctccatcacttcccagcctccttgcatatttatgtattgttgcccacttgattcaaataaaagctattgcctataatgctcgaacagcagcttattggaagttgtaactgctgtagctcccgcagccaacgccgcttccacatcctctggggtgcgaataagtccgcccgccaaaataggaatgcccgtgcgttcgctgacctccttaatcatcggcggaacaacaccgggcagtacctcaatataatcaggtcgtgttttttccaccagcgcgtagcttttttccagcgcaatcgtatcgagcaggaacacccgctgtacagcaagaatccccttctttttagcggttgcgatcaccccggaccgggtcgaaatgatcccaaatggcttaatttcctgacacaaatattcagccgcatattcgtcattcttcaaaccttgcaccaggtcggcatgtaggagcatttgcttgctgcgacttctagccatctggtacaggttgcgcagctgcgctacatgcgtatccagaaaaacagcatactcataagaactgtccaaaataccctccagctgcttcatatgcttagctgcaggtaaaatgcgttgtccctgaaatggcatggatatcccccttaggctgaatgtcggtcaaactcgttcaaattttatattatcactctgttcgacgaacgtgaagcggtttcattgtagatatgtataaaggctgccttccctgcaatagatgtcagcaggaagaagacagcctaatcgttcaaaggaactggatcaaatcacacgacggcacccttaaaatgctctatagtgtactagccctcaaacccttggcgcagccatgaggtagcgagcgtgatcgcaccgcgcttggccgcggtttccgacaatgggttcagcatcacaaagtcgtggatgatgccctgaaagcgtgcagcggttacctctacccctgcttcacgcagcttattcgcataggcctcaccttcatcacgtagcacatcggcctcgcctgtaatgaccagcgcacgcggtagcccgttgagctgttctatggtggcacgtaacggggacgccgtaatctgcgctcgttcattgggatctgtcgtatattgatcccaaaaccattgcattccttcgcggctcaggaaatatcctgtggcgaactcctgataggattccgtgtcaaaggaagcgtccgtcaccggataaaataacaactgctgccggatggcaggaccactgcgttctttggccagcagcgttacggccgcggtcatgttgccgccgacactgtctccggctatcgtcagcgtatcgggcttcagtccatgctcgcgcccatgctgtgccacccattgaacgaccgcgtaaatttcctcaatcgccgtcggatatttagcttcaggtgccaagctgtattccgggaatacaacggctgcctgtgagccgactgccaattcacgaatcagacgatcatgcgtgtgggcattaccgaatacccagcctgctccgtgaatatatacaatgaccggcagatcgcttgtcacttgttgtggacgaacaattctgacctttacctcaccgccaggcccacctggaataattagatcttctacatctgcggcaggtttgtctgctggaccggattgaacctcattgaccgtttcacgtcctttttcaggacccaaatcatatagaaacggaggtttggcattatcgtctgcaaatttctgtgctgcgggttcaagctgtacttttttactcatatcgattcactcttcccttcttatctgtggtctacatatatccaatatggcttaagtttgctcattcagtttcaccttatatatttaaacgagttcctctctttccaatcggaggactttagtttgcccaatagaagggcttgacttttattttgtattgtaactataatagttacatattaaagttcgtaaatgcactgggtacacttacgatcaaacgaatgaatcatccacatcatatttataggaggctatctattatgaaaattgcagttattggtgcaaccggtaaagcaggaagtaacatcgtaaaagaagcattagacagagggcatgaagtaaccgccatcgtccgtgactcggctaaagttacagaaaatcgtgctactgtagtacaaaaagacgtttttgatctgaaaacagatgatctgaaaggctttgacgtagtcgttaatgcatttgccgctccactcggacaagagcatctgcatgtcgatgcaggtaacgtactaattgaaggcctgcgtaatgtatccggtactcgcctgattgttgtaggtggtgcaggcagcttgttcactgacgaatcccaaacacttttggtaaaagatgctcccggcttccctgatttcgtatatccaacagcaaataaccaaggaaaaaacctggaaattttgcgtggtaccagcaacctgaactggactttcattagtccttctgcggaatttgctctgggtaaacgctcaggctcttaccaagtgggaaaagacacactgttggttaattccaaaggtgcaagctatgtcagctacgaagattatgcagttgccgtagtggacgaaatcgaaaaaccacaacatctgaaccaacgtttcactgtcgtatccgagtcctaattactgtgttctcgcagcacatttagcataaaaaagacccttcgcccattctctcatgcagcacgctatgagaaattgaacccggagggtctttttgttatgacctgttgataccctcgttatgacttgtccgtactgacctttttttctgtatcgtgagcggaagtctccctcttatcgctaaaacacagcttgagaatcgaaggcgaagccaaggtcgtcagaatgatggcaatgatcaccgatgtaaaatattgctgtgccaacagacccgactgtagaccggtagctgcgataataagtgcaacctcgccgcgagatatcatcccggagccgttcgcaagggcagaacggttatcgaagcccgtcagccgcgccccgagtcctccccagaatagctacgacgaagaaagctagctttttgccaacaagaagtcccaacgaagtttctccacccataccgaatatactcattactaccgctagcagcacgccgatttcagacatattatgaatcagcgagtcattctgaacccatcctaatacggctgggcccaggacaattcctgcgatcagctttcccaacaccgctggttgaccgagcttgacagacaaatgacccacgacttttgtgaacagtagaatcagcagaagatatagtataaattgcataaaataaaaagggaaacctgaaataaagcacaggttcccctaaaaaagacataaaggagccttggtgacaggctcctccggtaaattcatatattcttttaatgttgtcggtcatacttgcgcaaacgagcatctcttctgcaaacccgtgtaaacgtgttgaatcaattttcagcttttttcacatagcggtcgcggtattcgtggtccagcatactcatcagaatcgaatcatggtattcataattgtagaataaagcatcccgctgcacaccttcacgctgaaagcctactttttcatagcaacgaatggcacgttcattaaaatcaaacacattcagctcaatccgatgcagattacagataccgaatccgtaacccagcatgagtacaagcgcttcggtgccgtagcctttcccctgatttccctgctcattgatcgcaatacggatgttggcactgcggttcaggctgtccatatcctgcagggctatatccccaatgacacgatcatcttcgcgaagcgcaatcaacagcaacaggcttgaggtgtcctgtcctttagcttcaatataacgggcaatttgatccttggtaaagctgcgttgtgtgcctgtcagcctccgcacatcctgatggaacaatgtattatagtatagctcggtgtcctctacgttaacgggacgcaagtacacctgtgatccttcaagtaaccgtgccacaggctctgaggctgaagtttgttgagtcatcatgatctctcccatgctaaaaatataaatgacgaaaatcaaagcaaattattgtgcaagttcgactacgcaaggtctgcattttgctccgtaggcaggctagaatcagcgagggactcgcgccaaattacggattgaagcagcaggcctgccaaacccaagattccaacagtcatcccgatccagacaaaagccgttcccgcccctgctattcggatcaatactccccccgcaagcggggaaacgaccatgattgctccaatcacggtactttggataccaaagacgcgccccaccatatcagcaggggttttggcttgtaatatataattctgggtgataatgtacaggccgttgcccacgcccagcacggccccgatcataagcagtacgggcaatcctgttccgggttgtgcccagcctaaagcagcaatagctccgccaaccagcacatatccaccaccgagcccccagcctgcgcttatgcgattcaagcgattaagcacaagcatgcagccgacggcgccagcaccaatggctgaaaccagccagccaagcagtgattcattacccggagcgagcactcgcagcaatgtagggaactggtagtcgatcatgagaatggcgattaagccgaaaagtccgaatataagcgtatgcaaaagcattcgactgcgccataggaacgcccagccctcacgccattggttgaaaaaacgagatgcgcggacatgctcctcccgcattttggcttcatcggccttaggcgctgtatgcgcagccgcctttccttgctgcccggctgcaacagcttgttggtctgcgctggccagcgccggaccgattccccgcaacggccacagtagcaggccggaacagaggcgcagcaatgcattgagaataatgcatgcctgaggggacaacacagtcaaggtcatagcgcccagtaatggcccagccactttggaggcctgattgaccagcccattcagcgaggtcgcccgaaacaggtcgtcgctggcgactaccgcgcgggttaagccttgctgtgaaggcatttggaatacgccagccgccgcgcgcagaccgagcaaaggcagcagccacgccgggcccgggacggcgaggatcgccagcgtcaataaggcgatagctgcatcgcagacgatcatcaggcgggccttgtgtacccggtcggctaacgtgcccgcgatggaacccagcagcagacccggtagggccatcactaccggaatcagcgcaatcatcattgggtcggcttcccagcgataggcaacaagcacctgaatggcgatagcatcaaaccaatcgccaaaggaggcagccgtgtgcgccgcaaacatccgccgaaaacggccattgcgccaaatgctaggcgtggattgcagttctttcttttccttcattatctactcaccctgctctcattttcagcttctttagcaataagaacattctaacgggtctatatcagaggaaaatcagacagctaaaaacatcagaccacagaaagtgtttgctccaaccagcgccttagcgcctgacgatgcagtgttaaactgttgtcccggtcaagccgatcatattgagccgcatatttctcttccagcgtgggataagaaccgcagagcttcaaaaaaccgcggatttggcagaccgctttgatttttagcaattcctgtttagccatatcaagggtatccagcccttcatccataagccgctcggcgttgttcacatctccagtacgcaaaagcataagtccgcgcatcatgcgataacggcccagttcgcgtaaatatggagcctccgacagcatgccttccagacgatcagacagttccgcagccttttccatatgattggaaaccagatgcatgtacatctccatcagtgcaacaggcatcacaaatttatcgagattatcccgttccatgaccctcaaggttagtggtagaccttcctgcgcgcgttcaggttctccattttccacataagcctccaagatgttgagaatgcgtaattcccgttcctgttcactggacaggagcctgctggaaagcgcacactcacatagagcaatcccatcatccgttacccctgctgtgcccgtaaatagcagcaacatccaatacaatcggtctacaggggcaaaatcctcccgctccaagaaccaggacacatccgcctgtacaaaacgggtatacatttgataaaaggcagacatttgaaaacccatctgctcctgctgggcagccagcgctacgatggaattcccctgccccaacagctggtatttccggaaaagtccatgtacagcgtcctgcacctcctgatcgagcaaggacggatgattctgtgggtgcacgtcagtcaaggtcaagctgtagccataccctctaaccgtatgaatacggagcccatcccatgacttaagttttttgcgcaatctatagatatgatcatccaccgtacgctccaccggatactccagcggccacacacgatccagcagttgttcccgggtgaacacctgattccggttatcgtacagaaagcgcaacagcgcaaattctttagccaataacataacacgatctgcattacagaccacactgtagccatctgcatcaaattgcagcctgatcatccacctcgcctccgacatatcgcttcttagctgcacccagccctataaacataagcaacacactcagacacaagagcagcagtagcgggattgtccagccttgcgtcgcatcatgcagataaccgaacagcgtcggtcctgttgctgctagcaaataaccaaaggattgtgccataccagacagctctgctgcctgctgcggtgtccgcgtccgcaaattaaagaacatcatcactaacgggaaagcaaaaccacccgctataccgatacaaatgacccaaatcacactccactgtgtagccccaagcagaaatccacccagaccgataaaatacagcgcagccataatcagaaccaatatccgctgatccttcacccgcgctgcccaaataggcacaataaaagtaaatggcatttgtgaaaactgcagcacggacagcatccatcccgcagtctctgaatccatcccctgtccgctcatcatttcgggaaaccaagcggcaggaacatagaacagggcagattgcagccccataaacagcgtcaccttccaagccaaagacgatgtatacacattcacagttcgggcagacactgccgctttattggctgttttgcgggccttaaggagttggggcacccagagtaaaatacctacgacacccacaattgcccatattcccaaagcaccgcgccagcccatacctccgttcagagccagcggtatgctcagcccggatgctgttgcagcaaccacattcatggatactgagtatacgccggtcatcagtccgctgttgcgaggaaactcctctttgatcagactgggcagcaacacattacacacggctatagccagtcccagcatggcagtcccgacaaataatgcggtcacccccagcgttgagcgcaccacaatacctgcggtcaacagcagcaaggctgcaaaaataataagagatgacccgaagcggcgcgacagtttggctacaaaaggcgacaacagggcaaaagccagcaacggcaatgtcgttaataggccactcagtgtattcgaaatatgcaaagaatccttaatcaaaccgataagaggtcctaccgaggtaatcgaggcgcgcagattggcacctaccagaatgatccctatggcaagcacccaaggaccggcatgccacaaagatttgtataccaaagctcgttggtgttgctgtgaactcatctctccattctcctatctatctgtgttatgctcaaaggctccaaccaagtgtacggctggagcctagcaatttttatctcattaaattataaaggcattcgtgccatatgcataggacggatcgaaacagcgctccaagtcttcaagttcagcatatagcttcattaaaaaataaaagctgcctgaaaggatagtttccttttgaggcagctttcagttcataaacttcgatgcgaccagcgctgcttaacgtaccagccagccgccgtccaccgccaagatatgaccgttcatgtagtcggaaccctgactagcgaggaaaaccacaactcccatcaaatcagacggatcgccccaacgacccgcaggaatacgcgacaagatttcttgattgcgactttcatccgcacggattggagctgtatttgccgtagcaatataacccggcgcaatcgcattaatctgaacgttatgaaccgccagctcattcgcaaatgccttggtcaaaccagctaccgcatgcttgctcgctgtatacggcggaacgaacttgccaccctgaaaagcaagcatagaagcgacattgataatcttcccgcttttttgctctaccatcacctttgccacttcctggctcaggtgatatacggcattcaggttaatctccataacagcgtcccaatcctcatctttatactccagcagaggggcgcgacgaatcgtacctgcattgtttacaaggatatcaattttaccgaattcattgacgcattcttctacaattttcttaatggattctttctctgtcagatcagcctgataaaaggcaaccttcacacccgttggctccagcaaacgtcttgtttcttcatattcatcattgttagctacaatgaacagatttgcacctgctttggccaaagctacggaatatccttgacccaaaccagtgttgcctcctgttacaatcgccgttttaccttttagactgaaaaaatccaatgaaaaattgtccagacccatgcctacgcctccatcacaaattagtataaaaacctataattcctgaagcctatagcgctgcgcgtacttccttatatttagctacataacgtgctgcattttctgtgatcaagtcgtagcgaccttccttggctggagccgtcaaattacccccaattcccacggctacacatccgttacgcagccaggtttccatattgtccagatcaacgccaccagttggcataatctgtacatgaggcattggacctctgacagccttaacaaagtccgcccccatcgcactgcctgggaacaacttcacgacatcgctacccaatttcatggcttccttaatctcattcagcgtcatacagccgggcatataaggaatcgcgtacaaattgcatagcttcgctgtttcttcttcaaaagaaggactcacgacaaactctgctccggctagaatagcaattcttgccgtcagtgactccagtaccgttcctgcaccaatcactgcccgatccttaaattcgtctctcaatcttcgaatgacctgatccgcatccggcgtcgtaaacgtaagctcaatattatccaagccgccttcaatgcaggctttagacattagatatgcttcctccgccgtgtttccccgaatgactgcgacgacacctactgaagtgatatgttccaaaactttctttttcgtcatgttcctgatcctttccacgaatgggatgaccatgtaccctcagccacttgcaggtccacgctccaatacactgattggattaacgcaactcgctcatggcaacctgatccatgtctttatatgttttattttcaccggccatgccccaaatgaaggtatagctgcccgtagccgcaccgcagtggatagaccaaggtggagaaataacggcttcatcatttttcatgaccagatggcgcgtttcgttcggttcacccatcaggtggaacattctcgcattctcatccagttcaaagtagaaatacacttccatacgacggtcatgaacatgtgtcggcatggagttccacacactgccgttctccaacgtcgtcatccccataaccaattggcaactttgaatgccttcatcatggataaagcgacgcaacgtacggttgttagctgtttcctgtgaacccagactttcagacggtacatcggcaaaagactgctgcgtcgtcggatacgtagtatgagccagggccgaaacgatataaaatttcgcaggcttttcactggaatcgctttcaaagaacaactccttggcccctctgcctacatagagacagtcttttgtgaccagctcgtaagtttcaccgtccaccttgaccgtaccgctgccgccgacattaaaaatgcccagttcgcggcgctccaggaaagtttctgctttgatttgatcgttaccttccagcgcaacagatttattcacgggataaatgcccccgataatgacacgatcttcatgcgtatagaccagctttacctcctcaggtacaaacagttcctggatcaaatagtgctgacgcaactcttcagtcgtaaaatgcttggcatgttcgggatgagttgaataacgcatttccataaaaacattcctcctgtttagataaacttttttatcaacggaattgttataaaagcggtttctaactctacttcttagctagaattgtaataattatctaagagggtgtcaacccaaaacttcactattcctagaaaaaaccttagtacatacgaagttttacacactttttaccttttgataaacaaaaccacatttttttatctgtattacctaaaaagtttttatccaatatatcaacttcatcattgtgaaaaaccgatttatgtgataatttcaatttattcagttggtgcatgcgcttacagattaagtttactaaacataaggaggaatacaaatgaccgcaacattggatgctgttaccttcggagaaccgatggccatgttttatgccaatgaagcaggctctctggatgaggtgcgttcattcaccaaagcgttggccggggcagagacgaatgtttcagccggtttggcgcgtttgggtctacgggcgggactcgtgactaaactcggcgaggatacgttcggcaagttcattgccagtgcgctacgtgaggaagggatcgacacacagaacgtcatgtttaccaaagaccactctaccggcatgctgattaaatccaaagttacaagtggggaccccgaggtggaatatttccgcaaacattccgccgcttctacattaagcatcgctgattttaacgaggcttacttttccggagctcgccatctgcattttacaggtatttctgtcgccctctcccctgagtgccgtgatttcgcacgtcatgcgcggcaatttatgaaaaaggctggtaaaaccgtatcctttgatccgaaccttagacctaagttatggcctgacacgaaaacgatggtggaggcgattaatgaggcatctgaggggtgcgactggcttctacccggcattcatgaaggtaaaatattaacaggctacacctcaccggaggatattgcttcgttctacctcgatcgcggcacctcgctggtcattatcaagctgggaaccgaaggcgcctattacaaatccgcagatgcggagggatatgtcaaacgtttccgcgtagatcatgtcgtggataccgtcggtgccggtgacggatttgccgcaggcgttatcagcgcgctgctggagggcttgcccctggcagaagcagtcaaacgcgggaatgccctcggcgcactggccgtcatgtcagccggagatatggacggctatccgacacgagccgagctggaatcctttttgctcagcgccagcacaaattagtcggggtttattccccgcataaccttcaccgctataagcgcaagctcaacaaggccgaatccaaagtcagccttaacttccaatagcccgtattcgcgtttgtacgatctgagcagcatacgcatactcagatcgtgcaaaggaatacgggctatttttataatatatgacacattgctcgtctacagcgttttgacggattctccccgattgatatccggcacaaatcggtaaataatcgggactgattcgccgccttcctcaatgctggacagcagtgtttttgctgcctgcttccccatatccgcaatgggttgtgtaatggtcgtaatcggcggattgtaaatatgggcaaactccgcatcgtcaatcccgataatggacagctctgccggaatacgtatacggcgggcattcacatactttaacacctcagccaacacgatatcattcccggccaacagcgcagtcggcggctccggcagttggaacagctccttcagcgtccgctggatttcttctctcggcacactgtgcatatattcttcacgagatggcaagccatgctcctccagcgcctttttgtatccgctaagccgctccactcgtggagtaatccgattcaggccaaggggcaaggtaatcagcgcaattcgctcatgcttgtgagccacaagttcctgaatcgccaacttaaccgccatttcgttatccagcagcagactgcgcgtattgacaccgtccaccaagcggtctaaaaacaccaatggatatttctcacgaatgagctggttgtaaatgtctgcatgcttgcctgtcgggaagatgatcaggccatccacctgccgagccttgagcatctcaatatactgaccctccttgtccgggttttcatcggcgttgcaaatgatcacctgaatgccaaaacgttgcaattcctcctcaatcgcacggatagactggatcgaaagggtatagtcaatgttggctacaatgacccccaccataaacgtccggttttgcttcaagctgcgggccagcccgttaggctgatagttcagctcttgaataacctcggcaatccggtctctggtctggtcgctcatatatttatatcgtttgttcagaaattgcgagacagtgcttttagacactcctgccttctgggcaacatcttcaatcgtcggcttcttcatcggtacactccttgtctttcatgtactgcgttagtgcaacaaaagtatatcttttttttagtaaatttaccacacttcaatttatgaatgccattatgatataagtcgaacttcaaagttgcctatcgtgccaccgtgtagaagtatggttctccagcagcaaaaagaaggcagttcaagatgttctcttgaactgcctccgcgtacacaactttatcgaaaagctaggttccagctggccctaaatgctgctcgacatcaatgtgccggaacgggcgttgcagactgatctggtgtatcgtgctcgaccagcgcatgcttttcccataatcggcttttccagcgagcatacatgatgacagcacgagtccattcatcagcagcaatggccagccacacacccgcgagtcccatatccagcttgaacacaagcaaatagccaagcggcaagctcatgcaaaccatggagatcagacccataaagaccgggaacttggcatctccagcagcacgcaacgagttaataatgacgatattcgtggtccgaccagtttctagcagaatgctaagtaaaatgacctgcgctcccaaacgaataatttcagggttttccgtgaacaaaccaagcaagggaacacggaaaaagatgaccaccgcatcaataatcacggtcacgagtagcgcccatttcacactggtcagtacacgtttataggcagtatccttctgtctggctcccacgagtcttcctaccacaatagccgtacccataccgactgccatactgaacaagtaaatatagcttgaaatattattcgcatattgacgtgtcgccattgcttctgcgcccagataagtcacgtacagtgtgaagatgagctgacacgactgatacataatggactccagcgcggatggtacaccaatgcgcaatattttagaaatgaattttttggacaattggacgtaatatttccactcgacacgaacctcagtgacccggtacatcagccagaagaagatcaggagacaaataaagcggctacctactgtagaaatagcagcaccttctactccaagtgcaggcatcccccaatgcccaaaaatcaaaacatagttgccgaccacgtggatcacgttcataaaaaccgatacatacattgtttctttggtaaaaccatgtgtacgaatagtcgccgccagcgcattaatcaatgcttgaagaaaaatggcacctccgacgatgctcatataagactccgcgtaagccagaatctcaccctggacattcagccattgcaacatgtgcgtaccaaatacgagaaaaattacgctaagcaaaagacctaccatcaaattcaacgtaatggccgtacctgtaacctgggccgcttcgactagtttcttagaaccgatatattgagctacgacgatagcagcgccgttgccgataacctccagtacaaggatagcaattgaaataatttgattggacgcgcccacacccgacaccgcattatcagatacagaactgatcatgaatgtgtcgacgctccccattagcataaacagaaacaattcaaggaaaataggccatgttaaacggaacaaattcagttccttagcttcggacaataccgaacctttttttagtgctctggttgtcattcattcacctttcttcatagatttatttaacgatcaaaaggtatgttagcacagtcattctgaaaatacatcccgtttacgtaaaatgatttgcaaaatgcgtaagaattcatttatcaccctctttataattgattatcgaactttattgaaacaggatattgcaagaatatatcagtagcctggtcttttcgacgcaattatgagctaaagagtataatagaatacgagcctgtgagcattgccgctgacaggttgtgaagattgttgtatgcttcctaagcataatttgtgaattaaagatggaatatataggatatccatagggttaaaaggtaataaaggaggcttttacagatgactcaatcatttcaagctcttgtcgtcgatcagacacaggacggtgaagttcaagcagaggtacgttctctggaagctagcagtttacctgctggagaagtattgattcgtgtcgcttattccagcatcaattataaagatgggcttgctgcccgcaaggatggcaatattgtcaaagcctatccgttcgtaccaggcatagattgctcgggaaccgtcgtctcttcggaggacagccgctttagcgaaggacaagcggtgctcgttaccggatatgggctgggtgtgtctcaattcgggggattcagccaatatgcacgtgtgcctgcggactgggtggttccacttccaaacggactcacgccgagagaggcaatgattttcgggacagccggattcaccgcagccctgtcgttatatcgactggaacaaaacggcgttactcccgagcagggcaaggtactcgtcaccggagcgacgggcggcgtaggcggggcagccattgccttgctgaacaagaggggctatcatgtggtagccagcagtggtaaagccgatgcgcatgattacctcaaggcgctcggagcagccgaggttatttcccgcgaggaggtctacgacggtgcggagagcgtccgcccgctgggcaagcagctttggcaagcggctgttgatcctgtaggcggaaagccgctcgcttcgctgctcagccagatcgcctacaacggctccgttgccgtgagcggcctgacggcaggcaccaagctgcctacgacggtgctgccgtttattttgcgcggcgtaagtctgctgggcatagactctgtcttctgcccatacgacacccgcgtagcgatctggaagcggctcggcagcgaatggaagccggaacagctggagcagctcgttgagcgcgaagtcggattggccgacctgccaagcgcgctcgaagacatccttgcagcccgctcgcaaggaagaacgctagtacggctggttgactaagcggcgtagtccgcaagctatccattggcgtgttttcgcgtgaagaagtgtcatcccttagggtctagcttaggaacatgtaagaagcctgtaaatctgcaattttgagatttacaggcttctttttttcgtgtggtacatttgaagcagacggtttactttcgcaaccaaatgaaccttttgagaacctcagttgttatatagataaactgcacgagaaaggagagcacctcattggagagcaatcgagagttgtttgatttgtatcaacgagatgtataccgaacctgctactacatggtacataatgcatcggatgcagaggatttaacgcaggaagtgtttatcatcctgtttcgcagcaatcgtgaacagatcgaacaactaaaagcctggattatgaagattacggtcaatcattgtctgaattaccttaaacgccagaaaagcctgcatttgaaggtatcggctaatccctatctatttaacggggcggaaggtaaacctgtagacaggctggtggaagaacgcgaatcggcagaggaatgggccgtttatatgaatcgccttccggccaaaatccgcgctgtgctgacactccgctatatgcatgattttacgctggcggaaatatcaaagctgctggaaattccgctgggaaccgtcaaatcgaggactcacaaaggactaaagttattggagcaaatattgcgggatgcaggggtacaaattcccgagatggaaggagagaactatgaacaacatagaaaaggcattgaagcgcaagttaaatgatgattcggaaatggcctatcctgacttcggtgagatgtggaaccggatggaacagacagggcatactgcccctacgctaaccgacacttccgattcattcactccccaccgacacagaaactggcgcaaaatagctattgccgcctctctaagcgcacttctggttgcagttcctgtctatgccgccatccactacaactgggacaatctgctacgcggaagaagtggcatccagacagcattaaagcaaaacctcgggcaaccgctggagcagtccgtgaccagagacggagtgaagctaacgctgcatacagctattgtcgatgagaaccggaccgtgattctgtacagcttggaggtcggaaaacgagcagacaacgagttttggaatgtcaaaggcgtatcgctaaaaagtgctgcgggggaaagcagtgcaggggaatataacttccagcaatgggacccgaaaaatcaacggtacaacgggtactttgaaagtgattggacaccgcagcaagaaacagagaacgtgcagctgaccatagatcatatagagctcaccagcgttcaggaactggatttgccgctcgatattcggtcgcctcaaatacagacgttcaagctggatcgtagcggcttacaagatatgaaggtacaggtattcgaacaaggtaaggacaaactgatgctgtcctcagcgattaccttcgattcgtccataccaaagagatgggacaatccacaaattattgcctacaaaggcgacgagcctgtgatgtcgcagcctggaggggcttttggcaaacccggtgataacggggagtataccgcacaacaatattttactaaagcagatataccggaaggacagactgctttcaaactgcaatatgcacaaactgagaaaagtatacatgaacccataaactttgatctgcagctaagcaagaagaaaatggaaagcgggacgattaaaagcgtactgaacactccattggagaacggcaatccgaattttacgctagaacaaatgattgtcacacctacacaaatccgtgtcacaatcagaagcgaaaagaaattcgccatgttaccttatcaaaagtactttctttctgtgaacggcacaacattagaaggtagtcgttggtcttcacctgatcaggaacacgatctgaacacgatccgttttgaacgaccttccaatcttgtgattaccaaggacactcctattacttttacaggcaaatacaaggttacgacccattcggatgacaaaacgccacagcgtttaactgatatttctgagcaaaaacagacactaacgacgcaagtcggtggctatcctgtgaagtggacctactacaaacaaggatcagacttattcgtagaaaccgaaagcgaggatgctcactttggagggattaaccagacgcatattggcctgggtaaagaacggattatcggcaagccgatcacagccaatttttccggagacggcaataacaaagcagtggatgtctacaagaacttcaaagggaaggaagcttctatctatatgttctactatacaacggacgacccggaagcagagacaaccgtacccttgcagcctctgacaagcaacagcgaagcatccaaatagcaatgctataaaaagagggtcctctatacctgtgtgaaccgtggtataggggacccctttttattttcctaggaaggcacattctgcctgaaacgattgactcccgtcctactttacagaaccttgcgtaacgccattgatgatccatttttgtgcaatcagatagacaataatcatcggcagcaaggccattagatacgaggcaaaggccaaattgaagtcggtattgaactgcccctgaaatacatactggacgagcggtagcgtatattgctccgcatcgctaataataatgagcggcagcaggaagtcgttatatgtggacagacaagtgagaattcccaccgtagcactaatcggcgccatcagcgggaatataatgcgccaaaaagtaccccatgtcgtcgcaccatctaccgtggccgcctcttccaatgccaccggaatggagcgaatataaccgacatacacgaaaacattaaacgccaaaccatacaccgtatgcagcataatgagacccaacagattagtcatatgaaggcccgaggccagttttacaatcggcagcatgatgatcgggaacggaataaacatggcgctcacaaagtaaaaatataatcccttaaaaaagcgtcgctgcatattacgggcaatcgcataagcgaccatcgaattggttagcaaagttaatacgaccgtcgatgtcgtgaccatcacactgttctgaaaagcgctgaagaagttggtcatttctacggcacgactaaaattttcccaatgcagctcggtcggaaaggcaaaggcggaatgcgccatctgttcgggatttttaagtgctatcgttaccgtcatatagagaggaaacaggataaatattgtccccaacgctactagaagcagcacaggccagttggtacgtctgcttgttttcatcagttatccatctcccttctctggaggaatcgcagctgtaagatggaaatgatcgcgatcacaataaagtaaataacagagttagccgactgataagcaaattctccgcctctaaatcccccggtgtatatcaggtgggaaatcgactgggtggcccgtcccggcccgccattcgtcaaagccacgatctgatcgaacaccatcagggaatttttcatcgccaataccatattaatcgtgaaaaacggagcaattaacggaaaagtaatgctccagaattcgcgccatttacccgcaccgtctaggttggacgcctcatacagacttgtcggaatggtttgcagcccggccagatagagaatcgtattaaaggcaatcccctgccatacagctacgatgacaacccccacccaagccagttgttcgctgcccaaaatgttcgtcgacaatgaggtaatacctaaattttgcccccaaatcgtaaacacgttcgagaacaagtaattgaatatgtaacccacgatcaacacgctcaaaatattaggcagaaaataaataccgcggaaaaagttacgaaaccgtattttagcattcagccctagcgcaatcagcaaactaaggatattagtcgcaatggtaaccacaatcgcaaatttgaaagtaaaccagtatgcgttccccacattgtcgtcctgaaacaaattaatatagttcttaaacccgacaaagtgatactgatgaccaaagccgttccagtttgtaagcgaataataaaagccctgcaaggcaggcaaggtcaaaaatacaaaaaacaatagcaccgccggcaccgtcatccagtaaaaagtcgttagtcgcttattcatgtctcctcctcctctcctatcggcggttagctaccttattccattcacggtcgagcttagctagataggcgtcgatgtctctgttttgcaggaaggcctgcacaatcgaattcaattggaccgccttgggaatatagtgatcggcaaaatcaacgacgcggcccgatttaaaatacggcaatagctctgccacactcggatcatcctgcgtgactcccttcaccgccgaaaacagcgtttgctctgtaatgtattgcttgctgttctccggcttcaacaagaaggcaatgaactcctcggcttcctttttatgcggagtgctctccgatacggctaatagcgtatctataccggacaccagcttgactgccttttcgtcattccctgttggtaatgggaaaaatccaagctccactttcggattggctttgcgaatttcagatatggcccacgagccctgaatgtacatcaatccctgcccgttagcgaaggcacggttaccgtcggcatagtttttgccaaaattatcaccatgtccgtatttcagtagctccagctgcttttccgcaacctcgcggtacttgtcctgaaaagtgacctgattttcacgcctttgcaggaaaaaatcaatgcccaccagattcgggcccagcgcattaaaggggaggttcgtttgccaatcatctttatatgtaaaatagaacgggatttttccagcagctttgatcttttgcgccgttgcaatcagctcatcccacgttttgggcacccgtaatcccatttccttaaaaagcgttttgttatacatcacaccattcgcattcgcagcataaggaattccatacacgggatcgaccccggttacatccttaagcattttgaggtaaatcgggtcaatcgtacgtggcaattctgtattcgccaggtccgtaaaaatatcactttgcgccaaaatggagtaggtatcggtggccccaagccctacaatgtcaggtacatcgtttttgacaacccgggtcaataacacagtctctgcctctggcgggttgacctgtgtcacttcaataccgggatgttcctgattgaattgagagattagcttatcgaatgaacccttggcctccggcttgttttgaaaaaactcaattttcaccttacccgaagcatcgcccttgttgcatgcgcttacaaaaaaagccaataaaaggatcgccgccagtgtagacagctttttgacccaacaccacatgctcatacctccttttcccctatgtcaatctatgcgggactagacaattaatacccgtcccttatggaaaagaaacgatactgctacaacaatctgataacaggaggaaccaatgttaaaaaagatccaattgaccctcaaacggtcggttggatctttcttttacttttatgatgttcaggttacaagtcttatttctaaacaatctttttttcccatcgtgtaaaactaataatgatacttaccagaatcaatccacctgcacacatccaaaaattaaaagaactgtctactcttaaagcaagcattatttgctgaaatgggtccattaacataatgaggggcctaaacaactcaaagagaaatacggataagataagaatcactatataagcaaacagtggccgtgacatgaacaaacatacagcgctactcaacatgagctttaccaagcaaaccagcgttaataccaaataaaacgaaagtatgtagggtacggcatctgaaggggaagaggcgacggatgaaccatatttaaaaaaagtagagctgtgtgggaaaaacaaccatccagcgaatacacctataagcaagcttgtccccataaaaatggccgttgaggctgatagtgcgagcaacttggcaagccaaaaatgaaaacgtcgatacggtcgtagcatatatagcctatatgctccagaatagagatcgccgcttaactgatccacgtacagagtgggcaggattgctgtaactagaaataaggcaacctcactcatcatcagccacggcaggttcagattatttacgaccacagtcccttcaccaaaacgtaagaccttcgtacccgttactttatggctccatataattgcaaccacgatgaatatataggctatatataataaaagagtggatttgcgattccaaattcgttccatttcacttcgccagattgccagcatgaggaaatcccccctaatacagataatcatcagtcacaaaacggcggtatgcgccccaagtaaacaagataagatatagactaacaacggtgataatcgccccattcacagacgaattgcccattaaggacctatctaatcctgtatgctgcatatatggaataatcataaatgcgatcacattgtataggtatggggtatgggaaacaaaagaggccaattttaaatatagtgaatcaaacaacagagaacccagattgtataccatacaaacaccgatggcatacgttacacttttgctatacatagcgacgaaacaatagaaggagcatattgctaataatgaggcaagcgcccaaccatagtatttaagcatctgcagtccttgagattcggacaaccccgcatcacttacatcatatgaaagagtccatacttcaacgatcacctgcgatgatactgcaaatacaatgagaagaaacaaaatagtagcatttaaaaccagcagtttactccagaaaatctgcccgcgggtaaatcggcgcataaataacaaccgcagttgcccgcttcgaaattcctctgtgtatacagcagcagctaaagcagctacagctatgttgcatactaaaaacaaattctcacgcagaccagtaacgacaaagtttaaagataatacctcaacaggaaccttcatcgtgcgcaaaaaatatactcctgtcgaacaagcaagcagcggcgtacataacaccatgagccagaaccactttcgtctccataatcgctcgaactcactgtatattaatgatttcatagtcccatcaatcccatgaaagcatcctctagccgttggccgtcctctactagttgatcagcaggtccctgccaaactagcctgccctctttgataacaatgagttcgtcacacatctgttgcagttcatccaacagatgactggatataaaaaaggcataattcgctgaatcacgtagctgaagcacgatatctctcagctcccgcattcccataggatcaagcccattagacggttcatccagcaataaaagctcaggagcacccagcatggactgcgcaatacctagcctttgcttcattcccagcgaataggttttcaccttgtcatctccccgtgtttccagtctcacctttgtaagcaactcttcaatatgtatctcccgatctgagggcacaatctcagagtgtaaccgtgacaaattgcgcaaaacctgtctgcctgtcatataatcaaaaaagaccggagattcaatgatagcccccaccttggacagcgccttttcccgatccgtctgtacatcatatgaagctatctttacagagccgctggttggctgcattaatccggtcatgattcgtatcattgtagttttaccagctccattaggtccgatgaatccatatatcttccctttctgaagcttaaaggaaacacggtctaacaaatgccttttccccattcttttcgttacctgactgacctccagtaaggagtctgacatactattccctccatccataacaaatcacaacaaagttccaacgcgtgcatttgatatgtaagatcatgatggacaacacagacttctcttaacaatgaaacatattatttattcaatttaaaaaatatcacatgttgcgaaatgcaaacaactttctttatatgtaaaatataataataacgatacatcaattccatttatcttaattaatggtcattaattttcgtgatgatctctttgtctttacactgcaaaaaaggtagcccttcagtaaatgttctacctcagggctaccctctatataaaataaactattttctatccagtaactactaacctgtcacctactccagttcaacccactcgccaagcaatacatccagctccgcttgcagtctctcacgcgcgtcccacagctccgccatgtgtatcgtgtcgccgcttgtgccgagcagctccagctcggcatccgccgccgccaattctgcttctttggcggcgatggcccgctccaaccgctcgctggatgcagcgggcgtgcgtgatggcttcgcggccttcgcttcgcgtgccccagacccggcagcgggcgagcccaagcgacctgagcgtgcacggctcgcatcggctcccgtagtcgctcccatatgcgcagccgcccccatgccattgctcgctgcactggaatgtacaactgtgcccgagccagagccgccacccgatgcggctctgcttgcagatgtcgggcgtgtcccggtatccccgtcgctctgtagacgagcgttctccagctcacgcttcttcgctcggtactcatcaaagctgcctagataaaaggtcagctttccagcctctagctcccacacgcgccctgccagcttgttaacaaagtagcggtcatgtgaaatcgccagcaccgttcccgtgtaggtgtccagcgcttcctccagtgcctcgcgtgagtcaatatccaggtggttcgtcggctcatccagcaccaacaaatttggctttttcatgaccagcaacgccagccgcaagcgggaccattcgccaccggacagcatgctcacgggcttaaacacatcggcaccgtaaaataaatacttcgctagcaacccgcgtgcctcgccttcttccacccctgcttcctccttgaagtaagcaagcacagttgcccggctattccgttctctttcttgctgcgccaaatatccgtactccacgcgcgcaccccactggaccgtgcctgcatctgcgctttcctgaccaagcagcagcttgagcaacgtcgttttgcctgacccattatcacccagcaaggccaccttttcgccgaattccagactgcccgttgccccgtttaatatctggcgctctccataggctttaacaatttcttcaaactggagcacccggcgaccggaacgatcctccagctttaagtgaaattccgccccctgcgggtccaatacaggccgcttcaccagttccatgcgctccaacgccttacgaatggaggctgcttttttgaaaaacttttcgttatcgccattgcgaccccactcttcaaaacgccgaatggcctctttcatctttttgatccgcttttgctgttccttataatcttcaaattgtagtagcaatcgttcttccttttccttcacatagccgctgtagttcgtgtaatacgtaaacgcctcgccatcctcaagctcaatcattttaacggcgacccgatccagaaaataacgatcatgagatacaaccacacacgcacctgtatagccctgcaaaaattgctccagccactccagccctttcaaatccagatggttggtcggctcatccagcagcagcaaatccggtcgtccgatgagctgtgatgccagcgctatttttgttttctctccacccgacagcgagccgaagctgcgcgtatacatgcctttgggaatacgcagcccatccgctacctggtcaatgtttgcatccatttcatagccgccattgcgttcaaaccgttcctgcaaggcagcatacgattgcagtagcttctccagaaggctcgcatccgctgccacaaccggatctgacatttcccgttccagtgtggtcatctgattgcggcaatccttcagctcacgataggcgtaagccagcgtttcgtacacggtgaagctctcaaactccgccggaatttgcggtaaatagccgattttcgtatccttggcgatgacgagctgcccttcatctgggcgggacaaacgtgcaattaagcgtaatagggtggttttaccgcttccgttgcggccgatgagccccaccttttctcccgtatggatatcaaacgatgcaccatccaaaatcagattggcagcgtggtattttttcaattgttgaccgtttactatatacatgttcaggctctcctttatttaggaagacccttacccgggtaacacaaaaagagccgcaggagcaaccccgcgactcttcggaagatacagaaatccgttcgagttaaggtaggcgtcttctcgcgatgtttacaaccgtatgattaaaattggacagacttctcccgttgtatggaaaagcatgaacaatgccagccatagcaatcggcagctggctaatacggttgttcagcatctcgtgattcacctacctcacctccttcttcataattgtgtgtagtataacatgtttgctcgtattatgaaagaggacgatggtccatcgagctatgaaacagagtggtgtcctctgacagcctgcgaagtcccggctctggtaatcgaaaatacgccgcagacaaaagcaacaatcacaaatgccccacctacccaagcgttcgtggcaacagattcactattctcaatcactactccccccaaggcagaaccgagagcgatcccgacctggagcgcggagaaattaaagctttgctgaatactacccgattcgggtgcattttcaataagataactttgcatcgggggcgacaaggcccaactcagtatgccccagataatcagtagcggcgcaaatacataaatcgagtgaattgagaatggcagcaagaacatcacggcgataaacacgcctacgacgactagaatacttttcgctgtgccgaaccgatctgccaaagagccgccaataaaaccaccgctcactgccgccagcccaaagacaaaataggccacactaacccatgaagcgttcaagcccatcatattttctaaaaacggagtgaaatacgcatataacgtgtaatggcccgccagtgtcagcgtggtcaccaaatgagcactgatgactttaacattttttaaagatttcaactgatcacgcataggtacaacatgttctgtcggaatccgctccataaacaagttgataacgatcatagcaacgaccgtcaataaagcaatgatcaggaaaagcacccgccagccaaatgcatttccaatcagcaccccggctggaatacctagaacgatggaggagctaacccccatggagatgacaccgaggacacgggcctgataagccttggacaccactttgactgcaatggtcagtgacaatgtcacgatcagcgacccgcttgcagcggtaatgatacgggatacaaacaagactgcataattcggactccagaaggccagcagacttcccagaataaaaataaacatcgaccacaggtacagtcgttttcgttcaattttggctgtcaacgccaacagagttggcccagcaatagcatacacgagcgcatagatcatgataagctgtcctgccgtgcttacggagacattcaaatcctgtgcaatttggggtagcacgccaccgataatcagctccaccaaccccaccgtaaaggtcgcaatcgttaaaataactactttgaagttcattacattagctcctttgctgtcatgtaaattccctcgtattacgcaaaaaaatcctgaccacaagaaatgtacaagacgtacactttttgtaatcaggatttatcggttcctggtagagaccctcaaaccatattattgaggttatacaaatggggcattcatttattacgcattcacgaaggttatagctattactataaaggagcctgtggctaagttcaaccccctacagccgcaaaaattcgctcatagcatgatctgacagataaggtaggtactcatgaccgtattcgtgatacaggagtatttccttgtctgatacgattttattgtacaccgcaaactgcgtggaaggcggacagatgatgtccgacagtcctgtcacaaacaacacacgaccacgaatacgatctgccaaatgttgaatatcaatgtagcctagtcggtgaaagagctcctcctcgcgcagatggttcggatcaaaccaacgaaaataataaaccagttcttcatatgcagatgtagtggcatccagcatccaggctcttttatagtccgacagaaacggatataccggaactgccatacggacacgcggctccaatgcagcgcaggcaaccgtcaaggcccctccctgggagcagccaaatgcgccgatccgttcagggtcgacctgctccatagacatcagaatgcgcaccgtctgtaccgtatccaaaaatacattgcggtaatacaaccgatccgggtccgggtcgtcaatccctcggatgatatggccgcgtaccgtcgttccctgaacctgcaaattgtcctcggacagcccaccttgtccccggcaatccatggccagcacagtgaatccgtgtgccgcatagcttaccttgtcgaaccagtcgccactgtcgcaggaatatccatgaaacatggccaaagctggcccttgttccgtaaggtgcttgggacgagccagcttcccatgaacctttgctccgcccactccagtaaaatatagatggtaacactccaccatcggagagacaaaattagcaggctccagtgtataatcaagcggctgccgctccagctcctgtaatgcccgttcccagtatgcgtcaaaatccggtggcttcgggttactccccatatatgactgcaattgctgtaaagacatatcctccggcattcaagttcctcctacatccggcctgactcacggtcgtctgcgaccacttcatccgttgcgatgacatacttcataatgtcggacactgtcgtgtatgcaatacctacatacgtgtcagcggctccataataaatcgcaatccgcccggtgtccgcatcatgcagcgtagcacacgggaacaccacattcggcacaaaaccccgttcttcgtaccattcctccggagtcagcacgaaattagaggaacgatatttaactttagacggatcatccaggtcaagaacggctacgcccatactgtaaaccagcccattgcacgtgcctgtcaccccgtggtagaacatcagccagccctctgtcgtctcaatcggagccggtccgccgccaatctttaccgattgccaccagccctgtccgcccttgctcatgacatgacggtgcttgccccaatagaccaagtcaggactttcactcagaaaaatgtcgccaaacggtgtatgtccgctgtcgctcggacgggatagcaacataaagtttccgtttagcttgcggggcaacagcacaccattacgattaaacggcaggaacggattttccaatcgtacaaagcttttaaaatccttcgtttgtgctatccccaatgctgcaccgtaaaaatctgtacaccagatgatataatacgtgtcctccacgcgaaccagacgcggatcgtaagcataatttggctgataatctttcccttcctcatcaaccaaatgcaaacgttctgtctcaatgtcccaagccaagccgtcgtcactccagcctaggtgcaaatgcggacgtccattaatcgtttcagcccgaaatacccctacaaaccgtccctcatacggagctactgcactgttgaaaatacgggcaatgcccggtaccggattccgtccaatgaccggattctcactatgtctccataccggagcctcactgccttcaggcttatcctgccacggcatttccggcagactacctcccacaattcgtacgctatctactcccaaatccacattcaatttattcatacgtgtattcccctctcaccgagatatttgattcaccaaattttctatttcgccattgttctatttcaccgaaccctgcgcgaaaccgttatagatatatttttgtaatgataaaaacgcaatcagcgtcggaataatggcaatgattatgcccgcgctaatgacttcccattgcgagccatatggccctttaaacttgaacagcgccgtcgatatgacctgaaggcttgttttgggcatatacaggaacggggtgtaaaagtcgttgtaaatattaacgcccttgataatgatcaccgtcacaatggcaggcttcagcaggggcaagataatgcgccagtagatcgtcagataggaggccccatccagcatggccgattcatccagcgccaccgcgatggaatccagaaattgcagaaaaatatacaccgcaataatatccgttcccaaatacagcaagatcgccgcccaaggcgtgttaaacagctccagcttgttgattatttggaatgtcgacacctgtgtcgtcacccccggaatgagcgtggcgagcaagaacgcacccagcatgagacttttgcccttaaatttaaaacggttcaaaatatacgcgatcatggaaccggtcaacgtagctccgatgatcgaaatcaacaggataaaagctgtgtttacaaatccggtcagcatatttccgttgataaaggctttggtatagttagcccaattcagccagtttacggggggagtcagaggactggttgccgcatattcagccttcgtcttcaaagatgcaaacaaaattacgacaatcggtagcagtgcaatgaacgcacctagtagtagcgcggcatacttgatgctgctacccagtattcttttcagcttatacatgattagtcctcctctccccgaattagcaaccgttgaagcagcgtaacagcaatcacgatcagcagcagaacgaccgccatcgctgaggccaaaccgaccttgctgtatttgaatgccacatcaagcgtctgaatgacgaatgtttcactgccgttggagccaccggtcataatatacgggatgtcgaacgcactgatcgccccgctaatcgccaagatgagattcaactgcaaaatccgcttgatactcggcaaaataatagagcggaattgatgccagcggttagccccgtctatatcagacgcttcatacagatcactggatatggaggaaatcgcaccgagaaacacgataaagttaaagcccatgtatctccagatcgacgtgccagccagtgaaatattgataatctccggattgcccagccacagcttgacatacgaacccagccccatcgcctgaagcagtgtatcaagggtaccgtctggcttaaaaaagaatagaaaaataaaaccaatagctaccccgttcatcagggaaggaaaaaacaaaacgcctttaaagaaatttttaaaccaggtttgaaagctaagaatggttgcaaaataaagggccagccccatctgtacaaaggtggctacaaagtaatacagactgactttaaacaccgagaaatactcggggtcggtaaagattttgatatagttttcaaagcccacatattccagacgcttactataaccgttccagtccgaaaagctgtacttaaacatattgatcactggcaagtacgcaaaagtgatcagcagcgctagcggaataaacgaaaaggcaacaataatcgccaatctttgtttggagtagctgagattcgaaaattttaacatgctgcacctcctggctgtccgtccatctactattacgtcgatcctttcttttcgtcagttcagatggctattttgcttcctttgcagccacttcagcacgcgccttcacccatgcgtcgttcagatccttcataatggtgtcatacgattccgggcggttaccgactgctgcctcaataatgcgttttttgaagtcaggctgccacaagccgatttctccctttttgtcgattttatcgacaatcccttcctgtccttttggagatggagtaagcgtttcaaaaacgactccctgatcttcgtattgcttcaaaatgctaggcattggggcacccttcagcggactaatgctacctgcctgctctacggcatagttggacttttcggtaaaccaatccacccaggcacgggccgccggtttattttcactgtttacgttaataccgaggttaaaatcaccagccagaggcacaagcaccttggaggcattcgtcgggaaaggcataaaaccgatatcatccttgttagaagctgtgcttttgatctggtcaatcgcccaagagccaagcaccatcgtaccgattttgccttgagcgagatccgccttggaggtctcccaatctgtagtcgttggatctttttcaatcaggccttttttagccgcatcgtacagtaccttatacagttcatagtggggctggcccttcgtgaaattgtcatctgtattcggttgtgtgacattcacatattcctttgtacccgccaatgttgccagactagactcccactgggtcagtgcccaaccagaggcatagttcgtaaacagcggcactgccttggttttgtccttaatctgctgtaacgctgtcaggaattggtccggtgttttgggaagctgcgtgattcctgcgtccttgaacacctttttgttataaatcacaccagagtaaaccatcgcaattggaataccgtagctgttatgatccaccgtacgttcttcaaggccggtatacttgtttttcatctcctcataagtacccagcggctcgaaaaagttgggcagctcttcaactggaatactgccaggaatcagcaaaacatctccataatccctggtccccatccggattttaatttgaccctcataatcggccaatgcctgaaaattgaccttcacgttcggataaagtttgttaaattccttggcgtaatcctgaaatacggtatccacaatatcagtccgctgtgtgataaccgtaatttcaccttccacacccttcggatcagagctggcagctggctcatccttctttgaggtacagccagtaaacagccccgctaacaaaaccacggatagtaatgacatcaaaaccttggacaacttcatgagacgactcctcctgttgttttcaaataaggttatcgttaaagtaacaaaatcattttattatgttagcgcttactgtgtcaattacaatattctttttgtaaagtggaatgggtcacatcttatgaaaaaacaccaatttagcatggttgacagtttacaaacagctagatatgatactactgtaaagttaacgataacttaataatttattttccgaaggaggctttgtctcttggaaacattactggacgaaattagacaggaatggaaggaacacatactcccattctggcttggactgaaggatgagacacacggtgggttttacggcgaggtggacgtggatctgcacattcataaccaagccgacaaaggagggattgccactgcacggctactctggtcattctcggcggctgcccgtgtaacaggggaagatacctatgcagaagccgcacgacattcattcacattcctgcgagatcacctgcttgatccattacatggaggaatgtactggatggtggactacaccgggcaacccgtggacacgtgcaagcatgtatacgcgcaggcattcgcgatctatgcgctggcagagtatgcacgagccacggacgacccgaatgcattaccactagctatgaagctgttccacctgctggagcaaaaaggatatgatcccacccggcaggcatacggcgaacaatatgaccgcttgtggaacacgcagcctaatgagttactcagcgaaaatggcgtcaccgcgcatatcaccatgaatacgcatattcatgttttggaggcgtacacccaattgctgcgcgtctggccaaatgaagaggttcgagatgcactgacgaacgtactggatattttatatcatcgtgtttacgatgcctctgcccgacgactgggggtatttttcgaccgtgaatggcgctctctgcttgacctgacctcatatggtcacgacatcgaagccagctggttgattgaggacgctatgagtgtgctgggtttttacccgtcagaatacgtggatatggtgatggatattgccgatgcggtagcagagcgcgctgttcagccagacggctcgctcatcaatgagcgggaaggagagcggatagacacctcacgtatctggtgggtgcaggccgagggaatggttggtttttataatgcgtttcaacgtacaaaagacgaacgttttttgcaaattgtgaaaaatctatggtcctatacccggcaacatatcatcgatccgcgccccggaggcgaatggttctggtcagttcaagcggatggtaagcctgacgcgaaagagattgcaggaccctggaagtgcccttatcacaacagccgattttgcatagaaatgctagaaaggatggaagaccaatgatccatagcaaatataatgagctgcggttgcagcaagaggaactgattacacgccccaatgaggttaaaactaccttttataatggtatctacgaacgctacatctacccagtgctcacacgccatcatgttccacttcactggcggttcgatctggatgcgcaaaccaatccctttttcatggagcggctgggtgtaaatgcggcattgaatccaggggcgatctatcatgaaggaaaatacattcttgtttcgcgtaccgagggactggatcgaaagtcatttttcgctttggcagagagcgataacggcattgatcaatttcggttcattgacgctcccctcgtatgggaggatatcgacccggaagaaacaaatatgtacgatatgcgattggtaaagcatgaagacggctggatttacggtatttattgctcggaaaaaaaggaccctgacgcaccaccccacgatacctccagtgctgtcgctcaggccggactggtccgcactcgtgatcttcgtacatggacccggcttcccaacatcactacccagtccccacagcagcgcaacgttgtcctgcaccctgaatttgtggacggtcaatatgccttctatactcgtccccaggacgggtttatttccaccggttcaggcggaggcatcgccttcggcctgtgcaaagatattacacaacccgtgattgaacacgaaaccgtcattgatgagcgttgttatcatacggtgtacgaagccaagaacggacaggggcctgccccgatcaaaaccagtcgcggctggattcatatcgctcacggggtacgcaatacagccgccggactacggtatgtgctgtatacctttgccaccagtctggaagaccctacgcgcgtcatcgccaagcccggtggacactttctggctccttatgatgaggaacgcgtgggcgacgtttcgaatgttattttttgcaacggggctgttgttaacgagcaagatgaagtctttatttactacgcatccagtgatacccgtatccacgtagcgacgaccaccatcgctcgactggaggactacaccttcaatacaccatccgatcccttgcgctctctcggcagcgccgctgttcgccgcgagctaattcatcacaatgaagcgctattgcaagcacactcccctccttcccagcggacataagccgcaggctttatcctgcttgcggaaccatgtatactatccatagaacaactgttacccgcaggctaatagttgttctatgggcagctacgctgctaagttttttggattttacaggcagctaagctactgatatattccccagcattttgcatccattctctggattaggcaaaatgcttatctttttaaaattggaaggcggaacaggaatgaagagcaacgttacgatgcgggatattgcagataagctgggagtaagcagcgtgaccgtgtcgaaggcgctcaatgacaaggatggggttagcgaggagctaaaagagcgtattaagacgctcgcgggcgaaatgggttatcgtttcaataccgttgccaagtccatgaaggagggcctcacctataacataggtgttgtcattcctgaacgttttactggccccggccaatcgttttatctgcacatctaccagcaaatttcacgagcactggagccatacggctactatggcattcttcacatccttcatcgcgaagacgaagaacagcttaatctgccacgtatctattacgaccgcaaggtggacggcttcattctcctgggtcaagtgagcaagccatatatcgagctggtacaaaccatggatctacccaaaatgtttctcgatttttatgatgaacatgccgatatcgactccgtggtgacggataatttctacggagcctatgagctgaccaactatttgatcgcccaggggcatcgtgatattgcatatgtaggcaatatctattccaccagtagtattcaggatcgtttcctcggctactataaatccttgctggagcacagactgcccctccgtaacgagtgggtgctcagtgaccgggacgacgaaggtgcttttgttgaaatggagctgcctcagccgctaccgactgcctttgtatgtaactgcgatcaggtcgctcacaatctggtacacaagctcattggtctgggataccgcgtgcctgaggactgctctgtggtcggatttgacaacgatgtatacgccactcttattgttccgcaactgaccacagtcggcgtagacatcgagcagatggcacgtactgcgattgattcgatgatgaaaaaaataagtcatcccggcggccgctttggtcgagtcctcgtacagggtcatattgtatatcgtgattccgtacagcccatccagagaccatgatcaacacacactttacttggggacaggtcacccctaccccaatattccacaatcaaaagccgctcagcatgtcgctggagcggcttttgacgttcataaattctgcagtatgatctcgtactcactttcaatggtggattttgcaaaatcctggattaggagcgctgggcgacaaaggaattgcccgcccgattgagaatcggcagcatccgcatttcctgccccattgaggcttggcaaaatggacaagctggctcgttcaaaaaggtgaaatccgttcgcatccaaccgttgcaaccctcgtttgtacacgaccaaatagccgtattttcctctggaatgatttccggggcctggcgtctgtacatctatatcccccctcggtttttatagggtaatatcccctgtcggcttactgttaattcccacctgtgcgggtattaatatgctccaacctccaaaaaatatgcgcaatttaccaaaatgtttatttacggatagccttagtccagaagccgccatgaaactgcttcggctctaccgtaatgacaaaagccttagggtccagctccagaatggactgatacagcttattctgattttttcgtttagccaaaatttccattaccaggcgctctccatcacgtccactgcccagccaggctgtaacgccgtatcctttgtcccgcagcgcattggcaattcctccattgatctcattgctgatcaccttaacggtgacataaccgagcgctattttttcctcaatccatgctccaataagaatgcccaatgcatagccaatggcgtatactgcaagacttgccacttgatccaggtacttaagcacaacattcaagcccaatacatagaccgtaacttccacggtgctaatgagcgcagcaatgtacttctgtcctttcagcgtcagaatcatgcgcagtgtatacgccgatacgtaaataatttgaatcacgagaataaacaataaaattttgagcatgcgctcactccccacttcacgttctgatttaatccgtatccaacattatacccccgtctgtgatatacagcctctggtttcgtattaccctcgctcgggtaatgactaactacagcatgctgaatgaaagttcgatcacataaggagggctataacatgaaggataacggaactagcgataaaatcaaaggtaatgtgaacaaagccaaaggtgaaatcaaggaccaaatcgggaacgctaccgataataagtcccttcaagccgaaggcaaactggataaggccaaaggccatcttcaggaaacagcaggcaaactgaaggacggcaaataatccaactcttgagactgtgatggattgtcctacaaacaagtttcgctgtcttgtgcagcgggcttgtttaatttttgttcggatacttttggaaaaatattttcgcaaacagggcaacttttgcaggcacctttgcgtctaactaatataggcacaaccaataacaacccttccaacctgttggattttgcatgtattaatgttactctagtctatgtatcacgctataattcttaaataaaggggtagaccgacgaatgaaatcattgaagtccatgaagaaacctgtcatcattactgccgtatcggccttggccatctccggggctctgttcagccaatctacatatgctgcacaagtaactaagccgatccaagcagtatataacaatattaaaattatctacaacggaaccgaggttcctgctgatgctaaaacagaaccatttctgctggatggcgtgacgtatatcccgctgaagctggcaggtacagctttggataaaaaagtaacatgggatggaacaaacaaacgcgtagtcattgctgataacggcgttcctattgatcaatctacagttacagcactgaacaatcaaattacgacgctgactcaggagctcaacactgcgaaagcagcgaacacaacgaaggacgctaccattgctcaattgcaaaaagacaaccagacgctaaaagatgaagcgagcaaaaatagctctagctccttgaaggatcttcaaaagaagctgaacgatgatcacagcgatgcctatagcaccaactctgatatcacgttggatggtaacaaaagtgatattacggtgaccatcgaaatgacaaaatccagatgggatgatctatccgacagcagaaaggaaagctacctggaagacatcgttgaagatattttgaaagagtataaagatgctgatattgaaggcacagtgaaaaactccagtaatagagataaactggcgaccttttcaaccaacagcagaggcgatgtgacgattaaaaaggtagcttcttctctggatacaagtacgatccaacgtaacttgtccgatagatatggcacctataatggggtcggctttgatttcacagtaagaggcgacagcagtgaagctatcgtcgaagtttatgtaaattcggatgactggaataaaatgtcaaacaatcaaaaaaacaacctgacagacggcgttactaattatcttaaagacagagagtctgtatccaaagtcgtgggatacgtacgcaataaaggaaacagcagtcaaatcattaccttctaagattaatctttcaaaaaagcgacaaaggcccttaagcctttgtcgcttttttatgatgtacaagcaacatacattccactacttaattaatctgccaacagaagtaatatattttatataatcttcatccgcattggttgtatcgatattcattgtataaaccaaattaccaggactggttattttaactttgtaaaacatactgggtttagaataaggatatacactataggtccctttgctataaacaatcataggattaaagtcaatttgcttgaaggcgggcgataagtcgctcttatacatagcatgagtattcaatacaccttgcctttgatcccagccaaaggaaataagatcaaatgcattcgcatcaatgacttgggccaagtcttgtcccttaaacctcataagaactggactttccgtaaagctgtcatgccttagcttcaataagccacgcttggtatcccactccatcttcgcatctgtatcctctaacaaaatggatactggtaaaaacatcgcattacttttcatgatggggactgtatccattgtcactggctcaccattaaccgatatttcaggtgatccgatcgtagtcgttacattacggcctagcaaatcaacagaagccgttttgttcgctgcattataagttactttgccgcccagtatatcttcagccgcttggagtggtataagcagtctgcccttcgtatccacaaagggtgatgcagggtaggtgtataaaacataatgatcattgaccttcaggtgtatgggggtttgagcttgagctgatgtcgaattcgagtgtgcagtaacaatactacataaaatcacaaggcagaccaacagtctgattttcataatgttctcctttgctagcgtttaggctaaaataaaaatttgtttaagcaaccttcttatagttacttttcttaattagattaccctcacaaaatcacaacgtcaaccataatttataatttttacctaacagccatataattcataaatacattaataatattcataaatataaaggtatttagcgttgaaagtagaatatatcactgtattccaatttagaaaggggataatgtatatgatgagaagcttcgttaaacgtagagtcaggtcgagcattgcattaacattgacatttttattggcaatcgcaggtgcaccattaggtacaatagacgcggcggcaacggtgccagaccagaacaataagcaggatgcgccaaccttctctaatgtatcggttcatgacccttccattgtcaaagacggtgacacttattatgtatttgggtcacacatctctgcggcgaagtcaaaagatcttacaaactggacttcttttgcaaacggttacactacgcctggaaacacactttacggggacttatcgaagaatctcgctggatctttcgcttgggcgggtgagaatgatgcggacagtaagggaggattctcggtatgggcgcccgatgtattttggaatgagcattatgtcaatgaggatgggacaaaaggggcatatatgatttattatagcgcatcttccacctacattcgttccgcgatcggcattgcagttgcacccaaaatcgagggtccatatcaatatgtggataccattatacacactggttttacgaaggagactgcattcgataaagatagcaaggtagataaaaaatggacaaatacgccgattcaacaactcattaaggaaggcaagctcgaggggctcagaccgggatggtttaataccgatggttcttatgcgaatcggatgttcccaaatgcaatcgatgcaagcgttttttacgatgcaaacgggcacttgtggatgacgtatggatcatggtccgggggaatatttttactggagctggataaggcaactggcaaacccatgtatccaggtcaagatggaactacggaggacggccgtctgattgatcgttattttggcaccaagatcgcaggtggatacggtgagtccggggaaggtccgtatattgaataccacccaaaaacgggttattactatttgtatgtaacctacggcggtcttgcagccgacggagggtataacatgaggttattccgttccaagaaaccgacaggaccttataaggatgccaaaggacagaatgctgttttgccggcaaataccaaaaatacaacttatggcaacaagttgataggtaatttcttgttcgatagtaagataggagaccccggtacaggcacaggctacggctatgtttcccctggacacaattctgtatacaccaatcctactactggacaaatgtttgtcgtctttcatacccgattccctcagcagggggagacacatgagctgcgtgtacaccaaatgtttatgaatcaggatgactggcctgttgtagctccttaccgttacggtggcgagacgctaacaaagctggatgagaaacaattcattggtgattatcaatatattaatcatggcagtgattcttcggctacgatcaagaatacacaattcattcagcttagagcagatcataccattcaaggcgatgtacaaggaacatggcgcaagtcgggggatgcgaatatccaattaacactggatggtgctgtgttggatggggtgtttttaagacaatgggatcaggttacgaatcaatacatcgtggcgtttacagttttatcgaataaaggtgagatggcttggggcagtaagcttcctgatatgaccgatacgacagtagtggatagtgtgtatcgtgatttagatcttggcgatacaagtcgggtgaccgctagcctggatcttccgaaggaaggcagtcggcaatcccggattacctggaaaacttcagaccaaagcgtcattacggatacaggtgaaatcaagcgtccaggaatcggagaaaaggctgcatctaccactttgacggctaccattaccaaaggagaacgtagtcgggacaaagtttttaacatcacggtatccccttatgagaaggcaacattgactgcgtcatacacatttgaaaataatctggaggatcagcaagatgcttttgctaatggcgaagttatcggtgaccgaatcgatcgccagggaggaagtgtatcctacgctgaaggcgtaaagggccaagctatagtccttgatggaaagtcaggcattgctctacctgaaggactcatatccagctcagcatattccgtgtcactgtgggtaaaaccaagcgatttaactctgcatacaccaactttctttggagctatggatagtaaccactggattagccttctgcccagaggacccgagaaggataatacaatggtctggtccggcagctcactttggtataccggcagtactggcctaaagatcaaaacaaatgaatggacccatctcgccttcactgtagaacgtggggtgttagccgtgtatgtgaatggcgagcttcaatttatcggctcaggattcccagatgtctttacctccaaatctggaacattcagcttaggtgtcaactggtgggaccctgcgttcaaaggatctattgatgagctgagtatatttgaaggtgctctcccccctgtacaagtggcagagttagcgaagataaagtgaattaagactaatgaaacgtaagcaactctagtgtcgaaaagaaaaactacaaaaaaagagagcactgaatagcgctctcttccaatgaaacatataaaatataaggaatattaataggccaatgcaaaaagtcctttgatgtgggataagtaacggatgttactgccttccttcatcaaagtagctacagcgcctttcagttgggtgccattcgcgcctacagtaccgatcgcgtctgttctgcccaagctgcccagtgtaccggagaatactggtgtaaagcgttccattttcgctccgttgaaataagcgaagatgttgtaaccaactaattcgcccatttgccaagccaactgtgcagttggagggtatggacgctcgccttcacccgggaacaccactgcgctgtcgccagcgaggaagatgtcttcgtgagaagtcgattgcagtgcaccattcacagttgcgcgaccacggtttacttcgataccagatgcgccaaccagtgcattaccttgtacgccgcctgtccagatcagtgtgttcgttttgatcgaacgtccgtctttcaagagaacttcgtcagctttcatttctgtaatcggaacacccgctacgatttgaacgccacgtttttcaaggcttgttactgcacgatcaaccagtggttgagggaagcctgccaaaatagatggtccagcttctacgcaatacaagttgatatcttcgtagttaatacctttttcgcgacaaattacaggcaatttgtcagcatattcacccaccagctccacgcctgtcagaccgccaccaccgataacgattgtagcgtctgcttggttaccggattgcttgtaagcatccagacgagcttccacatgtgcacgaatacgattggcttctgccacagatttcagcgtgaagctatgctcttgcagtcctggaataccaaagtaagccgtttcgctgcccagggaaataacgagagcgtcatagctcaacgtagcgccactggccaaggttacttttttatcgtcaggcttgatttcggaaacagtatccactttcaggataatttctttgttacgcagcagcttttccaaaggaagcgcaacagctttttcggcaattgtacctgccgccaaacggtgcagttctgtaataatttgatgcgacgcaaagcggttaaccactgtaatggttgcttggctagcgtccatatgctggcgtgctgtaagagcggctaacaatccgccgtacccgccgcccaagatcaaaatttgcttcgacatgtccatcctccgttctcgatcaggtaattatttgctttcgcgttggcgctcattcagaatatccaggaaagcctggctgaaacgcagcgttttttgtacattcggatctttaagcattttgagcaggccaaacagacctacactgccgtccgtagtttgtacacggtcatttgcttcaattgcagcagaagccaatcctttagccgaatctgtaacaggcttcacaaactctcccatggagcttttcatatctccgataaagacagggtcagtcgccagactgcgagctacatcataagcgtcggtcatcaaagtaactatctcagtcaacttgggcagattttctaccagcacggtcagcgattgctgaacctccggtttcatcaattggtccaatacatcccgagactctttggtagcttcttgtgttactgccacctcttgttggttttcagacatgcgtgaacgtcctcctttactgtgaaaatagaagtccattcctttctcgtaacctgtatccataaactctagcaataaaacgttcatcgaattcacgcccttaaacatgcaagaagcacagctaaaaccggcctatacccttcagggcaagactgatttatcgcagatgccaattgtatattgctcagacggtattctgttgttactgctgcggaatattccacgaagcgctccttcgtgactacaacaggccgaaacggaaccctatacctctatattacacctttcacgacacaatcgtcgaagaaattttaaatttgcacaaatttctgcaaaatttttattgttattttagataaaaattagaataagctcgatttttgtccaagtttcccttaaaagaagggtcatcttatgctagaggagggtaataaagagagtgcgttttagttcgataatatggaaataacacaaaatatattcatacggaggttttaaatgatggctaaaacatttggagatatggttcaagaagcgaggcagcacgttcagggcattgattcacaggaggcacgtcagcgaatagaggcaaatccagatacattcgttatcgatgtacaggactcccatgatgcaggcgcttgcggtctgattcgcggaagcgccaatatttcattgggcatgctgcccatccgcgctgacttggaggttccacaggatttgcgtgacgaacgtctacgtgaccgcaaccgcccgattatcaccacttgtggggcaggcggacaagctgcattggcagcttatacactccagcagatgggctttaccaatgtagcttttatcgaaggcggaacaacagcctggaaagaatccggctttgaagtagaactgtactaagggatctacgctgcaagagtcgccctacgtatgtagggtgccttcagaagcgtcaggattatcaggtgcctcgaaatcatcaggagacggctgcggtacaccagactcaatgaactcatctacatcacgggcagccttaacttgattgcattcattgcaagcacatacacaattgaccggcgtcgtgtgccctccttttgcccgaggcagtaaatgatcaatcgtgtcaccgtagcccccgcaaaaaaagcaagtataacggtcacgcttaagcacatattgacgaaattccttgttgctatacagcctgcgcacggtgtatggattaacaatcaccgccatacgctctctgaccagggtcatggccagatcaagctcaatctcttgatgccagcgtctcccctggtcggttttgcctcttagccgaatcatgccattgcgattgagccgcaacgcccgggtatccgcaggcttcagcctgctaagcagatgccgaacccgttgccggtggcgctcacgcgctttgtccgtgaccggcttcctgcgggggcgttgtgcctccataggtagcaacgcctctaggctgtgcgcagccgtatttgcttcaaggctatgctgcatcacgggagcagccgaggggttcgtttcctcgccggaaggagcggacgtagctgtacgttcttgcggggccaatcctcggcaggaacggcaaggaccacgccgggaataaggaccagcccggcgacccgttctgcgctgaaagtccgttaaaggtttcatctcctgacaatacgtgcattttttaatcagcggtttgcttgcttcatccttgttctgctgcgtttctgtcacgtccactcctcctttcctctgttgctcgcgcttcacagtttgcccaaaacccgaactattgttaagttagattcattttaccgttttcacgttcccttttctagctacccgagtcgttgtggccacttaggtataacaaattttaatgatttagcatacgttatacagcaatccttgttcttcattcagcatcatattgaccgtccgacgtttagcccccctcacttggtgggtaacttgttatatatgaaggagggacgcacatgaaaaggaaccatacgatgatgcaatttttcgagtggaatgtcgaagccgacggttctcactggaaaaagcttacccgcctggcaccggaactgaaggccaaaggaattgacgcgatatggattccacctgtcaccaaaggccaatcgcccgaggatacgggatacggcgtctatgacctttatgatctgggcgaatttgaccaaaaaggtgcggtgcgcaccaaatacggaaccaaggaagacctgctggaggctgttgccgcctgtgttcgccacagcgtgtccgtctatgtcgatctggtcatgaatcataaggccggcgcggatgaaactgaagtattcaaggtcgtcgaggttaacccggataaccgcaatgaagtcatttccgagccctttgatatcgaaggctggactaaatttacgttccccggccgtcaaggtcagtattccacatttcaatggaactttgaacattttaacggaaccgattacgatgcaagccaggaccggacaggaatctatcgtattttaggtaaaaataaaagctggagcgaaaatgtagatgatgaattcggcaattatgattatttaatgttcgccaatattgactataatcatcaggatgtgcgcaaagagatgatccgttggggaaaatggctggtagatactctgcaatgcaacggattccgtctggatgcaatcaagcatattaatcatgaatttgtacgagagtttgctacagaaatgattaaaaaacgcgggcaggatttttatatggtaggcgagttttggaaaccggatctggaatcgtgtcaaaagttcctggataccattgattataaaatcgacctgtttgacgtatccctccactacaaactacatagcgcttccttgggtggcaaggatttcgatttaagcaccattttcgaggatacgcttgttcatacccatcccctgaactcggttacttttgtcgataatcatgattcccagccgcatgaagcgctcgaatcctgggtggaggactggtttaagcctagcgcctatgcactcatcttgctgcgcaaggacggttatccctgtgtgttctacggcgattactacggtatccagggacaaacgcccgtgaaaggcaagcaggctgagctagacccgcttctatatgcccggtaccataaagcttatggtgagcaaaaagattatttcgatgatccccatacgattggatgggttcgtcaaggcgtgcctgagctggaaggctccggatgtgctgtggtgatcaccaacgcaaatgacggagaaaagcgcatgttcgtaggcaaacaacgtgcaggggaagaatggatggatttgaccggacatcacgatcataccgtaaagattgagcaggatggctacggcatatttcccgttcgtgccggcagtgtatcggtgtgggcacttcccgcagaggaagacagccaggaaacagaagaagaggaagcgaacgcttaatctatacccacacaaagaggacaggatgcgaggaagcgccctgtcctctttgtgtatggaaagtcactccgttaccttgctttggttggccacggcttgcttcttagcctctacatgacttggatcaccgagataaaaacgccggatgggatctatatgctcatccagctcgtacaccagtggaatgcctgtcggaatattcaaatccagcaatgcggtttcgtccagattctccatatacttgattaaggcccgcaaagtattaccatgtgcagaaatgataactcgatcctttttgagaatcaaaggtacaatccgctgcttccaaaactcaccgacccgatgcacggtgtcctccaggctttccccaagcggcagctcttccggcttaatattacgataacgctcttcccgatgcggactccgttcgtccttctcatccagcatggggggtcgcaccgtcagactacgccgccagatatgaacctgctcctcgccgtattgcacggcggaatccagcttgctaagcccctgaagagcaccgtaatggcgttcattcagcttccacgacttctgcacaggtatccacagatgatccagctcatccaagatgtgatacagcgtgcggatagaacgttttagcacagaggcaaatgccaaatcaaacgtataaccagcctccttgagaatacgtcccgcctcaatggcctcatgagtcccttgttcagtcaggtccacgtccgtccagcccgtaaacaggttttgtcggttatacacgctctgtccatgcctaaccagcaccacttgatacatgcactcactcctctcctgtctgtctttatgttttacccaacttctatgtatttaacgtaaaatgcattttttaaaccgtctctttaatacaaaaaaggacggcattcagccatccttttcttctcaccctacacttagtccctcttactgaacttggccaacagatccaaaatccgtacatacagccatactagagtcaccagtaatgcaaaagcaccataccactccatatatttgggtgcgccttgatctgcttgctcttcaataaaattgaaatcaaccagcagattcaaagccgcaatgatcacgataaataagctaatgccaatacccagccaacctgtttcatggatatagggaacattcataccgaaaaagttcaaaataaaatcaaccagcgtcaccagaaaaatcgccatcgtacacaggaccacgaatgagataaagccgcgtgtcaccttgatgattcgctgtgtgtacataaagagcatcaagaacaagatacccacggtcagcaaaatggcattggctacaattccagggtactcatactccataaaagctgaaacgccacccaaagcaaaaccactcagaatcgcatatacaggagagagtaatggagccgtttttgggaaaaaggatatcgcaagtgctacgcctgccataccaataaagcctgccgtcagcaaggatagcacctctacggttccttcgtaggtcatgtaccaggtaatacttccagagacgatgagcagaaccagcagaagcaacgttttgttcaccgttcctccgatggtcatgcgttgttcacttgcttctctttcatcttcgcgcaaaaagatgtcatcacgtaaaaccggattgctaaagctcatacagggtactccttttcgatgttgttgtttgctatgctatatgtatatatcggcacaatatgaaaaaagtttcagaaaatttcaaacaaaaaaaactctaaccttgccatacggcaaagctagagttagaggatcaggtcgttacaggttaaaaatcagctgtcgcaatctggatcgtacccgtagctgctccagctgcggtagtctgcagagcagctaccagcagtaaagcaacctctaacgtgaggctgttagttggggggataacataagtgatcacaggtgcattgacacgagttacgacaagatcgatcggtgccggaccgttattattaacggtaattgtagcattcgcgccaccgttcaagttttcaaagtatgatttaccaatattagctgcgagagaatagaattgctgaggtaatagaatcgccataggattcacctcccttgcgcttgatagtgtattctatgcttccaatctacgaacgtaacgttaagtgactcagtaataagacacaatttgaaagacttatagattaacgtaccctaacctatgcaaaaaaggagttgccctctcagatccccttcagaatctgcggacaactccttactaaataatagaagtatcagacagtataaaagcagttagcaggattgtatgttgcctttgcttccttattgcacgtcaatgctcaattcctgcgaaccgaaacgagaaggcgcggaaacactcacgcggatattgcccacctcaccctttgtacgaatccaaaatgcaatgcgtccaccaattagggataagcttgaaggaccgatcaattgacccactccctcgacctccaccgaaacaggatctgtatagaacggcagggcattgccgtattcgtccagagcatccactactactcgtgttacgtcccaatcgccagcttccagtaccatatcatctgcagctacccgtagctctgtcggcaccggattacgtgaatagtatttgcggatcacttcttgcccgtctacgtacccaatgaatacagcgtcttcccacttcatgccccagtggcctgtcagctcgtcgatcacgacaggggggtgaggaagcgccgggtacttctctcggtttggacgataaatacctttgcgctcatgaccgtagatgaactccacctcatcgcaattggtgaacacaaccagcggcacgatgcccccgatatttcgctcgccacgagaccagtaagtgaccggctccataacgatttcctgttcgacgttcttctggctccggtacacgctcgctgcaaatttaggcaggcggaacatatccatgacaccatggtagcagattttatcaccggaaccaaaatcagcatgcgtgttatagtcaaaagcacaccagccaatcgctccggcaatgccctcatcggcataggaagcattttggacccgcgtatggcgcagtgcatgttccattacccgttcctcctggtcaaaacgtttcgtcgggtacatatgcccgttatattctgttaccagataagggaccggatgatccagctttgtaacgagagacggctggcgcaagcctgtcgtttcgccatctacgccttctgtatcgtcatacgtatcaaaatttcggatttccttcgccaaatattttttatgcccaccatcatgaacaaaatcatttatcgtatatacatcttccagcagctcactgcctacaatatatcgcacaccacccgtagcacgggtcggatctagctttcgtgccagctcattggtacgcgtgtacagatcatggtcatcctgcgactcattaattcgtacgccccagattacaatggagggatgattacgatcacggataatcatgtcctctacgtccctcaccgcctgttccttccacgcttcaccgccaatatgctgccaacccggaatctcttcgaaaacgagcaatccaatctcatcacagcggtctagaaaatgacgggactgagggtagtgggatgtccgtaccatattcagccccagctcctccttgagcacatctgcatcacgacgctgcgctcttttgggcatagcatagccaacgtacggataggactggtgacggttcaggccgagcagcttgatcttccgcccgttcaagtaaaaaccgtccggctgaaatccagcctcgcggaacccaaagcgcacggtcacctgatccagttcttctccgcctcgtagcagcatcagtttcgcttcatacagcttaggatcatctatatcccaaagccgcaggccgcccagctctttcagctccagcgtgacttccgccgccgtcatcgctgccagctcggtctccgccttcacgctcgctccgtccagcaattgcagcgcgaccgtcaagtcatcctgctgatcgccgatgccctccagctccacgaccacgcgcaccgccttatttgccgcaagcggctccggtgtctgaatgaatatcgttctaaggtgtacaggctccactattcgcagctgcacttcgcggtaaataccgccgtaggtcagatagtcaatgactgccccaaagggagggatgtcgtctcgttccgtggaatcgacaatgactgtgagcacattggagccgccatactcggcaagttcggtcaattcaacgctgaacggtgtatatccacctttatgctcccccgcctttaccccgtttagatatacctgggcataggtcatgactccttcaaaatcaacatacactcgcttacctttggcatctgccggaatgttcagctctcttttatacgtagaaataaactgaaatgccttgtcgtcaaaataattatagggaagctctacattggtgtgcggcagctgaattggctcataccgacttgcatcaatgcctacgcttacttcgctctcgacatattcaggaaggtaaaaccattgatcattcaacggcaaaatggtacgcatgggcagtcacctcaaccttttattttccactcttataccatagtaaaatatttaagtaaaaattatgagtaaaacttagtaaaataaatatatgttcaatgtaagcatttccaagacaattgtcaatccatttttgtatctttttataatcaaaaaacagccccggaaggcggggctgtccaaatccatagcgtcgattttatttggcatcggtatacagcggcgcactgctgttgcgaatcattagctcggtcggaatgatgaccttgcgccccacctcgtttgcaccgttgcgtactgtatgcagcaagagctgaacgcccgtttctcccatcagttcggtatgcgttttgactgttgacagagatggggtcaaatattccgctgtcggaatatcattgaagccaacaatggagatacgttccggcaccgcaaggtgatgctgctccagcgccttcaacaccccaatagccaccgaatcgctcgcgacaaagaaggctgtaggcaggttttctggtcctgccagaatagccgcttccatcgcacggaagccgtctgccgctgttcctccgcacacatgaatatcatccgacgtgcatagcctatgctgttcctgataccgcaaaaacgtttcatagcgggcatctagctcgacttgttcggaatcatgggactgcccatccttacccatacctacatatccgatgtgacgatggcccgcgcccatcaaataatccagtgcatcagccgcagcgtgagcaaggtcaatgaccacatagtctgcccctgtacgctctaccggatgatccagaaagacgcaaggaatgggcagttccagcatacgttctacctcttcgctgctaaaatgccctagcacgattagtccatgcagcccttcggatgacgtcttcagcgcagttaggtcctctcttctgaaaatacgctccagctgcgccccgctttggcggcactctttttccacgccaaaccgaatagatagataataagggtcttccagttcctcgtacgcactaaaccagtgcaccatacccaaccggatgggtccctctgccttcttgcggggctgacgaccaataccgccatttttacgtttaaccgtcgtatatttcatgcgctcggcaacctcaaaaattttacgccgcgtttcctctgatacagacagtgtttcatcataattcagcactcgggagaccgtggatatcgaaacctctgcctcctgggcgatatcttttaacgtaggcattgcagactcctttaatcgttttactctatttttacttttattttactattatcttactcgtctcccctgtgcaacacaaccattcattcctaaaagggtcaaccatttttttcatattataagcctaatcatgataaaatacgtaccataatagaaatgacactaaggaggatacacacatgaaacaggaactgattgaccgcctgactacatatgttcaggtagatacccaatctgatgaaagcagccacacttgccccactacacccggacagctcacattgggcaacctcttggtgggcgaattgaaagccattggtatgacagacgtaactattgatgataatggttatgtgatggcgacccttccttccaatacggataaagaggttcccgtcatcggttttctcgctcacctcgatacggctaccgaactgactggcgcaggggtaaagccgcaattgacggaaaactatgatgggggcgatatcacgctgaatgcttcgcttggtgtggttctttctccacgtgagttccccgaactgactcaatataaaggccacaccctgatcacaacagatggtaccaccctgctcggtgcagacaacaaagccgggatcgcagaaatcatgacagctatccactacctgattgaccatccagaaattcaacatggcaaaattcgcgttgcctttacaccggacgaagagattggaagagggccggaacgctttgatgtagccgcttttggcgctgaatatgcctatacggtagacggcggaccgctcggagaactggagtatgagagctttaacgccgcagccgcccatattaccattcacggtgtgaacgtgcatcccggtacggctaaaaacaaaatgatccacgctgccaaaatcgctatggaactgcacagtcggttacctgcaaacgaagccccagaatatacagacggatatgatggcttctatcatctcttggagtctacaggtacggcagaacaagctaaactgtactatattatccgtgattttgaccgcaagagctttgaaaaccggaaagcttatttaacaaatgtagtcaaagagctgcaggccgcatatggagaaaaccgtattgcgctggaattgagagatcagtattacaacatgaaagagaaaatagagccagtcaagcatatcgttgatgtcgcatatgaagcaatgacaaagctgaatatcgaacccattattaagccgattcgtggcggtacagacggttcacagctatcctacatgggactgcctaccccgaatatttttacaggtggggagaactaccacggtaagtttgaatacgtgtcggtggacaacatggtacttgctaccaaggttattgtggaaatcgtacaactgttcgagcaacgcggtaagtgaactacctatacacagcactgacacgttaaggttaaatagaaggcatatcgttccgtaatggaaacggtatgcctttttttctgaagctttcatttccctttaaattttcaatatctttataacttttatccgtctttagaccgacaactatatacgagactataaaaaatatatctagtaaagaaaggtaggttatctatttgaatacaatagatgcattaattgcagccattccctacatacaacagattatgcgtgagaaagtgacccttgctctcttcgaccgcactcatgtccttatgtatacccaatcggagggtatggacctcggctttgaaacgggctcggagctgctcgaagactataaagattttgccatgcttaaaaatggacgtgagcccagcctgacccacatccctgctgaaattctagggtttcctcttgatatgatcagtattcctgtatttgatgagaaaggtgaagtcatcgcagcatttgcggcctcttataatttgactaacaaaaatcaactggaccaaatcgtttccgagaacctctccatcactgagcagctcattgatatggtacagcatgtggcggctcattccgaggagcttcaggcaaccagtgaacagattttgaaaaacacccaaatcgccgtacaaaactcgggtaaaatcaatcaggtagctgtgttcatcaaggaaatttctgatcaaaccaacctgcttggattgaatgcagcgattgaggccgcgcgtgtcggagaagcaggagcaggctttggtatcgtcgctcaagaggtgcgcaagctatccgtagaatccaaaaaggcgacggtcgatattgaaggagcccttaaggatgtacagaactccattcgtcaaatggagcaggaaattgagcaaattgtttcttcttctcaagagcaggcgactctggtaggctccttcactgaagtgatggagcgtatgcaaaaggcgagtgaaacgatgcaacatctggccagtcacctgacttcgtatgtcgtaaaataaatcctggcataaaaagggggagtacactgatcgcaaaatgcgtaaaagtgtgctccttttatgtacaaaagccctatcaggcttgaaggtctaattctgactcaagcagtataagaaaaaataccatgatttgaaggaatcacagggtctaaccctccccaaatatttcccaccagaagagcaatactaagaaacgccaagaccatagttaccgagattaatgcctttttcattatgaagcccccttaataaaatggtttggtattgctctcgctgtgatggtgttgccaaatctcgataagtctcaaacagagcaaccagtgtcctgaaatcggcatccgcttctacactggcagagaattgcagagaatcaaggacataatttaaggcaacggagtactgcttcttcttgagatggtaaatggccaattggttgaccaattttaaataatatacgcggtttgctctatcttcataaccttcaaatatcttaatatcatcggcaaaatcgttcagcaggtcgtctatattccaattattcaggttagctgcttcggtaataccaaccaatcctggaagtagctcctcgtcattgtcgtgaagaaattgaacgtactcaggcaaaagttcccttctccccgaaagtaattcaatcgtaaataaattagccttggcgaggaaacggaatctctctacttcttcgtgaccgctctgatccagcggagtcatgctcgtagcctccattttttgcataccattatattacatatatagtcaaaacctaacatgaagtcaattcaatcataactaccttctttttttgcaaccttacattgctgtgtacggttatcggttatgaatagtcgactccccttatagaaataatgctaaaagaaaacaaaatgtaggctctctcacggatggtttttatgatgctatagtatcgtgggggtaactacgttacgaattagtgcgtacttttcaaccgggtagctgggccttacaatcaaacctgtgcatgaaactaaagtatagattgatactcaacagagcatgtacctgttcatcaaaatataaattcacttaaggagtgaagttaataacatggaacttcaattggctttagacttagtagatatcccgcaagggattgcattggtaaaagaagtagagtcgtatattgatatcgtagaaatcggtacgccgattgtcatcaatgaaggacttcatgcagtaaaagcaatgaaagaagcattcccgaatctgaaagtgctggctgacctgaaggttatggatgcagggggctatgaagtgctaaaagcttccgaggctggtgcagatatcgttacgattttggctgtagctgaagatgcaacaatcaaaggcgcagtagaagaagcgaaaaaacaaggtggcaaaaaaatcctggtggatatgatcggtgttaaaaacctggagcaacgtgcgaaagaaattgacgctcttggcgttgactacatctgtgtgcatacaggctacgatctgcaagctgaaggacaaagcccattcgaagcactgcaaaccgtcaaaaaagtcgtgaaaaactccaaaactgctgtggctggcggtattaagctgagcacattggctgaagtcgtgaaggctcaaccggatctggttatcgtcggcggtggtatcactggcgaggacgacaaaaaggctgtagcttcccaaatgcaacagctcatcaaacaaggttaaccccaatggaaacctctcaatatttatctgaggtactcaaggagctacaattggttccacaattgatcagtgatacggaatcggaacagctgatccattccatcgccgttgccaataaggtattcgtagcaggtgcgggccgctcagggttcatgattcgctcgctggcaatgcggctgatgcatatgggaattcaagcttacgtagtcggggaaaccgtaactcccggtttgggcgagggcgacctgctcattatcggttcaggctctggtgaaaccaaaagcctgatctccatggcagaaaaagcaaagaaactcggagcctctctggcgctactaaccacttctcccggttccaccattggcaaactggccgatatcatcgtcaagctgcctggtgcggccaaggacccgtccaacaaggactaccagacgattcagcccatgggctcattgtttgagcaaaccctgctgttgtacggtgacgcactggtactcagaacgatggatctgcgtaagctgacctccaaatctatgtttggtcaacacgccaatttggaataaaactgcaactcctttacgatagcaaagcaggctgtcctttacatgtcacatgtgaagaacagcctgcttttatgcttgtagaaggcgatgttcgatacagcatagaataaggcaaaacgagcccggcatgtattcaaaccatttattcgttgttccctgctggcaacgacgggactttggacggatcagcaagtgcccaataggcatatttggcctttaaccgttcgtcgaatagtagcggcttatccaaccgggctattggaaacgtgctgagccacgtatttccatcatccgtaccccaaatcgtcacattgctgatatgttcttgctgtcttgaaaacatatcgaacagcgcccgatagcggtgagcctgccggatgagcatagattctggaattgtttcatagcgatctgtgtcattggaataaagacccatatccagctcggtaatttgattatccagaccaagtgaagcaaacttttctatggactgctcaatctcgctaatagcgggaaactccaggcggatatgcgattggtggcctaccccgtcaatcggtacacctttagcgagcagatcacgtaccaaattgtacagaaaatcccgtttcttcggctcatgcgtgttgtaatcgttaatgaatagccgtgcgttcgggcccgtcacttccctcgtgacacggaatgctttttcaatataatccgtaccggtaatctgataccacttgctgcggcgcatgccgtccggctgatcaggatcaatgacctcattcaccacatcccaatcggtgatgacatttttataccgggctgcaacagcgcgaatatgcgtctccagccgatccagcaaaagctttttattctcagcagtcggcgtcatcggctctccattcttatccttgaacatccaatccccagtttggttatgccacaccaaagtatggaagcgaattgccagtccatgctgtctagcaaactgcacaatttggtctgcttcctcccaatggaactgtccctcggacggttgtaaggagatcggcttcatcgcattccctgcaacgacgctgttaaaatgcttctgtaccaactctccgtaagccccttcggtctggaaagcttcaatcgctgtgccaatgctaaactgtcccccatataatccatgcaaagaaggaatgtccttttcaatagcaagcggtggtacaagtgacagctcgaaatcatccatataaaaggaaggcgttccttctgccgtttccaaatacatggaaacggtgtctgcatcatacgcaagcgtatacgtaccagacaaatgcatccatccctctgtcgtagttgccgtgtcgcctacaacagtttcatacgcactatccccttgatgatcacgctgtacgctgagcctcaccttggcaggctgctcacccggcgccagctttacccaggcactgaccgtatatcggctgcccttttgcatcgtagcagtcacatccagcttgggtccggcatatgtcttttgtctgcctgttgtcagcagactgtatgagccgcttcgtgcatcggcgtccgaaacctgtacggtctcgactcccatacgggacacccatccttgagccgtaccatcttcaaacccggatacgataccattggccggctccgttggcgtcttcgatacctgtgttatttctatctcatccacatagtaggcctgcgcgggattcgagctttccacatacagcttcaatgcatccatccccccggtaaaagtatatttcccctgaagtttgatccacgatgtatccgccgtctccgtctgcgctaccgtcttccatgtcgtagtcccgcctgtgggctgctgctccactgtaagtttaaccatgctcggaaccgcagaatgaccatccagcttcacatagccactaatttcatactccacatccggctgcaacagcgacttcacatccagctccgccccgttccaagccgctgtacgagcggttgccttcagactgtgcgtgccgccatatgctgcttccgtgacggatgcgatttgggtataagttcctcgcggcttccagccgtcgctgtttccttgctcaaatccatacgttccaatggtcttatgaatactacccgccgatagcaccacatccgaaacgggcggggaatgttctatagacggagctgccttcactacagacgctccccaccaaccgataggcgataacaacagcgctccgaccagtaccagacaaaaaggcttaacccaacatgaccgcaaagcaatccctcccgtactccaattttttggaattggtatttggcaccattggttttcatttactatcctttgacaccgcccaaggtcatacccttcacaaagtatttttgcaaaaagggatacactaaaataataggcactgaagcgacaatcgtcattgtggcccgaatcgaggtaggcgtgaccgacttcgccagattttccgaaccagcgaattggctcgcatagtcctgaccgttaacagacgtgttagaattttgcagtattttcatcagctcatattgaagagtgctccattgctcatatgatgaattgtacaaaaacacatcgaaccaggaattccattgtgccaccgctgtaaacagcgacaccgtcgccagtacgggaacacacagcggtaaaacgatgcgcataaaagtggcaaactccccagccccgtcaatacgcgccgactccaaaatcccttccggcaatccctcaataaaggagcgaatgacaatcacattaaacaccccaatcaatcccggcacgacatatacccagaaagtccccagcatcccaagctcacgaatcaggagaaagtttggaatcaatccaccgctaaaatacatcgttaaaataaaagcaatcgaaacaaatttgcgcagcacatattccggccggctgatcgtgtacgccaccatcgcgcagcaaaacaccgaagtcactgtacccacaactgtacgtaatacagaaatcagcgtagcatggaaaatcgtcgcttccttgaacacaaattcataattactccaagtaaattcacgcggccacaaatagatcccgccccgaatcgaatcattcgcttcatttaacgaaaccgccagcgtatttaaaaacggatacagcgtgaacaccatcaggcagagcataaacacgatattgcacgcatcaaaaattcgatccgagggcgcccgaaatcgcccgtgtacggccttccctttgcccatgactttccgctcctttctaaaaaatagtttaggcatttggatcgcgcaccctctgctatctccttcgaatagcacattcctaaaaaacagcctctaatggccgatagcgaagctgagccagccatgatggcacatttacccaaggaagcgcgagtcacgcgccttccttaaactctcccctgcccctaccctcagttcttaaaaaagtgactttacggcgggtagcagcggagcgggcggaattgttctgaagaagcggagcgttcgcctttatccccggattttaacctatgatctttattccaataagaaaatacggggataacagcgatcggaagaacaatccgcacgcgaagcggccgtcccccaccataactcactcttctttcagaacaatctctcctcccctaaccgcttcgcaatatgattggcgctaaacagtaagatgaagctgaccaccgttttgaacatcccagcagcaatggaaagcgagaaattacccatctggataccatatttcagcacgaaaatatccagattctccgagtaatccacgttcatgccgttgcccagtaagtattgcggctcaaagccggattccagtaaatttccaatgttcataatgagcaggatgataaatacaggcttcaatcccggtaatgtcacatgccaaatccgctgaaaacgccctgctccgtccatctcggctgcctcatactgcgagggatcaatcatcgtcatcgcggccaaataaatgatggtgttccagccgacatttttccatacctccgatgcaccgagaatgccccaaaaatagcttccctcgcccagccacagaataggctccttaatcaaccccagccacatcagcacctcattgatgatgccgccatccgcagacagcgccgtactgatgatgctagccgcgaccacccacgaaataaaatgtggcagatagctgaccgtctgcacgacccgcttgaacatgatctgacgaagctcattcagcaaaatcgctaatgttatagcggtgacaaagcccagcaccagattaataaagctcatcgccagcgtattgcgcatgacccgcagaaagtgttcatcctgaaatagaaaatggaaatgttttaatccgacccattgctgatcgagcaacttgcgggcaggcttaaaatcctgaaaggcaatcgtccaaccccagatgggcaaatacttgaagatgaacagccagattaaaaaagggacggacatccataccagtgcccgttgctgattcagcttgtgcataaatcccctaaagccggttcgccgcgagggcggcaaatgattcaaggagatcgtgacaggtggtggtgacgagtggcccatagctgcttcctcctttattttttaccgggattttcgatttttttggcaacctccttcgtgatcagctcctcatacgcctttacatccagcttgttgaattcagtggtgtattcattccaaatcgcatcaaactgctccggtgcagacagcaccaaacgcgggaaatatttgcgctgtaggtcccccttcttttgctggaagagctgcgcagttgagccttgagcaatcggaatactccaggccggataccatgggcgctcgtcaggtgcggaaaacatttgcgagaaggactctacaccatagacttttagcagctttttatctccctcggtgtaggacatacgcgcaacctcaggctgccgtccggggccaaccgagttgccgtcaggcagggtagaaccgctaccgtatcgcggccaactgtattcaaaatatttgaacccgaatgattcgcggaacgcgtcctgaccagtctgcttaatttgctcctcagtccggtaaaagcgtccttttttatctacatcataggtttcccccttgattccccagttggataatatctggttttcgtcggtcagcaggttgtcaaaaaatttgatgatacgcaccgggtccttggcactgaccgtaattcctatgcctcggttattaacgaatgacgaaggatcaatgtactgatcctttatattctggtcgtatacaacaggcagccctacatactccatatcatcattgcccgattgcttggaagcctcttgcagattattcagggcctgccccgcctgccagcggtagtcgaaaaagcccagcaccttacccgaggtcagcttcgccaaatattgatcgtaattgtccacaaaggacgatttatcaaataggccctctacattgagctgatttagctctttcagataccgctttgtgatttccatatctccataatccgtggcccggtgtgttttcatatcaataatcgtgccgccatcattcggatagcctgccagatgcataggcgcgttcgtaagagcataaaacctatcctgcgtggttaacgccaggtacccagtcaagccctcatctgcatgctttttcgcatagttacgaatcagagctaaatactcgtcaagtgttttgatttttggatatcccgcttcttttaataccctgcgttgcacccaaaaggctccttgctctaagttaggcgcaggtaaataatcgcctaccaccgcacttagcggcagaaagtaaatgttcccatcctccgccttcatcaagttgtagtacggtccatatacacgcttaatatttggtccatatttgtcgatcaaatcattcaggggaataaaagccccggcatccagcagcttatcgatcgtgccatccggtactatcacatccgggtaatcgttactggcaataaatgtaccaatcttcgtgttggaatcacccaccaaatgctccagcttccagtttacccccgtctgatcctccaggattttgccgatccgcgtttcattggtattagtgtccctccccgcagtggcattaaaatacgtgaatgtgaccttctccttgctatctcctgacgccggctccttgcccgagctccctgagcaagcagcgatcatagacgccatcataaccattaccagagtgatgattccgaaccttttgcttgtcatgccagaccctcccctttcgccctcttttgtcgattgtgtgtgaatatcgtgcgcacgtacctcaagcattgggaatcccgcacaccctaaattgtaagcactttcattttataaaatgctgttcatttcgttcacctgtcaatctaaaggtgttacttagaaaactataggtaaaggtccttcaaagcaaaataggtactgctctccacctcactcccgatccgcaggaatcctaattcgaatctccgtaccctcgccgggtgcactgcgaatggcaagctcaaagcggcttccgtagtaaagtttaagacgatatatgacattttgtagacctatacgctcacccatttcttcctgcctttgcatgtaaccatacaagcggtgtacctgttcctcagacatgcccaccccatcatccagaaccgttagaatcagttgtccttcctcatgctcaaaatgaatctcaatgcgtcctccatgctttagcggctcaatgccgtggatacttgcattttcaaccagtgtcagcgcgaccattttgggaagcagattgtccaagtcttcagagcgcgcctgcacttcgtactgtattcgctcaccaaagcgatattgctggatttctagaaaacaacggatcagctccagctcctcccgcaaagtaacccgatccttgttccacaccagcgaattgcggaaaatccgtgccatgttatgaataatgcgcgctgtctcatcctcatgcttcatcaagctccgcatgcgaatcgtctccagtgcattgaacagaaaatgtgggttgatctggctgtgaagtgcattcaactgggcatgtctgcgctgaatttccagattttttcgctgtatatcggccatatagacatcgttaatcagtcgctttattttcagcgtcatccgattaaactcacctgttaattgcccgatctcatctctcgactctgtgccgcgaatcagctcaaaatgctggtttttcaccttcttcatgtgctttaaaatacgatgaatcctcacgttcaacgaacgtgtaatccaaataatgattaatgtaggtagcagcatatttacacaggttaacaagagcacaaaattgcgggattcctgcatttcatacagcactgcatctctcgataccgcagccacaatgctccagccattcagattgctcgtaagcacataattcgtcttgaactccatggtgtcctcgggcagcttgagagtgttataggccacatttttgtggtttatatccactttggggtccgttgtatattcgattccccctcgttcgttcagcagaaagagacttccctgcaaattcaggttattgaaaatctcccgaatggacgacattcgcagttctattttcagtattttttcacgaccattttgggaataaaagtagttcatccgccgaatcaggctaaaagggtacatctgttcacctgaactgtcatcggtacgaacaaatataggcttggactggcgtccaggcgagattttggtataccagggcaaacttctgactccctcatctataaagctgattcccccggaattcagcagcgttgaattattggtgtagatcgtaattccacctacggaatggtatgcaggactgtaagtgttgttcaagatatgacgtaaataagagtcataagcggcgatatagtcagcagggtggggatatgtttcttccaatacctcattgagctgatgatccgtataaaagatagacgagatttccatcgcatcttcaaattcacggtaaaattcaattttaatctgttccagtgcgcgcgaaatatcctgcatacgctgttccttcacgttttgcgaggtgacatggtaaaaaatcagattggtcagcactacaggcgtaaaaacacagagaaaataaagcagcagcattttatctcgcagtcgtacatgatcaagagtcattctcagcatcttcattcgccggccctctctgactcgttgccaacaatcaggctgttgcggtattcgcttggtgtggcatgcgccatcttttcaaactgggtaacaaaatagtctgaactgccgaagcccacgcgctcagcaatttcataaatccgcagatccgtctgccgcaacaagcgtttcgcctcctgaacacgcaatttcagcagaaattcgttaaagtacacaccatacgtttttctgaacaattgaccgaggtataccgggttcatgtaaaagcgagccgcaatacttttcaggcttatattctcggcggcatgctgctcaatgtaagcacggatgtgctggatgcctccctgctgacaatccttgcgcagaaccccaatataccttccactttcctctgcaaaagctgtaaacaatcgctgtagttcacccagggacaggttcatgtcctgccagttcatcatcggttctagtgactgaagtgagcgctcatctccctgcatgttttgaatgacccgaacgatactaagtacgcactgatgcagactcattttcatagcctcaggagcataacactcctcccgaaagctgctaaataaataatcgacggccacacgcagctcatccaaccgtagttcctcaacttgttccgtcaagcgatccagtacgtcctgagggatggtcttatagtgaagtggtggcatttctttctgtagatatacaacaataccgccatggtcataaatgtatttatggagcactgcctccttcgcacaggcataggactgctggatatcctgcaaccgattcacaggctttcctgcataaatgaaaactcgacttcccagctgatcttttagtgtcttcatcccctctatctcgcgttgtagcgctttcataaaaacttcgaccttgccttcaaaacactccaaaaggaagtccggtacgataagaccaatccggttacgatgctcatgaacatagagagggtacttgccatccattaaccgatgaagcgcttgctctataagctccctgaattggaaaagcgatagcatgatattattgtcaccggagcgccagggatgttggtcattcagctcgacgagtacatagtacatataagtggcttccccaagccgtagctgctgctcccactgtgtcaccactacatcatccactgggttcatcatcacagtctctaacagcccacctgcatggtgattctgataacgttgcgcattctgttgttcacgatgcagtctttcactcagcttgcgcaatgtagccgaaaaatcaccctcatcaatcggcttaagcataaaatcatgaaccccatagcggattgcctgctgcgcataagcaaaatcactatagccgcttaagataataaacgcgggatgttctgtactctgttcgagcacagaccgaatcagctctaatccgtccagcacaggcatacgaatatcggtaatgaccaggtccgggtgaatacggctgattagctccagcgcatcctcaccgttatcagcttctcctacgacttcaaaaccacaggcttgccaatccatgagttgaagcagccctttacgagtaaaggtttcatcatccaccacaatggctcgatgcagcttcataacacgcttcctccttttgaagtatgcctattttattattttggttaactattccaatgatctcagtcactatggtaatgtaaaacatcaggaattggaaattttcgttatacctattatatgacgaatagaggggtgcaaagcatgtgcactccagcagccaagccaaagcagcaaatatacaaaaaggagacgaatccctgaataggggttcgtctcctttttttgctattgcgtaaaaagctttattctcttattcgtgaattcaggctatcgctcagcgatgatactgaccgcttgcagatggtcggcgtactttacaaactgcttgcgcatacccataacccttgtccgggcagcatggttacgcataaggttaaaggcaattttcccaaatctcaaccagccctcgtcctgaatgatacgtggcaaatgcaataagtgcatgggaaccgtatagattttaacgaccttaaagccttcctctttcagcagctgttcccactctgacaccgttaacggtgtcgcattaactctcatggctacagccaaatccttgtaaatttgttttctgagcgcaggctcaatatggttagaagcaaggcacatctcatgaatagcatacttcccacctgctttcaaaagccgcctggcttccgaaataatctgcgctttcttggcccttgtgtgcatcgtcagcatggcttccccatataccaccgtcgcagaggcatccggcaacggaacctgtttagcatcggcaataatgacttcccgatttgctccgcttgcatacgtttttacgatagaagccgccttctcattctgttcaatcgcaatataacgacggggattaagccgcagtgtgatttgggcagttatacccaatccgggggcaaactcaataacctcatcctgcccggttacgtcaagtccctctatcatccaacgtgtcgtttttaaccctccgggcctaagcacgcgcttaccgagacttgctaatatccagtgccctggcacctgtttgtaatctactgtctgcattggctattaacacctcttcttaaaattcgataatgatattcattatcaatacgagtgtaaaaaaaataacctttttctttttttgatatgagcatgttgcatcattcaatatctatatattgccgatcggagacccgctcttacgatttatgccaatgccccatttatacaatgatggtgctgtgtcctcttttatatgttctgcgcatagctttcgcttggcgtttgggttaacactacatgcagactggaattcgcctctgcaccgccacgataggaaaagtgctcatcgcccgtaacatgaatgatatccccttggacaacttccgttgcctcgccgttcacagttacaataccgctgccttcaagaacaagcaaatatacatttgctcctgggtgattatgtgttggcaactccgcattaggagtaaagttgagaataaaaattacattgtcagcttccttatgcacaattcgttttgtaaacgctgcttctttatattcctgaaattgaatgagatttgattttttcatattggttcacgctcctgtttgaaattaaatttgcttaagatggatgaatacctttattgtattggattatttcactcgccttgtgattgcaatcacaaaactaaatttaagtaaaaaatacttttaattatttaaaaatttgatttcaatcatctttttcatcgacacatccaactagaatcggattatgcaagatgctaaaacaataacaagcaggaggttattcctatgaagcccggattcaagctggcaaaggatatttattgggtaggaaaaattgataatcgtgaggttccctttcatcgtcttctactatcaaagggtacaacttataatgcatatctattaaaaaccggaaagccaaccattgtggataccgtggatatggcgttcggtagagaatttgccgaagctgtaaccgaattgatcgatccattggacattcaatatatcatcgtcaatcacacggaaccagatcactcgggcggattggcggcacttgcttccaaggcaacgaacgctacgattgtctgcactgagattgccgttccggaaattcaacaaatgtacaagcttcagcatcgcaacttcctcgtaatcaaggatggggatcaactggacattggaggcaaaacgctgctgttcaaagaaactccttatctgcatacggaagaaaccatgattacgtattgtatagaagataaaatcttgttcccttgcgatattttcagtacacacgtggctgtagagcatctatttgccgatgaggctggttttgatatcaccgaggactttatcggatactatcaggctattattcatccacatcgcagatatgtgcgcacattaatcgaagctgttgccgatctggatattgagatgattgcgccttcccacggcttcgcgatccggcatgatattgccaagtttattgatttgtacgcctctatgagtaccgaaaccaaggaagataaaaaagtagcgattgtctatgccaccctaaaaaataatactaaaaaaatggcaaacatcctgaaggactgctttttggagaaccaaatcaaggtggagctatgggacgtggataaagcggatgaaacagaaatattgaatagtattgcctcagcagatgctgtgttcgttggtagctctactaaatatgccgatatgacgggcaaattggaagacctattgcaacaaatgcaaaagatgaatctggaaggcaagctggctgctgcctttggttcctacggctggagcggggaagccattgaagttgtacaggactacttgaacggtaccaatatgaaggtgcaaagcacttcagatgtaatcaaatcaacgggtatgacccatgtggaattcccggtacgtattcgtttctctcctacagaagttgagaaagtgaaaaaaattaaaaatgccgctgaatttgtctcagatctactgcttagtgttatttaaaacacagtagcgtatagcgaataggagagatactgaatgggtaaccaacattacgttattatcggaggcagtgtcgccgccgtcaacgcggcaaaagcgattagagatcatgatgagctggccgaaatttctatttacggggaggaagcatcctttccgtataacagagtcaaactttccaagggactatttactgatttgcacagtgacaaaatcctgatcaaaaaggaaaaatggtttgccaatcaacgaattcatgtgtattccggcatcaagataaccgagatacatccagaggattgtactatcaaaacaatagatggacaaaccgttgcttatgacaagctgctgctgtgtacaggagctcacaaccgtaagcttgtgctggatggggcttctctaaggaacgttcacaatatccgttttcgacaagatgcagatagccttaaagcagaattgcgacagggagaccggatatgtatcatcgggggcggtattcaaggcgtggaaaccgcctggtccttccagcaagccgggtatgctgtaaccatactggaagcttcgcatcggcttatgccccgccagctagatgaaaaggcctccgctattttgaccgatcaaatgaccgaacggggtactcagatccaccttgggcaaggcgtaaaaggtattaaaggcacagatcacgtagaaggtgtggaactacaggacggctctgttatcccttgcgagcatgtcgtgtactctatcggaattgtaccgaatacggagcttgctcgccaaatcggccttgatattagacaaggcattctggtgaatgcacagatggagaccagctccgccaatatctatgcagcaggtgatgcagccgaatttcaaagtagagtagatgggttatgggaaagcgcaatggagcagggaaaaatagcaggcgctaatatggcgggcgcatccgtcagctatcagcgtcccctccctgtaaccctttcaaactgctatgaatctcctctcttttccatcggtctggtagatgaacaagtctgcgacaccagcctgattattaaaaatcgtgcttcttatacacgtatgtttatacaaaacggctctatctgcggcgtgattggctttggagatgcccttgcttcactaccatacaaaacagccatcatgcagggactcaaaccggacacaccagagcttacaaaaattttgaatgacaaggagaactagagatggaaaaatatgtttgtcagccctgtggatacatttatgatcctgctatcggtgaccccgatgaagacgttatgcctggtacagcgtttgaggatcttccagaagactgggtttgtcccgtctgcggtgaggatcaaagtcattttgccccaatagatgatacagaataacaaccatgcgctataacctgtagtttccggtttatgaatggagtgaatgaatgtgaatgcgatgtcctgtccctgccagtgcgaaaaggagccctgtgcccgcaaagtgcctatcttttcctctttgtcctgcgaagatttgtgtaaggtcagctctatgatccgacaccgaaaatatcagaagggtgaagccctgattatcgaggaacaagcatccgatacgctgtacattattaaaagcgggcatgtcaagctgctgaagatgacgcctcagggcaaggagcaaattctgcacattctgacaactggcgatttttttggcgagttgaacatatttaacagcgatgagctgagtaactttagtgcgtatgccttaaaagatactgatatttgtatgctcaccaaggatgatatggagcagttgatccgcaacaatcccgatatctctttgaagctgctcaaaaccattactaaacgcttggcacataccgaaaacctggctcaaagcctagctaccaaagacccggaaatccgcattgcctatatgattcttgagcttggacataaatacggcaagccggacggttcctacattaaaataaatctccccctttcacgcgaggaactggctaattatgtgggtgtcacccgcgaaaccatcagtcgcaagttcggaaaatttgaacagctggggattattcatagcaagggtacaagagagattaccatttgcgatgtacagaaactgaacgaatatatggattgagacacatagatacaatgttactctaacatgaggacaacaaaaaaccgcttctttaacttatggattgcagttgatctatcaaccacttccatttcgttaaaaggcggttttttagcatattttatactccactaactatcaattgtcgtgtttacaccttgggaagacgctccccatgcaggctgcgctgaaggaagttctggcgaaactctgtctgtggaaggagcagtctcaatcgtggtcgatttggagcaatcccacactactttgaccaaatacccaaacaacaacacattcaacaatgatgtcacacacaaaataataccgtattgatcccgagagttggagctatagaaaatatcaaaggtattcaggaaaatcgtaagactgaatccacccgcaagccacaagaatctgcggtctcgtaaatacagatacgccagtacagctaacgcggccgcagggaacaagtaccgttcatgcatgctggaagcgaaggtaaatacacctgcaatgagcaccagtgcagctgctgctgcaaattgtggtttgcgactgcggatatacatccaccatgtaaatagagtcaccaacacaatgcagatcataccccacgtatggtaactgaacaggaacagcgttgtagtgtcctgcgtataattgccaccgatcaatgcaaaaaagttatacgcgttcaccgaagcatacggatactcgccgaccgttcccttgtataggtcaagtagccataacggctcttgcccccacgaaaatggcaatatgaccagaatggtcgtcacaacggcaccgccaatggacaacagccaaggctgtattttacgttgtctcaacagctcaaagaacagaacaggcccataaataattccctgcggcttcatcaatacggctaccgtaaacaatacggcggaccagccgacccggttttccacaagcagcacaatcatgcccacaatcagcatcgtaaagaaagaatctacctgcccccagaaggtcgaattgataaatacagccgggttaaacacgtagaatatagccaatccaaggcttattccatagttgacccgtttgctcgccaaccggtacagcatgtacgctgtcacgatatcggctaatatattgggaagccgcagcagcacggacatatagggactgaaagcatccgtagagccgatttgaccgatcacatataaaatataaatatagaacggcggataatcacttgatccgttcgtgtaaaagcccgataagctatccgctgctgtcgtagcccagttccggaatagcattaaatccatgtgacccgaaatccatggggcgatcgccattcttaaaaagaaacccacacccagcacagtccacaacatcagtcctcgattacgttccccgagcttccattcacgagcccgaaaccgatacgcaataaacacgaacgcaccgaagaacaaagcggcgaaaatcgccagcggagtagcataagcagatgaggagttcccacttcttccaccacccatatcaccgccaggaccgcccatgccagatccgttaccagacatgccaccggggcctctgtgctgtccgtctctggcaacaccactgccacccgatacagacgtatcattcccggtcgttgtacctttgtcacctgatgtcgatgtcccctcagtggaggagttggtagtttggtctgtcgtcccctgattcttgctgtcagcgctattcgccgaatccgtccccctcatacctccgccaggtccgccccctcccccaaacccgccggatggtccctgcctaacagccgcagactgggacgcagaactacctgaataactccataacgaaacgacactaacgacagcacacaatatgagactacatagaagtatatatttcagaccgttcgctttccaaacgttcaaacccgatgcacctctctctgtttctattttcccatattgtatctgccttagcttaggactttgtgagttctggctgaatgttggctgaataccgaatcatcacactgaagattgtcgttccatctccataatcgccctttccagctgagattgtggatgcttcagcatgttgccgtgaccgacagctaataaagatggattgaaactcgccagctttttggcgcttttcagcgaaatttccttgttccaggtagccagtgccggaaaaggaaacagcggcttaagccttcccgataccgctataccacctcgggtctgaaaggcgtcgcctgcaattagcgctcgggtgcgagtatccaaaaatgccatcgagcccggcgtatgtcctggtgcactgatcgccaacagcgaacctacatgatccccatcctccagtaaaacgtcaggctgggtaaggatatgcttcggtacatcgcctcgaataggagtatccggttctcctgtctccaacgatacatcgccctgtagcagcggtgcgtcccgcctggaaatgaacacttgcgcgtcaggataccttgccttgagcttatccaacgcacccacatgatccccatgggcatgggtaagtacaattcgaataatcggctgcccaatccacgccgcagcttgtgctataccacgggtactgtatggcaatccggcatctaccaaggtgagcccctctttctcctccaccaaataacagttcaccgggaacagccggggcataaacgtcaattgatacacatgctgcacctgaacaatacgcatttatctcatctccttgacttaattataaactaatcatattagtattataaataatataattagttttaagcaaatacttttgctgctattcagctggagttggagcttggaactgctacggggacggccgtactgagaaaacagcaaaaagcatccccgggactctgcccccggggatgcctctcaaaacaagaattaatcttttcctcctgttattaataacgaagccttcttggctatttcctctttatcaaacggagtaattccagatgcccataaataaaccagcctcatgtatgatgttggcatgaataggtaggacatctttcaatcttcatccgtaattacagccggattgcctcagcaataggcgtactgccagacaccagattaattgcacgatgatacgtctgctgttcctccagcgctgctaccaccgctgccgccacatcttcacgagaaatggtgtggcgggtgagctcctcaccggtagcaacttttccggtgcccacatcatccgtcaggccacccggacgaagaatcgtgtagtccaggttgctcgcttccaacaagcggtcagcgtaatgcttcgccacataatacggtttaatggatgcaggccactgctcccgattctccgcatgaagggcgctgaccataacgaagcgccggatacccgcttgttcggcggcttccatcgccttgaccgctccatccaggtcgataagcagcgttttatccgctcctgtttttccaccggagcctgctgtgaacacgacagcatcgctgccttttatagctgcggcaatatcaccaaccgtcccttcgaggtcagctaccaccgtttctgctcccaaacgttcaagcgcttcggcctgatccgaatggcggatcaacgcctttacgcgatgcgatttattctgccccagtaggcgaacaagatgtctgcctacttttccatttgcgccaatcaccagtacgttcactcatacccctcctgtattcgcagtctctcatctacattatacagatgtattttacccttcgggtctgcgacgcaatcatgttagctgcatcaggttgaaatcagacttctttggtaagctcggcatctcgcttttgccgcacacgcagacctgccaaaaaggtagccatcatcacctcaatgctccgatccacttccacaggtaaaccaaagccgcccttttgttcaagcgaggcgaatccatgaagcagactacggaatcccctcgctgcatgaatgcaatcttcttccttaaagccataaccactggataggacggtaatgaccagctcggccacgcgatccgcagcctgcctcatttcggtatcatttcgatcagttgcatactgcatcgcttcatacaaacctggtcgctcgcgagcataccgcatatacgcgttccccatagcggtcagcgcatcttcgcccgctctaccaaccgctgcgctcatcaaagcttcctccaactgttcgaggctgtgcaatgccagtacttggcgcagtccattcaatccgttcacgtggttatacaaggacggagggcgaatgtgcagcttttgcgccagcgtggtgagcgtgacatcccccatcccttgttcattggcaatgtcctcggcagcccgcaggatatcttgcagttttactccgtttctaggcgacaccatcccgcctccttccatcgaatttctatgtaatccggtaccttatacatatactgagtcgatccagattctattttaactaatcctgttagtttatacaaagaaaatgccgtttacaacagccgacctgcatcgaacctttatagaagagcatggcggtcattactgatataataaaaaaataagatcataaacggaacggatctgatccctttctcgatcccttacaaaggagctagctatatctatggaacccaagccacttccagctattgaattcaatcacattatcaaatatttcaccgggtctggacagcaacgtactgttctgaacgggattacagcaaaagtctcccccggcaaaatcaccacgttggtcggtccatcggggtctggtaaaagcacgttgctttcactgtgcaacctcctaatgacaccagatgaaggggatatccgtgtcctcggcaaacctatatcggagtgggagatccctgaactgagacggaaagtagcattggtttttcaggatgcccccatgcttcagggaacggtcctatacaatctccaaaccgtagaacggctgcacggtacggtgttggaagatccggctggcctgttggaacgcgtaggactcactcgcgatctgttggaacagaaggcgcaggaactgtccggcggacaaagacagcgcttggccttggcgcggacactcgcgaaccgcccggatattttactgctggatgagattacttctgcactggaccctgcctcggtcaaagaggttgaggaactgttgctgcaaatgaacaaagaagagggaacaacgatgatctggattacgcatcatatggaacaagcccgcagggtaggccacgaaacatggctgatgatcgacggaagactgatagaacaagcggatacggagacgttttttaatgctccacagcatagtgagacccgcaggtttgtagcaggagaatggatatgacgattgttgccttgattctctctctcggttttgtatttatcgccatcgtcatgtccaaatccttcaaactcggtctggaccgagacatgatcatcgccacaatcagagcgtcggttcaactgctggcgattggatatgtattgcatttgatttttgggatgcagagctacggatttatcgtattattcattctgctcatgattaccgtagcctcacaaaatgttgcgcgcaaaggacgatttatccccggtctcatgtggaagtcattcctgacgctgctgtgtgtggaaatcgttacacagacattcctcattggcctgcatatcattcctgcgacagcccggtatatgattccgattagcggcatgatcattggcagttccatgattttgtccagcctgctggtgtcccggctcaagtcggaagtcctgctgcgcaagcctgaaatcatgctcattctggcgttaggcggcacgcctagacaagccatcttccctatactcaaggattgcatacgttccagtatgattccaaccattgaggggcagaaaacgctggggcttgtccagcttcccggcatgatgaccggacaaatcatcgcaggtgccaatccgattgccgccgtgcgtttgcaattgctcatcgtatttaccaccatgacctctgctattttgaccagcgtgctgctcagcctgttcatttatccggcattatttaaccgccagcaacaactgcacacagaagcatgggaacgctaatcaggtgaatatccccagttatctgtggtttcgcaaaataaaagagacatgtttaattcctgacacaaaggttaatagatacacgtacccgctttactaaaattcgatgaggagtgattgaacatggctaacaacaaccaaaatggcaaaatgagtcgcgaagaggcaggacgtttaggtggagaagctactgctaaaaatcacgacaaagaattttatcaagagattggcgaaaaaggtggcgaagccacttccaaaagtcatggcaaggacttctaccaggaaattggtgaaaaaggcggcgaagccacttccaaaaaccatgacaaggaattctatcaagaaatcggacgcaagggcggcgaagcccgtggcaactcagaccaaagtgatagggacgggaaaatgagcagggaagaagctggccgtaaaggcggcgaagcccgcgcacgtcagcgtagagataactgacaatagggagtatgtggtcggtgcaattgcaatgtagaggcacagactgcatataaacatgaagtatagtggacgtttatgttataaaagcctatctgcccgaacaacggcagataggctttttgtgtgaaagttactttcgtcaaccgatcatacgccttacaatatacataaacaggttaaataaccaatcatacatattttattacaaatgaaagaatggattataggaggtttgcgcgaatgttgattacaaagaataaaacggctgcaactattctaagaattatattttttttactgattttcagctggatttattattattcaggtcatcactcggcagaaaccgctaaattagttaaaactacagatgattacttggtcatacagagagatgcttctagcggaggtgaatataaagaattatatatttccccaaagtctgtgatccctcctctggttataggcaaacaatattatttcgtgtctgatcaaaggtactttcaacacccatatatccgttatgtagaggaggaaacagaacaagacaacaaggactaacacagcccttggttaaagcttcatggatacaaaagagtgcatgcaactcaaatcaaatattcctgcattccgactgttaagatggagtcgaaaggagggaaccctcgtgtacgaatggaacgaaatggtgcagctcatgatcgattggattgataataatcttacttcagcaccttcgttgctgagaatgtccagtcagttaggctactccccttactactgtacaaaacagtttcattctcttacaggaatgacgttaagggattatgtgtggatgcgccggattagccgtgctgcactggaactccgggatagcaatgtccgcatcctcgatgttgccataaagtatgggttttcttcacaagaggcttttacacgggcatttgtaaaagcgtttgaggtaactccggctgtataccaaaaggagccccgacctattccgctgaccattcgcgttgaggtgttctctccttatcattaccatttgaaggagcgggataagatggttaaggatcatttgcaagaagctgaagtcaaaatcgagcatataccagcacacaaatttattggaatctgggatacttcttctcgaaactacggtgatttctggagaaacggtcacaattgtgatgaaatttgcggaacattggaaagcatgtctcatctcaagcttcccgaacaattgggccaaactgcgggctggttctatcaagatggtcagaaaggctacctctatggaataccggtcgccgctgactacaatggagagattcccgcaggaatgaagtgtcgggacatccccgaatcagattacctggtgttttttcacccacccttcaattatttaaaaaacaacggagacgttatgagaatggtggaggagaaggcttggaactttgaccctagcagcctagggtatgaatgggatgaggaaacaaagcaagattatcagcggcatttcccagaaagatacggatacgcagtgttacgtccagtgaaaaaagtgtagagaaaaagaatcccaagaagccgctacgatcaggatgctgttcatcgtcttgctaaagtctgttgaaaaataataacagtttattactaacgggttccatcttgagatgcaatacacatcgaattgacattgtggtcataatacgatgtaaatacagaataaaccgatccctgaatcatacagttgtcggtttattcttgatcagtatttttattttgcaagtaactatcaatgattttaacccaatccggtaacaaggccacatgatgttttatcgtttcactatctgattccaatacaatcacgccatctgagctgctgttgtcaatgacaattaaatgatcgataagtttaagatgtaagagcagattgtctagtgaggtctgatgccgtcttataatatcagcggtttcaatgtggtggcccccatttcgaactcgtgcagcaactcgctcgatattaagacgataatcaccaaggcccacataaaacatgataacttcaaagccattttcttttgccactcgcatttgtcgaatcacattgccaccagcaagtgtcgtctctacggtaaaatctcgtttatttcttatacaatcccgtgctagcttaatcgcttcctttcctgccgatactttgtatcgatcagggtttttacgatcaatccctcgcgctaacgcatctggatcgatattaacacttacaccaagtttatcaacgattagattacgaattgtactcttaccacttccattgtttcctgcgaatacaaacatagtagcaaacggctcactcatgataaaatatcctgctctttaattcgttcgacttgaccattactgtactctttaacaaattgaccatccgacgttttgtagacaatatatgtgccatttgctttagcgtccagttttgctctatctccagttagtttgattaacttgcctaggtcgtgtgtacgattcattcagccatcaccatcccatccaaatcatatatcgagagtatatcataaatcgaaaagtctgaaagaatccagcgtcactcaaatccatacgaataccgcacggctaaaaatcgtgacaagtaaataggatcgaaatattgtctttttaatacattttaataaataaatttggaataaatgctaccttcagtttttttattcgtctataacaacaaatacaattgcggaggtacaggcaatgaaatcttttcgtttttggctagtcctaatctcatgtctagttattactatcaatattacagggtacgacgactataacatgctattggctatcattagcccgctagtttggatgtatgaatcatttcgatttgtgcgagaggcagacatccccataactattgtttacttcactacactaattttctggtatctcattggatacgctttggaccgtttgattagaaaattaaaaaattaaagtcacttgaaatcaccttctaaattgtcgtctactttgtcaggctcgtactcgaccgttctgtagtatagaagcgttcatatattctgaaaatgtcgagatagcagcctctttgggcttatcgggaagtttataagattccttacctcctccaaaacctgtagcaattacggtcaaaatccctcctaagacaaccaagcaagccaacttattacgcgatacaatcctcaataaataaaacctcctttgttgtaaattttaccacctattttcaacgtatctcaacttaaacagccactgtaaaacgcagcataacttcttgtaaaaccccattcatttaaatccaaggccattcttttcatataattttattttaacgtaaatactcaccgaatacctttgttaccttatgtaatgtcgtcttcccatcctgtaaactaagttccatcaagcggtaaccgctggatcatagagaggatgagatatttatgggtttggataatagagtttttgcgatacaagctggtctggacggacgtgtaaatgcagttatagatcaaacccttgccgagaagcgcctggtcggcgcagtcgtcatgatatatatggatggttcacccgtgtatgtccgagcggcggggctggctgatcgagaagaacaacgtcctatgcacgaggatgctttatttcggctttcttctgtatccaaaccgattgtatctactgcggctttggttttggcagcccaaggattgattaagctcgatgaatctattgaacgctggttgcccgatttccgcccccgattaatcagtggtgagcagccctccattacagtacgccaattgctgacacatactgccgggttgacctatggctttttagaggaagaaggcggcggcccctatcatcgtgcaggcgtatcagatggcatggatttttcaaatcttacactggaagagaacttgcaacgtttggcttctgtgcctctgttatatgcaccgggtaaagcgtggggatattcgattgctactgatgtgctcggcgctatcattagccgtgtatgtggcacaacccttgatgcagctattaaaaagctcgttacagaacctctcggtatgcacgacaccagtttcgcggtcgcggatgctggacggcttgcggctccttatgtcaacgatatatcagaaccccggcggatgcgtgagcttgaggttgcgcaggtttttgaaggcaccgcaggacttcgttttcagcctgcacgagcctttgatcccacggctttccactctggtggctctggtatgattggcagcgcaaaagatttcatgcggctgctggaaacactgcgaaacggcggcaatccgttactttcagaggaatgggtccgcgaaatgggcaccatccagaccgggaaccttcctttggcaggctggccggggcggggttttggattaggattcaccgtactccaaaatcccgatgaaagcggaacagcagaatcacccggaacgtggcgtctcggaggagcttacggtcattcgtggttcgttgatcccgcactaagacttagtgtggtcgcctttaccaatacagcatttgaagggatgtcaggtccgtttacaaccgagctttgccaagccatttacggtagctcaaatagggtctaataaagtgggggttacatgtttatggtctacaggcgaggacaggacaattaacgtggtagagtgcccatgctttccacactcatccccgaactgctccagcttgagcatagactcaaccatgactttcagtaagtaattttgctcgccgctgattctatggcactcaatgacttcaggtgcagattggcaaaactcaacaaatgaattgcattgattcgtgtgcacgagcacgtgagccatgatcggttttccaactttctcatgtgaaactatggcacgatacccagtgataatacctttatcctccatgcgccgcactctttccgttacggcaggctgggaaagcccaacctcctttcccagctcggtcatggagatacgcgcctggttttgtagacacaacaaaattttatgatccacttgatccatcaaaccagcctccttaagttcaaggtaatattacaaaaacacaattattattatgtattatttcgaatattgccttattattttatgatttaatgaaatattagcatgcaaaaccaaggacgtaaagcaggaagacgtggaaagggaatgaaaccaatgaaatatagtaagcccctgcttttcattgcgcttggcctatttggtgtatacacgattgagttcggtgtggttggcattttgccggtcatcattgaacggtttcatattacggcagctcaggccgggtttcttgtcagttcatttgcattgatcatcgcgttgttcggtcccttcatggtgctattgatgtccaggtttaaccgcaagcgaatcatgacaatgtcgttgtttgttcttgccataacaagcttgctgtcagcctatacatccaacttttatctactagtgattttacgtatcattccggctctgtttcacccggtgtatttctcgcttgcctttgtcgctgccactgcgttgtatcccccggaaaaagcaacgcaagcttccgccaaggcctttctcggcacgagcatgggaatggtactcggtattccaattacagcctatatcgccaatcaattttcatacgaggcctccttctggtttactgcggtagcgaatgggcttgcagggatcggtattttatttatgctgccggatacaccgcaagccgaaatgttctcctatcggaagcagcttggcattttgcgtaaagtatcgctgtggctcaatatcggggcggctacttttatttttgcagccatgttctcggtgtatagctattctgccgaatatttggggcaaaatacagggatgagcagcaaggttatcagttttctgcttattattttcggcatcggcggaatgctcggcaatctgttggctggcaagctcatgggcttgcataaggtacgcaccgctctttttcatccagtagtcttggggggcacctatttgctgttgtacgggatcagttcttcatttatccctacgctcttcatcattatcgtgtggggggccgttcataccagcggactgattgtcgcccagatttgggtgattgacgaggccaaagaagctcctgcgtttgccaacagtctttatatctcgtttattaacttaggggtatcactgggctcgctggcaggggggtggtttattgccagagcggggatccatgggacgctgtggagcggtttgctgttcgccatgctggcgatggtatgcatcgggtctaaagtgatttatccacgtattttgcgaaaatataaagggttagatgtgcaaagctaaaaagttgcaagagggccaagcctgttatcataaaaaatcggttcaacactttgtatggtgttgaaccgatttttgtttaaagattaattcctgcctgtcggattagatcatgcccggcgatcacgatgcttgccccttgctttgctacttctatggctgttgccagccctatacctgcactgccgccaatcacgacgacacgttgattatgtaaattcatactattctcaactcctttataagggttatatcataactatttaaagacatactcatttttattcgtatgggctttcctgtatcgtgcttttgcgataggatgtcggcgattggcccgaccagcgcttgaactgtctgctaaaatgcgcaatatccccatagccgagcatatcggcaatttgttgtaccgaccattgcggatcagccaacagcaacttggcctcatgcagcacaagcccggatagatacacacgaggagatacgccgaaaacgctacggaatacacgattacaatgggacacgctaatacctagctccgatgaaatcccctcgatcccatcctgtttttccaccgatccggcctgcccatagggctgattcactctgccctgaagacgactggcaatctgatgggcaagctctgcctgcacatatccacgccccggcagatgggccgcttcactggatacagcctcccacaacgttgcgaacagttcaaacacagcagattgaatccgcatacgctttgccaccgaatcactacctactcctatgtcctctggcgttgaaagatcgagcagcttgcccagcgctggtcccatctgccctgccactgttccttcagctggaaacagcacctgctccagacgactcaacagcgagagaaacagcttatcatcaatgtcgaaatgcatacaaaaatacgtaaatccctctccgttactatggctggagtgaacaatccccggacgcagcagcaccagatcaccctgtcgctgggtatagctgcgaccatccacaaccatgatctgttctcccgcaagcacgatgttaatttcatattgaggatgctcgtgtggcggatagctccactctcttccgacacttcgtgtatgaatggcaaacaaattgaccgtggtccgtacatcgggaaaaaagaattcctctccggcagctgtaaggtctggatgatggggacgattcggtaaccgtggtgacgacatgttttccctcctggcttacttacatggatatactccagtatatcgccttcagcgcgatttggataaatagttgcgcgatttgacaatggttccccaccacatgacatgctaggctctaagtgaagttagtcaaagttaaactttattctgaaaggggtttcattatatgtcgaaaaatatattttataacacgcagcatgcaccgatcggttctttttccagctttacgcttgggtttaaaggcaatcgcggcggactaggtttggagctgggcaagcctgccgatgaaaatgtatatattgggctgcaatccagagatggccgatcatacgaggcgcttcccttttttgcatccacacaggatgaaagtgcccgctacgacgtggagaaaaagggtaaacgaacggaaccacagcttatgtcctttgccgattcagacattacccgtgagctaaaagcaggaacggatacatggcaggctggagatttgacgttccggctgtactctcctgttcgcccggtgcccgagccgggaaccgcgggtatggatgagctgcgggcagcgttggttccggcggtattcgccgagctaaccgtcgataacacgcaaggaactgcagcacgaaaagcttttttcggctatcagggcagtgatccgtatagcggcatacgcattataggagaagatcctcgcagggacgctacggattctaccccattggagggaagactcacaggcatcggccaagggcgcagcacagccattgtgaccaacagcagtgaagcggtacctgccagcggatttgcaatggagaagctgcttggggagaccatggccgagaatttatcctttggcctgggcacgacgggtgcgctcctgatggacgttcccgcaggtgagaagcgcacatataccttcgccatatgcttctatcgcggcggcattgtgacaacaggcatcgaagcattgtattactatacccggctgttcaaggatattgaagacgtggggagctatgcattgaagcattttacagacctcaccgcagcctgtgttcaggctaatcgctggatggagtcggccaacctgagcccggatcaggaattcatgctcgctcaggcgatccacagctactacggcagcacccaactgcttagtcaccaagcggatggagaaccgatctgggttgtgaacgaaggcgagtaccggatgatgaatacactcgatttgacggcagatcagctctactatgaattgattttaaatccatggacggtgcgcaacgagctggagtggtttgtccaaaggtacagctatcgggatgaggtacgctttccgggagaggaacagacctatccgggtggtatcacgtttacgcatgatatgggcgtggccaacgtgttctcccggcagggatactcctgttatgagctggcagggattgacgactgcttctcttacatgagccatgaggagctgatgaactggctttgctgcgccacggtatatatcgagcagacacaggatcagtcatttacaacacgcatgctgcctgtcttgtgtgactgcttcgaaagcatgctgcggcgggatcaccccgacccggcacaacgaaacggcttgatgggcttggacagctctagaacccggggaggcgcagaaattacaacctacgacagtctggacgtatctctgggtcagtcccgcaacaacatttatctaggcagcaaatgctgggcggtatatgttgcactggaaaaaatatttgcctcaaaagggcttaactccctctcacaggaggctggcttacaggcggacaaatgcgcagccgcaatcacagcacatatgacagacaagggctatattcctgcagttattaaggaaggcaatgactcgcagattattcctgccattgaggggctgatcttcccttactttacaggatgtgaggctgcgcttaaccctgatggacggttcggtggatatatccaagcactgcggcgccatttggaaactgtgctggtaccgggagtttgtctgtttgaagacggaggctggaagctgtcctcgaccagtaacaactcctggctgagcaaaatctatctgtcacagtttattgcccgcgagctgctggaactgccttgggaagaagctgggcaggccgcagacgctacccacgtctcatggctccttcaccctgaagaatcctattggtgctggagcgatcagatactgtccggtattgctcacggcagcaaatactatccacgcggagttaccgccattttgtggctgtatgaaggcaacggcaaccgtctgactctccctgaacatatgagtcaggatcaggaacagcatgcctgaggatcatcttcacctgcccaaaaggaggctccaatatgagcaagcttatggatatgccaaaagagagcggctatgcggcttggctgcattacagccgcaatagtaaggtagaaaagctgcccgcttggtgcagggtcatcgtggtccatgagacagatgaagtgcttcaatcggctgcgagtgagcttcagcacggattgacctccatgtttggacagcagccgaagatcagcgccgttcctgtgaatgcgccattcattgcgctgggtacgttcccagcgcatcctttggtcgcagaacgattcagcgcagaggaacaggcagaagtgggtgcagaaggctaccgaattcgcgggatagagatgccagatccggcatattcagcttcgcatggtaacgatgagttcaaaggacaatacgttacagtcgcagggcagacctccaaaggcgtattgtacggagtctttcatctgctgcgctacctgcagggaggactagatgggaagttgaagcccaccaccgaatcattgaacgcccccattctagaccaattatccaaccctgttaatcccatccgcatgatcaaccactgggataacatggatggtagtgttgaacgtgggtatgcgggcggatctattttctacgaaaataatgcctttactacaagtatggagcgcctgcgagactacgcccgtctgctcgcttctgtaggcattcaagcactatccatcaacaatgtgaatgtccatcaggtagaaaccgagctgattacagatagattcctaccggatgtggctaaagtagctgcggtgtttcgcgcctatggcatacagatctacttgagcattaactatgccagtcctattcagctcggcgggttaaccacggccgatcccttggaatcagctgtagctgaatggtggcagaccaaagcccaggaagtttacgccgccgttcctgatctgggtggttttgtggtcaaagccgattccgaaaatcggcccggaccgttcagctacgggcgccatcacgccgatggagccaatatgctggcagatgcattgcagccctatggcggacgcgtgatttggcgctgctttgtctacaactgcaagcaggactggcgcgatcgcaagacggatcgggcccgcgcagcctttgaccattttaaaccgctggatgggctgtttcgggaaaatgtcattttacagatcaaaaatggtcccatggattttcaggtgcgggagcctgtctcccccctgttcggtgcgctagaatccactcaggtactgctggaatttcaaattgcgcaagagtacaccggccaacagaaacatctatgttaccttgttccgcaatggaaggaggtattggattttgacacctacgcccgaggaaaaggctccaccatcaagcgtatcgtgagtggcgctttgcattctcccaagcataccaactatggaatagccgctgtatccaatatcggtgcagacaccaattggaccggacatttgctcgcccaatccaatctttatggctatggtcggttggcttgggacccggacctgtccgcagacgaaatcgctgatgagtgggttcggctgacgtttggcagacaagggaatagcgacggcgacacagatttaatttctagcattaagcagatgctgctcgattcatggaatatctacgaatcctacaccgcccctctcggggtcggctggatggtcagtcccgatcatcactatgggccggatgtagacgggtacgaatattctatgtggggcacctaccattttgctgattgccgggggatcggggtagatcgcacgtccgcaaccggaacgggctatgcaggacaatatttttctcccaatactaatatctacgaatctacggacacctgcccggatgagctgcttttattctttcaccatgttccttatacacacttgctccactccggccaaactgtcatacagcacatttatgatacccattttgaaggtgcagaacgtgcagcccatctccgagacacatgggttagtctacgaggacaactgaatgatgccatgtatgaacaggtgctggagcggctggagcatcagactgagcatgccaaagaatggcgggatcggatcaatacgtatttctaccgtaaaagcggcattgccgaccagaaggatcgccctatttattaagcaagctgcctcggcaatactttcatacagactggaacaaggcttctctacgcctagattcgctttctcctatactggcattgtctatccacacatcattaaaaggcatgcgtcttactcagacctatgccttatttttttgcctggaaacttttaagcacacggttgcttacgtaaaatgtcatatttgtccactctgagtgtgcaataaattcttctttttatgcaaccgcttgctttatactatttttgtagacgtttacaaaatgttgtcgaattagactatgctttggggaggatgatcggtttgaccttgtatcgaagtctatggaaaaaagggtgtatgcttctactaagccttgtgctgtctctgaccgccttcattggctcaccctctaatacggcgagcgctgcggttgcagatgattttcaggcttccgttatgggaccgctggcgaaaattaatgactggggttcctttaaaaagcaactgcaaacgttgaaaaacaatggcgtgtatgccatcactaccgacgtctggtggggctatgtggagagcgcaggagataaccagttcgattggagctactacaagacctatgcagatgccgtaaaagaagcgggactgaagtgggtccctatcatctcaacgcataagtgtggaggaaatgtgggagatgactgcaacatcccactgccaagctggctgtcgagcaagggcagtgcagatgaaatgcagttcaaggacgaaagcggttttgccaataacgaagccctctctccattatggagcgggactggtaaacaatatgacgagctatatgcctcatttgctcaaacctttgctagctacaaaagaatcattcccaaaatttatttaagcggtgggccctctggagaattgcgatatccttcatactatccggcagcgggatggagttatcctgcacggggcaaattccaagcctacactgaaacagccaaaagtgcgttccgcacggccatgaatgaaaagtacggatcaatggacaagattaatgcagcatggggtaccaagctgagtagccttagccaaatcaatccgccgactgacggggacggattttatacgaacggcgggtataattccacgtatggaaaggattttctgtcgtggtatcaaagcgtgcttgagaagcatctgggcgtcatcggagctgctgcacacaaaaacttcgattctgtgttcggtgtccggatcggagccaagatttccggtctgcactggcagatgaacaatcctgccatgcctcacagcacagagcaagcaggtgggtattatgattacaaccgtctcatcgagaagttcaaagatgcggatctggatttgacatttacttgcctggagatgagtgacagtggcacagcaccgaattattcgttgccgtccaccctggttgataccgtctcctccatcgcgaatgccaagggtgttcgcctgaatggtgaaaatgcactcccgacaggcggcagcggcttccaaaaaatcgaggaaaaaatcacgaagttcggttatcacggatttacgttattgcgcatcaacaatctcgtcaacaatgatggctcaccaaccggtgagttgagtggattcaaacaatatatcatcagcaaagccaagcctgacaataatggcggtacaggcaacaaagtaacgatatactataaaaaaggcttcaactcaccttacattcactaccgtccggctggtggtagctggactgctgcaccgggtgtgaaaatgcaggatgccgaaattagcggctatgccaaaattaccgtcgatatcggttctgcctcccaattggaagccgcttttaacgacggcaataacaactgggacagcaacaacaccaaaaactactccttcagcacgagcacttctacgtacacgcccggtaatagtggcaatgcaggaacgatcacttcaggcgctccagagggcgtgaatcccggggatggcggcggtacaactaacaaggtaacggtatactacaaaaaaggctttaactcgccttacattcactaccgtccggctggtggtagctggactgctgcaccgggtgtgaaaatgcaggatgccgaaattagcggctatgctaaaattaccgtcgatatcggttctgcctcccaattggaagccgcttttaacgacggcaataacagctgggacagcaacaatactaaaaattaccttttcagcacgggaatttctacctacacacccggcttgaacggagctgcaggatctatccgaacgggggcaccttcaggaagtgccgtcagcgtagtgacttccacctacgcaaccgacctcaacgaagtggcagggcctatccaaacagaaaaactttcgggtgtatccttaaatgtaagcacttctacctacacaccccatgttaacggagttgaagtaactgctaaaacggaggcgctttcgagcgccttcacctctatagatccgggtaccctctccaagcccactccccttggcacagactggagcaaacagagtatttattttatcatgacagaccgtttcagcaacggagatccatccaacgataactacggtggcttcaattccaacaacagcgatcagcgcaagtggcacggtggcgattttcaaggtattattaaccaactcgactacattaaaaatatggggtttaccgccatctggattactccagtaacgatgcaaaagagcgaatacgcttaccacggctatcatacgtatgatttctatgcggtagacggacatctcggtaccatggacaagttcaaagagctggttggtaaggcacacgacaaaaatatcgctgtgatgctagacgtagtagtgaatcacacaggtgattttcagccggggaacgggttcgccaaggctccttttgacaaagcagattggtatcatcagaatggtgacattacagggggagactacaactccaacaaccaatggaaaattgaaaacggtgatgtggctggactggatgacctaaatcatgaaaaccccgctaccgcaaatgagcttaaaaactggatcaaatggctgcttaatgagacaggcattgacggactgcggttggataccgccaagcatgtaccgaagggttttctaaaggattttgaccaagccgccaataccttcaccatgggtgaaattttccatggcgaccctgcttatgtgggggattacacccgatatctcgatgccgcattagattttccgatgtattatacaatcaaggacgtgttcggacacgatcaatccatgagaaaaatcaaggagcgctactccgatgatcgttactatcgcgatgcccagaccaacggtgtatttatcgacaatcatgatgtaaaacgtttcctgaatgacgcctccggcaagccgggtgctaactatgacaaatggccacagctcaaaactgccttaggctttactttgacctcacgcgggattcctatcatctatcaaggcaccgagcaaggctttagtggcggagatgatcctgctaaccgggaaaacgttgtgtttaacgccaatcatgatctgtatcagtacatcgctaagctgaaccgtgtgcgcaacagccaccctgccctgcaaaacgggagccaaaaggaaaagtgggtagacgactccttttacagcttccagcgctctaaaaatggcgacgaggccatcgtacttatcaacaactcatggagcagtcaaactcgcacgattggcaacttcgacaatctgtccaacggtacccgtctgaccaaccagctgagcaacgactccattcagattaacaacggttcgatcaccgtgactctcgctccaaaggaagttaaagttttcaccaaataagttacatcgaatattcaattgtgctaaaataaatggtagaaggatatactaaaaaaagagcaaggatgctgtaacatccctactcttggcaacagccgctttgaagagcggtcggctgaaaagggctagctattagagatagaccgtgtttcccctctccagggcggtctatttctttttgttatactctacttatttttctatacgaacataacttcgcaacgctaaaaaaagtcccagcacaaatataaagaaaatactgatgacccctccaggaacatacgtgaatgttctgcccatttgtccatggggagaaaacaatagcggaactgtccatggataaaaggtattccccggtgtattaatcaaaacaaaatttaagcacataaccgtacacatcccaataatggcgggtacaaattttttccagcgaatagcaaagaacgtgatgatcgggatgagcatagcgtgcataagaatcatcttagcaaataccccaagctgatacataacaatttcaaaggttagcggtctggtcgtaataaacgtacccaatactgtagatagcacaaatgccatcagtaggctaacagcgatgtacatataaataacgagtagtttgctgaagtaaatacgagtccggcgaatcgggtttgtaaacagtgcaatatgggtcttctcctgatactctctcgcatagatatagcaggtcaaaatatagtagctcatatacccagtcagaaaattaataagaataacaacactcataaagtagtcattccaaccatcacgatctatggaatacttgggactatccgcgtaactataaaattctaaaaaaatggttaatactaaaatcattacactcaaccaaacaattttagttcctttcagcttcaagcactctgctttaaacaggtcaagcatagtaaccctcctctcgaaaactctctatttattcttttctttgatatgtccatatagataaaagcaatccaagaagaaaggtcaccgataagctgaaccatgctactgaaacattggtaggtatagtcgcatttctttcattaggagataaaagatacggaacaatccacggataccattcacttttgtatataaaattcaaaaatattgcagtacaaactacgagcacaaccaccatgatgctcttccagcgtatagcaaaaaaagaggcgattgggattaacatcgcatgcatcagacacattttagcaaacacttggatttggtatacccagatagccatcgttaaaggtcgatctgtaatggacatgcctaataaggcagacaaaaacagaacgagaaataaggatacaataataaatccataaataatgatcaatttactaaaataaaatttaaccctggtgacaggcgtggtaaacataaatagatgcgtgttttcctgatactctcttgcaaaaatatgaccggttaatatgtagtaactgataaatccggctgcaacattgacgaagagaactatgccctcgaaatagtaagtccaaccccgtttatcaattgaatatctgtaaaaaatagcgctcgtcgcaaattccaacagcacaacagccagcaatataatatagctcaacaagaaggctttagagcctttaagtttaataagttctgctctaatcacgtcgcccatcctctcctgaaatgagagtcagaaagtactcctcgagtgtctgcttggaggtgtgtatctcatagactgaaaactgatgatctattagctgcttatttaacgcagctgtattctcaatctgactatgaattcttagttgttgtggggatatcacattagattgaagttgcttcatgtgctcttgcagaaatgcttgcactgcttctgcatcgtctacctttacatctgtatattgctcaaaaccttcctctaatcggctcaaacgatcttccgctaacagttttccattatgtataatcccgatgtgtgtagctaactgctgaatttcgctcaagatgtggctggaaataagaatcgtttttccttcttcctcgcacaaccgcttcaatagctgacgaatttccttaattccagatgggtccagtccgttcgtcggctcatctaatataagcaactcagggtcatgaacaagcgcccttgcaatccctaatctttgcttcattcctagggaaaaattcttgaacttttttttgccggtatgctctaatcccacagtagttaatgttcgttcaattctcccatcatcctgcacccccatgtacatacagcaaattcttagattgtcgcgtgcgctcaaattttcatataaaccaggcgtttcgataattgtacctattttcgagaaaatagaaggatagtttttctccagccgctcgccaaataaaaaaacctccccacttgtaggctcaattagcctcattagcatgcggatagtggttgtcttaccagctccattttcaccgaggaaaccgtagatactgccacgctccacatgtaaggatatgtcgtctacggctacagaccccccaaactgtttgcggagctttttcgtttcgataatatattccactttcaaacctcctaatcactaaataatacaagtatacaaaatataaccactactacctgtaagattgcttacactgtaccatctgtccataaaacaaaacaggcacctgacgaagcgtacacttcgttgcaggtgccttgtttatatataaacaacgtgggattacttaggcctcagtagccacgttgatattgttcaggtatggaaggctcctcgccgcgcagcgtcactgctgcatgaatcgcccaatatggatcgcgcagcgatccgcgtcccacagcgaccagatcggcatcctcgttgccgataacggactgcgccaaggctggctcatccaacgagcctacagcaatcaccgggatgttcagtgcctcgcgaatttggcgtgcgaacggcacttgatagcccggatagttgcccggctttctggcgccagcagggccttccccgcccgagctaacatggatcacgtctacgcctgcagcctgatatgcacggctcagctcaatggcatgatccacatcgtacccaccatctacgtattccaccgcgctgatgcgtaagattaacggcatatccgcaggcatttgcttgcgtacagcctgaataacttcaacgccgaaacgggataaatccttaccgtactcgtcgtcccgcttgtttgtaactggcgaatggaattggtgaatcaagtaaccatgtgccccgtgaagttcaatcgtatccacgcccgcttgaactgcacgccgggtagcgtctgcgaatttctgcaccatgccacggacttcctccgtcgtaagcgcgcgtggctgtttataattcgcatccgggtatgcaatcgcggaaggagcaactggctcagctgcatcctcagctttacggcccgcgtgagcaatctggatgcctactttggacccgtgcgcatgaatgccgtcaaccagctttttataagctgggacatgctcgtctgaccaaagacccagatcataatctgtaatccgtccatccggttccacgtccgtcatttctataataatcaggcccgtgcctccaatagcccggctcaggtaatggacatgatgccaatcattcggaatcccgtccttggctgtcaccgagtattggcacatcgggggcatcaccacacgattttttaattccaaatctttcagtgtatacggtgtaaacaacgaattcgtcaaaacgttcatctcctttttatcttcgtcacataaacgaaaaatacgcttcaaattacacggtctattaaaaacataatcggcatagtccaaacggaataaagagattccctccaaagggggatctctcacatttgcaacttgcagtcattatgtatgtcgtatggtgtagatatattgcacacaacctattatccacaactcaataactttttgcaagtaaatatttaaatattattaaatatttttttgtccttcccctctccgcctcctagctataatacaaaaagacgcccttacggacgcctctgcaataccaatcttattgtgctgagcctaattgtacccatgccttctcaatctctgcaaccgcctgatccttgttcatgttaccgctgatatatgcctgcatcagctcgccaaatttttggtggaacgtatccagcgagtagttaacagacagatcaccggacttcgacgttttcaaaatgctttccatttccttaggcatttccagatcaggaagcggtgcatccttaattggaggaatcaccttcgctacctgggagaaccagttcttaccgtattccgaagtgtacagccagttgaaaaattcaattgtttccttggatacttcggaatccttgttgatacgcagcgcctgatctgcaccggtaataatgaccgattgatccgctttgtcactcaccggatatcccatgatgccaattttgagatcagggttaattttcttgattgcttcctcatcccacgcacctttaccggtcataaatgcagcttttccggatgcaaaatcacttacttccgcattgctgtcccgttccagtggcttatctgtgccatgtttcaccgtcaaatcaatgaagttaaagaagttgttgtacagcactgggtagtccttgatttttgctttgcctgcgataaaatcactaacgagctgtttcggttccacgcctgcatcctgcgcggcagcatctacatagtgttggaagatatgtttccatacccaccactctttatatgcgttggcaaatggagtaatgcccttcgcctctagcttggtgaccgcatcctgcatttctgcaatcgtctttggcggggaagttaccccagccttggtaagcaaatccttattgtaaatcagcgtaaacaggttcccttttaccgggagtcctaatactttgccgtcactggagctcatattcgctcgaacagcatccgtcatggctgctgccagcggctcattggtcagatcggcgctataatctgcatacgtgtcgatgtcgcctcctgccgtcgtttggaatacatccggtgtactacctgaggctattttcgacttcagaatcgtgttgtagtctgcctgcatgatctccagattgatcttcacgttaggtttgaccttcttatactcctcgatatacgcgttaaaagcatcggtatactctggtgaggctgtgaacatgtttattgtaaccgttttcaaatcttctttgccgccagcactttctttcgacgcatccgtgccgccgccgcttccacatccgctcaacaaaccgaccgtcaaaagcaaactgccggataacgccatcatcttctttaacatggatactcccccatttgtttgtgatcaacgtccatgcgatcattctaaaaaatatactcccatttaaaaaggcagattagtgaagcgttaagggtaaaaaagtggtttattgcaggctcacgcgatactcagacggtgacacctgataataattacggaaagccttactgaaataatttttatctttgtagccgagcatatccgagatttcctgtattttcaggttagaatcacccagcagctccttcgccttgtccattctaaccttctgtacatattcgtgaataccgtaaccaaactgctgcttaaacagcttcatcaggtattcccgactcaaaaaataggtttcggcaaaaaacgaaattttgatatcctcaaaataataacggtcgatgtgtcttttgatgtccgttatgtcaaagggctggttccccgcttgagcaagttggaccccagcaatgtaaagctccagcatccgattcaatctctgaccgtagtggacaaagctcgtaaaatcagcagacaaatcgctttcccccacttgctccggttcttccaaagctccatcttgattcaacgctgacgtagacgcacccaactcaatcgcagcttctctcagtaaaaaatggaactccttcatcattcgatccgcatcctgtaaacggaaaatagggcctgatgccaattgttttagcagatcgcccagcagtacctttgcccggttcgcctgacctgtctgagcatccttttggatcgacaacagtcgctccgtccatgacatttcctctaacgtacccgtttgccgtggcactgtatgaagaatagattccccttccagcttcaacacatccgtgctgtgaatgagcatcttggcatccatataagcagacgctagctccaatacatctgtgcagagcttacccaatccggcaactaccaccatgctgaacagcccatgcaggttcgccaccgccttctgtgtcacttgtgccaatagtaaggccatatgttcttcttgtcctggggccaaggtacagatcgaaacgacctcacgctcccgtcgcggatgggagaagctaaaacaactcaaccgttcatctgacgtctgagctaacacattggtcacggcaaaatccatcagatcggcatcgccatgaaaacgtgtcctgcgaatctcatccctgttcagcagccgcagcacgatcaccccaaagcgattccccggctgatccgctccgatcaatgggagcaacgccgtattggcctgccttttgaagctaccgtccaaaatggacaaatatagcttctctttcagcttcggcagtgacatattcagcgtaatgttctggctaatgaacttgtttttgctctgctctcgactttccagaatgtccactgctttacgcagtgcctgattcagatcctgacgattgataggtttgagcagatagtccaccacccgggattgaatcgcctgccgtgtaaattcaaagtcattgtagccactaatgacaatcgtcagcaggtggggatatgccttttcgatggcacgaagaaattcgataccgttcagctcaggcattttcatatcgaccatcaccacagctatatggtgctgacccaacagctccagtcccaaccttccattcgtcgcctcataaatatgttcgatgcccagaccgtcccagtccccgataatacgaatggcttcgcgcaatggctcctcatcgtcaataatcaatacgttatacatgactacttcctccccggggaatttgcattctcatttccgttcccgtttcatccgtaagtatgaataatcctgcctgatctccatacaaaagcttcaaccgtgtgttcagatttttcaaaccaatatgctcgctctcccgttcttcccatttttcatggaatgaatccagcaccattttcagcttgtcctctgaaattccaggtccgttgtccctgactgtaattgtggcatttgtagaactcgattcggctgaaatgacgatcagaatatcgcttgatactttttccaacgcatgcttgatagcgttttccaccaacgtctgcacagataatctcggaatcggcagctccatcagcgtttcttcccataccacttcgacccgcagtctcgctccgaaccttgctttttgcagacctatataccgttcaatgtgcttgagctcttcgcgggcaactacgatatccttgccgttgatggaataccgcaacgtttgggccaacgcatccaccatatccgccatgtcgaacatctcccgctttaatgcctgtgtggatatggcttgcagggcattgtacagaaaatgaggattaatttcagcctccaacgccttgagtatggcgttcttttcgaccagcttcatgcgatagcgctcattaataagttcttcggttctttgtaccatttcgttaaaatgcagcgacaaatatgcaatctcgtcatgtcccttcacaggagctgttgctccaaaatctccggtgctaaaccgcttcatctgggtggacagcttatgtaaaggtcgggtaatggcgttcgaggtcagtgtcactaatataatagacacacctaaaaataaagctccgatggcatagctccaattccgtgttgtcgtagctgcttcataaatctggcggtatgggatgggcttaatgagctgccacccctctttttcaccaacatcatagacgaccaaatactcctgatccccactgctatctgaccacgttactcgcccgcttcttcccttgccgatctgtgtcaacactccagaatcacgcatccgctcatatagcggaaagctgttcacataaaagggaacccctttagggctcattagcatcaattggtcccctttgcccagtggaatgttctgcatgatttcgtccacggcgctcgtattgtaataaaaggacagcaccgcctgcggatggcgggatgcaatcgacctcagcactcgatggtatgccataaagctggcttgtggtgccacatagcccatatcagagcgggaccccacaaaggattgaaatgattcgttcgtggtactagccatcgcctctttataccagggaagcttgggaatatccgtgtttattcctttgcgcaccgtaatgttgtatgtctccctggtgaccacatagtattgatgtcggtccgccacgtacagatagatcgcttccagatcattacgtgaataaaacatgctgcgcaagtaattttcaatgaccattctcgaagcatagtctcgattctcattggcaatggcgttcatgatatcgttataacgaagctgcggaagagccaactgctgcattccctccaagtaatcctccaaattctgattgaccagcaatagattattggtcgtgctggcgatgctatggttaaccgactccttttcaatcatctgataggaaataattgtgagtgagcccaccaccagaataatcaccgaggtaaaaagtagaatgagcttgttcactaatttttgcgtgatcctcctccacatagagcgaagaaacgttcctacacgctctgacatcatgataatcgccccttttgaaagcgtacacatttttaccctcaactgttttcttaaatccattggtccggccctaggggctatcctatactttcattatatcttaaacagcttggagcgaaagagcggaaaatgttgagaaaaagaggtgcgttatgctgaaaaaaaggggaacttggggcgacaagggcagtaaactggaattcggtttattcacactgcccgtaatcctgtgcattacgattgcattttatattccgtttttgatgacgatacgctattccctgacgaagtggaacggcatatccaaacatccgaaatttgtaggtctggataacttcaagcaaatcctgcttggagacgccaattttgcacatgcagcctggtttaccgtcaagtatgccattctgtacattgtattggtgaatgtgctggccattttgctggcgctcgttctcgatatgaagctgaaaagctcggcttggctgcgggcggctttctttatcccgtatatcctcagtctcgtgattgtcggctttatatggaaattcatcttcatgcaaggctttgagtcactgggacacagtacaggctggggcatcttccagctaagctggctgggtgaggaagggctcgcgtttatttccattttggcggtatcgatctggcaatccattggcttttacatggtcatttatattgcaggcttgcaatctgtgccagaggatttaaaagaagcagccattgtcgatggcgcggggccgattcggagatttttcagtattattctaccgatgctcgcaccttccattacgatctcagtcttcatggcactgaccaactcgatcaaagtgtttgacgtcattttatccctgaccggcggtgggcccggtggtacaacatacagcattgcgtatgatatttaccgggacacgttccagaacaatctgtatggctacggaacagccaaagcattgattttattcgttgcagtcctgatcattacgattattcaattgtctattttcaaacgcagggaggttgaagcctgatgcaacgcagccgtacgggacgtattttgctagaagcgggcatgattgtattatcattgttatttttgtacccgctgtttctcgccattaacaattcgttcaaaagcttcgctgaggtcatgaccgacgtcattgcgctgcccaagcagctttcgctggataactacgtatatgtatggaaattcattgactatccacgcctatttctgaataacaccattatcaccgtcgtcggactggcaggtatcgtactgatatcttccatcgcggcctacaagctggcaagaaccaaaagcaaatggagctccgtgatttacatgctgtgcattatgccgatgctgatcccgtttcagtccatcatgctcactgtcttgcgactggcaaaagacttaaatctggcagatagcacttggggacttggcttgctgtattggggcttcggcgcaccgctggcagtgtttatctatcacggcttcgtgaaaggtattccggtcgagattgatgaaagtgccaagatcgatggggcctcgggcttccggcttttcttttccgtgattttccccttgctgaaatcagtcactgctaccattgtcattatcgacgtgatgtggatttggaacgattttctacttccgcttctcatggttaacggctcacctagcaccaagacgctgacactggccgcctacacctttgtcggacagtatacgtcagactggcaatacgccatgaccgcgatggtaatggctgtgctgccctccattatcgtatttatttttctgcaaaaatacattgtcaaaggcgtcgttgctggagccgtcaaaggctgagtcaaggaatcgaagccagatgcaaaaaagaggacttgcgtgttgttcgcgcaagtcctcttgtcttcgtgatatccatcatgggcttctgtacagtattcattaagccttaaactggcctagcgctttcagcatctcttccatagcaagctgtaggtcagcagagcaggtattcagacggttaatctcttccatctggtcggaagctgcaaccgacacttcctgtgagccgccgctcgtcctgcgggcgatgacaataatttcagtagcagaagcggtaacttcctgcacacctgctgacatttgttctgcggttgctgccatgctttcgatccgttctgcaatgtgagtgcttctttctacgatctgttcgaagctgtcatgtgtctcgttcatcatccgcagcccgctgtccacatgcgctaccacatgtccaatcgcttccgccgagcgctgtacatctccatcaatgttttggatgagctgcgccacttgacgggaggctattcccgattgatctgctagcttccgcacctcggatgctacaacctcgaatcctcgtccctgctcacctgcgcgagcagcttcaatagaagcattcagcgccagcagtcccgtctgttcagatattccctgaataacctgcatgattccggtaatttcacctgattgacggtgcagcgcttgaatcagagcatccgtatgctgaatggacgaatgcagctctcccatctgttccaccgtgaggcgcgcggtttccgcgcctgcctccgcctgctgcttggagtagatagcagcttcggcaatctctgaggcgttttccgcgacattctgaatgccctgagccatctcttccatcgccgtctgattttccaatacgcttcgggtctgtgcttcggctccgtctgcaacctgccgtatggtgtctgcgatcctatttgcctctctcgtcgatgcttcagcaatgacggcaagccgtcccgttgaatcggctaccgctccacaagcatgcatgccctcggaaatcaaaatgcccaaattttcccgcatttcgttatagttggtactcagccgcccgagctcatctttgctttgatcatgcagaacagaagtgaaatccccctgacctgccttggcgagcgcctggcctacacggcccagcctgcggtttaccctgctcatgtaccagagaatcacggctagcgacactgcaatagcaatcacaatcacaatcataaattggcggataaacccgctaatgatcccgtcaatgatcgattgcgatgcacctacatatagaatgccaatcacagcaccgtctgcgctacgaatgggtatgtacgcagcttgatacgttttaccaactactaccgcttgaccataatagggttgaccctgctttaagacaacggtagccaccttctcggatactttcgtgcctacagcgcgtttgccctccagcatgacattcgtcgctacccgttgctccccttgaaagaaagtcaccgtatcgcctgttgccccgccaatttcatcgacgatttcttcattattgttaatccgttggcttcccttatataattgcccgtccttgatctgccatgccccgctatatttgtagtccagcaggcgggttgccatattcaagtcatttttagccttttcggtagcaaaagcctcaattccctcctgcattcggctagtaacaacataagcaattacgacagacaacacaaccaaaataccgatcaccataccactaattttagtgcctatccctattgtccgcatgtattggatacgtcctctctaatctgacgccatgccgccacaactctatacaacttaagctcaatctgttccatcatggatacttattttatcgtacaaattacctaaaattttaattatttatcgatttgaaaattaattcagttcttatcaggtgtattggtgttgccttccttgacaattcctcttaataatgatttactaattttactattagtaattattacgattaagtaaaacaaagaaagcacctctgctttcctatctcgcatgataaccactacagcacattcgacatttcatgatactttcgaagggaagagtgattacgttggcaaacgctatggaattggaaaagaaaataccggtcacggtactaagcgggtacctcggctccggcaaaaccaccctgctgaaccatgtgctgaacaaccgggaaggcttgcgggtagcagtcatcgtcaatgatatgagtgaggtaaatattgatgctgatctcgttcgtgaaggtggaggattatctcgtgtggatgagaagctggtggaaatgtccaacggttgtatctgctgcaccttgcgggaagatttattaaaagaggtagaacgactggcactcgacaaaaggtttgactatattcttatcgagtccacgggtataggtgagcccattccggtagcccagaccttcagttatgtagacgaggaaaatggaattgatttgaccaagctgacccgactggatactatggtcaccgtcgtgaatgcaccggaattttggaaggacttctactccagagacttcctcaaggatcgcggacaggaagcctcagaggaggatgcacgcggcatcgttgatctgctcatagagcaggtggaattttgtgatgtgctgatcattaacaaatgcgatctggtatcccctgaggagctagaacgactggaaaaagcgttacgcggcattcaaccaaacgccaaaatcatccgttccgagtacggtaaagtggacccaaaagagattttgaacacgcatcgctttgattttgaaacagctagtcaggcggcaggctggatacaggaaatgaacaaagaagagcatgtaccggagacagaagaatatggcattgcttcgtttgtgtacaagcgcaaaatcccatttcatcccgaacgtttgttgaaatggctggctcaatggcctgctgaggttgtacgctccaagggattggtgtggctcgccacgcagaaccgcactgcttttacattcagccaggcgggtagctccaaacaattcgcacgcgcaggactgtgggtatctgctttgactgaagaagaacgccaatactatctcggtgaagattttgaaaaaacacctgactgggacgaagagtatggtgatcgggttaccaaactcgtatttattggcatcgacatgaaccgggaagaaatcgagcgcaccctggatgagacactgctgacccctgaagaaatggagcaggattggcgcaagcttcctgacccgtttacgaaaaaagtataatgagattataaaataaaaagcgccttaagtgaggaatccccccctcttaggcgctcttatattatttatgcttaacccattgtgcgctatccaccggccaaaaaatcacatccgcacggccaacaatatctttaatagagacaaagccaatagcacgactatccctactattattgcggtggtcacccatcacaaaaatatacccctcaggtaccttggaatcggttatggttccatttggaaaatcaacattgttatatagttctcccttggcgtgcgcatcctgaatagctccctgaatgtatgactcctctactttcttaccgttcacataaagattgtcgccttgatactgaatcgtatctccagccactccaataacacgcttaataaagtctttttgttcctttctcacatggaatacaacaacctcactcggcttgggatcacgaaaatcgtaaatcaccttgttcacgaccactcgttcatctgtcttgaaattcggttccatggacgctccctcaacaataaatggcgcaaataatagccaacgtataatgaacacgagcacaatggctacaataatggccttaagccaatcgatcatctcatttttcactcgtggctgcttttcctgcaattgttcgacagttgaatccgtcaaatgatttccactctccatgcgctacacccaccctttcccacagttttcattcctattatatgtataatgtttaagtataatcaaattttcccagtgtggcaaaactacaactatagttgaaacaaaagtgtgaactttttttcacaatatcataaaaacagtaaaaaactgttgatgcaaacgttaacatatattacactgtgcatatacttcttagagcgttttggactaatggtagatcaatctgttcccccaggaggtgtcctgtttttagtggaaagacagcatgagtcacttttatagatgctatcttcttttaaaatatgagctcaaataaggaggaaattacatgtttaaacgaaatgatcgtccaaaaaccggctttaacgctctaagactcggtgtttcttttgtttttgcttcttcttgccttattggaaccgcttacgcagatacgttatccaacgacaccccttcttccgcacttacagaagaggcagttagtacaaccgactcaaccaccgtctccacaacattagcggcaggagatttgtatgtggcgccaaatggtaacgtgtccaatccgggtacaatatccagtcctaccacgctcgaagcagcacttacacaaattgctcctggtaaaaccatttacctgcgcggtggtaactacacctactcctcaacgattacaattcagcgtgaaaatagcggcaataacggctcactcaaagggttggtcgcttacggtagtgaaaagccagtacttgatttctctgctcaagcctttggttcagccaatcgtggacttcagcttaacggagacttttggctggtaaagggccttgaagtaaagggggccggagataatggtatctatatcggcggcagcaataaccgaatcgaaaacgtggaaacccaccacaaccgggatactggacttcagcttggacgttactcccctaacgcttccaatagtgagtggccatcgaacaatttgattttgaattcttactctcacgataacgctgatcccgataatggtgaggatgccgatggcttcgctgccaaattgactgtgggatcaggcaatgtgtttgataactgcttggctgcgtacaacgtagacgatggctgggatttgtatagcaaaaccgaaacgggtcctatcggcgaagtaaccattttgaacagtgtggcccaccacaacgggcagaccgcagatggaacgtctaccgcgaacagcgacggcaacggctttaagctgggtggagacaaaatcaaagtcaaccatattgtgaaaaacagtattgctttccagaacaaaaaacacggcttcacctacaatagcaaccccggcagcattacgttgaccaataatacttcgtgggacaatggacaaagtaattttgcttttgacaagggtgatcacgtgttcattaacaatctttcctttgagggaagcgccagtgacaaaacaagcggtacagatcaagacaactctagcgtttggtggaaaaacaaaaaatcgacaaatgccaaaggtctggtagtcagtgcagacgactttgttagtctcacgccttccatcactcgaagtgcagacggttccatccagctaggtgatttccttaagctggccaaaggaagcgatctgatcggctcgggtactccgagcggaaaaaatataggggcacgttaaaagccccgcctaatcaggacgccctggcccatctaccaactcagacaattttgcataatatagcgaccggtgattgtcctcataaccagacaaaatatgaggtgaacagatcatggaacgaagaatcacactgaaacatacactcgcctatggaagcggtaacatgctaggaagtggcgcacttgctattagtggtgcatggttaatgtacttttatacaaccttttgcggactgtctcccgttcaggccgcggccattttctctgttgccagcatcatagatgcagtcagcaatccgatcatgggctttatcagcgataactttcaccggacccgcttgggccgtaaattcggcagacgacgctttttcatcatgatgggtatcccgctgatgctcgtgtatccgatgctttgggtagatgggttgggcttctggtattacctgagcacgtacgtgctgtttgaactagtgtatacctctgtcatggtgccgtatgaagcactagcgtcagagatgacccgagacttcggcgcacgctccagattgactggatggaaggccatgtttggcaaaattgccaatttcgctgccgcttttatccctggtcgctttattgccgagtatggcaaagactctccattgcctttcttttataccggtctcgtttttgcagctattctgctgattgcgatggcattcttgtacaaaaactcctgggaacgtccaagtgaggaactgcaaaaggaactggaaggtgaagctccgctatcctttatagattcgatgaaaaagttgtttgtcgacatttcctctaccttccgagtcaaaacgttccgtcatcatctcgggatgtacctgggcggcttttcagctgagtggctgtttacttctgcttttacgtactttattgtcttctccttgttccaaagctcggagatggtatcgaatttgaacagctttaactctgtcattcaattgatttctacctatttcttcatccaattctgcgtgcgtaaagggttccgtatgcctttcatcgccgcactcgttgtcgtttgctttagcgtagcaggttatggcctgctctatataacgggagcctcgaatacgatggtatggctatatgtcatcaccctgttcatggggcttggtactgggggcgtctactacattccttggaatcaatacacgttccttgccgatgtggatgaagcgttgaccggccgtcgccgggaaggtatttatgcaggtatgatgacttttgccggaaaaatggtgcgggccgttgtcgtcttcattctcggctgggtgttacagcattttggttttgtatccggggctgatagtcagcccgtcgctgctcagcacgccatcttttatgtactcgtggttggtactatcgttctcgcgatcatcggtatgattgcttctgtcgtgatgaagctggatattgacagccacaagaagctaatcgccgaaattgaccgcctcaaaaacggtggctccatgaaatcagctaaaccggaagcccggaaggtattcgaggaactgacaggcttccattacgatcggtgctggggtaacaataatgtgggcttcaagaacaaacccgttgaccctaagacacacactccatctatgtaacaacaataacaattacagattaaacatttactaaagaggtgactgtatcatggcaaatccaacatcacaaccaaccaccagtcctacaaaaacagattcttgggctgtacgtatgagcgattcagttctacaacggagcccggaattttacgaaaaatgggaatatgaccatggcgtgatttacagaggtctggaatgggttggcgaactgacaggcgatcccaagtacatggaatttataaaaaaacatatggatcattttgttgacgaaaatggcgtaattcagcgctataaagtagatgagtacaatattgaccacgtgaataacggcaagctgctcttctctctgtatcgtgccacaggagatgaacgatacaaaaaggcagcctaccaattacgaagtcagttggaaaaacacccacgcacaagcgagggcgcattctggcataagcaaatttatccgtatcaaatttggctcgacggcttgtacatgggtgccccgttctacgctgaatttatccgcgaattcggagatccgtcagagtttgacgatgtgaccctacaattcaagctttgctacaagcatacgcgtgatcctgaaacgggtctgctctaccatgcttgggatgagaagggtgagcagcattggtgcaacccggaaacaggctgttccaaaaatttctggggacgctcgatgggttggttcgttatggcactcgttgacgtgctggactatattccagaggatcatgcagaccgtcctgtcctgatcgatatgctgacggaaacactggaagccctgctgaaagtgcgtgataaagaaagtggagtcttttatcaagtgctcaacctgggccatgtgaaaggcaactatctggaagcctctgcttcctgcatgattctttatgctattgccaagggcgttcgcaaaggctatctgccagagcaatatcgtcaagaggcagaaatcatccgtaagggaattatcgatgaatttatcacgattactgaagaaggactcgtaaatctgaacaaaacggtgcaagtaagcggtttgggtggtaaagatcgtcgggatggtaccttcgcttactatatcagcgagccgattataaccaatgatcccaaaggtatcggagctttcattcaggcgatgggtgaagcagaacgcatctaaaatacgcgaacgatataccttaatagcaaaaaggacggtggccatcagccccgtcctttcctcatttatgcctatcttacttacttcataactttaaattcatatccctgtttcttcagatattctatgatttgcggcaatgctttggctgtttcttctttaccataggtgtcatgcatgagtataattgctttttctcgacctttgactgaccttataaactggttgattagtgccggtgctttcttggatcttccctctgcatccttcgttaatacattccagtccacctgatggtaatccttttgacgcaaaaccttatccagagcagccattccctgtggatctcttctgttccatgtcatgtgccccccagggaagcggatcattctggtggagaattccggccccagaatactttttagaacctgattgttcttctcgatctcctgcataacatggtccgtgcttacccgcctgttaggatataaatacttataattatgagagtacgtgtggtttcctatcgcgtgaccctctttaacaattcttctgataaggttcctggtatgctcattttcattggcttctttacctacaataaaaaaagttgccttgaccttctgctttttcagaatatccaatatctgaggtgtgaccgtcacggatggtccgtcatcaaaggataagtaggccacttttttaccatcggctccatcgggcatttgtcctagcatttgctgatttaaatatttttcaacaaaggcaccgtcttctacatcgggatcgttttttggagaggccgctttaccctttgcccctgcgctggatttaacgtttgatgatccggaatccgtttttttagcaagctcctgggtcggcgcgtgtggcttactatccgaaacctttatcgcaatgaaagtaatgcagcctgccacaaataatataatagcaatcagtatcagccttcttctgttcctcttcaagcggtgctcactcgttctactatgtgaatagcccttttccattagcttatgtacctccatactaaaataagaaaaaccaccggatcagggttggtgtacacaccttagaatagacattggaaaaacccttaggtttagccgatgaaaatttagggatgcgcttcaaccagaggacaacctactcccggtggctttcttgtcttgcatttacataattatgagtatcattgcagtttattacgattgcttcgtgagggcctgagccaacaaggacgcataagctttagcacctttaggttttaaatgtactccgtcatgctcgaaataggagtttttaccagagctggctccataccagtcaatcattgtaattcgcgggtcctgggacgctgcttcggcaagatgcttgttcacaatactctcccacggccgaggcacacgggtattcacaagtataatacgcttcgcatccttcaggctagccaacagatcggataactggtccttggtgaaagcgccgttcgtgcccagctcaataataaccgtcttaccgagctgtccgttctgtcttagctgctccagtacggcaggcgcctccgccatctgacggccgatccgcccatctacaacagctcccgggaaggattcctgaatgtacgactgtacatccaacatgacagagtctccaatggcggtaacactcgagccatcacctgtcataggcgtagcttctttgggtttgtccgcaggttccgacggtttcgtaacatcgtccgtagtaccagcctggaccgccgtattcttaggcgtctgggtttgagacgggactggggtctgcgccttgctgccctcggacccttgcagcttgatggcttggggctccttggaagccacggataccgttccgtgaagcggcggcatcgcctttgcctttgcgactggattctcatcgcttgatgccgcctgaatcgttgcatcaggagaagccacgtacaggtggacggtacccacgagaatacctacaaacagcacagccgctgtagttgtaggcatccatctccaccgtgcctgtctacgaaccgcagaacggattcctgtgatccagtggcggaatcctccatggcggatcggctcctcgatatatttaaacgagagagacgccagcaatacggtagctagcaattgtaaaatgatgcgcagcacatgcacgccatcggtatctacctgaggcgtcgttagcgtgataaccggaacatgccacagatacagtccgtaggaacgggctccaatccaacgtagcggcttgattccaagcagacgaccaaggtggcttaccggatgtgccaacgctgcgaccacaatagcagtgactaaagctatgcccagtaggccgccccggtacagagaggggtcatattcattcgaggcccacgcccagtgacaaagcaacagcaagcttattgcaccgatgctgtccagaagcatacgcgccttagcagaagcttgctctttcagcttgccgcttggccacaccaaggccagcgctgcaccaattagtaaagcaaatccacgcgtatccgtgccgtaatacacccggctcgggtcgcttcccggtacgtaaatcacggccatcaggagcgcagatattaacgccagacaagtcacccagcctgcaagcacaatacgcttgggcatgaattttagcccgagcgccagcagtaaaggccacaggatataaaactgctcctccaccgccagcgaccacagatgcccaagcggagaaggggggccgaaactttcaaaatacgaaacctgatggaaaataaaccaccaattactcatatacaccaatgcggcaggaacatctccacgcaaggccgttagccgtgacggatcgaagagcaacgagcacaggacgatgacagccacaaccgtcaacatggcaggcagcaaccttctggcacgacgcagccagaaatctttcattttaaaactatgatatgtatcccactgactcaccaaaatatctgtaatcagataccccgacaacgtaaaaaacacgcctacacccaacaaaccacccggcaaccaatccggattcagatgatacacaatgactgcgatgaccgccagcgctcttaaaccatccaaacctggcatataacgacgttgtgacgacaaccgattagacttcatttcagccgccgtccttcttgcaaattcaagctccctgtctgtttcaatgctcttctgccctttccctctcctgcacatcgtctgcgatgccctgtagccttttcattcattatataaaacttcataatcgtaatgatttcaatgaagttaaaattaatgacaatgtttttattatatcattcctttccacagttaggtaaccactgatagatatacaaaaaaaggcatctcttcccttaggaagaaaatgcctttttattagtattctattctcttaaaatttgatgatacctgaggtatgaaggaagaccaacaacatcaggatcggtgcaacataccgaagaccgaataaccatacgttgaaccagaagggtttgatgttcgcatgctcagccgcagtcttccaataataacctgtgaatataacaatcaacaaaccgcctaacggtaagaagatgttggatgcggtaaagtctacgaaatcaaagaatgatttatcccctacttttagttcaggcaccagccccatggacaatgcagaagggacgcccagcatcaagcacaggaccgatacgacgataacggagcgaacccggctccaacgcatacgctccatgacataggctactggaacttccagcaaggataccatagaacctaatgcagcaaccgccagcagtacgaagaacaaaccgccgaagaatgcaccaaaaggcattgccgagaaagcagccggtaaagcaatgaaaaccagcgatggtccttgagccggattaattccgaaggagaaggttgtagggaaaataatcatacctgcgataaacgcatagattaaatctccgccaccaacggccagcatagctccacccagcgattgacggcgatctacgtacgcaccgtacgtgatcataattcccatccccagtgagagtgagaagaaggcatgtcccaaagcaaccaatgcagactctatacttagcttagagaagtcgggattcagaaagaaggatacgcccgcaccagagcctggcagcataagagcgttaatcatcaacacgagcaacaggatgaccttggcaggaatcaaaattttattgaacttttcaatcccgttcgataccccaagagttaccacgactgctgtaaatgcaaaaacaactaacagccaaaccaacggcgcatagccggaggaaaaagaagcgaactgtccagcaaaatcattattcgaaaacagatttccgctaaatgcctcaacggcataatgcagtgtccagccccctacaatggcatagaacgacaagataacaaacggcacgataacaaacatgatgctcatcttgccccaaatcggatgaccgcctacttttaccattgcagaagcagcacttcctcgacctgcacgaccaagtgcaagctccgctaaaagtacaggcaaaccaacaagcaacaggcagacaataaacaataagaaaaatgcagctccgccatattgtcctgtaatatacggaaatttccaaatgttacctagtcctgccgcactgccgatcgccgccaatataaatccagcagacgagaagcgttcatttttatcagacaggctattctgccccttgctcaaactcattatatccccctcattctctctacttacgcataaactgagcatgcgtacataaataatttttactcattatagcgtaagtaggatgtaaggtcatgcataatttttcactattaccggatttattttcataatgttcggtatctacaaaatacaacagaaaactacatattttcttcaacatccttctttattatggtctctcccatgcgattagatactttttgataaatatacgaaatcgccaacagtacaacaccaaaagagaagtaggctacaatcgtgcttccagtcgttaacagatgtagatcatacaacagcagcttacctgtcgacagcaaggtcaagcccaatccaaatctgcgaatgtagaccactcgcttgaggaagccgtatacaatatacaaaatggctagtagcaaatacaccagactgaacacaagaccagcatcccccagacggaactgaactccgagaaaggccgttatgatgcccagcaaatatacacccataatgaccggatacaactcgttacttctataatgtcgggtcatcagtgcgttcaggaaatccctgctgctgaagaataccagcacattaaaggctgcgagtaccaccaatgccacataatcagcagccgtattttgcgcataattttcatgcaaggtcggaaccgttacagtaaccaccagtgccagcgcgtagcctatgacgtacaacgccaagctgtagtatttaatcacccgatcatacagcaacctcaccttaggcaggaaataagccaacaccagcgatacgcaggcatacaacaatactttgtacaaggtgtaatgagcaaactcgtcggataagacgatgttataccaatgcccggcttcatacaaaaggtagaaatatacgttcaccaaagctacatatttaaatccttgcatgatatgcatttcgtacaaccgattgtttttgaaagcattcggacggctaaattcaatcgcatagaagacggtaacgatcaacattcccagtgtaatgagcgtatatttgagtccaaaatagtctgtctcaaatcctgacaacagatatatagggaaatcgacgaaaaagaatgcgcccagacacagtaataaaatgccccagccagctcgttccaattccttcaaccggtaacggtgtccatataatgtaaggagaactgcttcgatcaaccaccccatagataaccatctaactccaaactggaacggaatcatgaggatggcaaaggtcaaagaagtcgcataaaataatattttagtttgtttctcctctggaatatatcgacggacccattgtcccagacctccgtacaccaagcaaaagaccagagccagcaagcctttataatcatccaggcctgcatcgccgaatagagaatacagaacggaacagctcacgactgtattcagagccaatagggagaaatccagccatgacagttttgtttttaaacggaacggcacccacagtgtcatcccgaggtacatcgcaaatgtaatgactgcatacagcatgctcgctacggtgctttccgataaccacgccagcacaatcatcaagggcgtattaagcagaaagctgatatattgcacgacgacccagcgtttgcggaaggatacaagcagaatcagcaagtttaacaggaacaaatagcccatggcgatatacacggcgttcccttccagcccgttggctgccatataagaaaagagcggaagatacccccctactaagccgaaagagcatatcgttcgggattcataccttaatgacagtagcacagcggtcaccgtaacgagtacggacaagcctatgcctgtatacattcctatgatttctaacaaaaagtagctgtaaaaaattgatccgtacagtacagaaataccgccgcccaaaataccgagcgcaaaggtctgcttctgcttgcggtacagccattcgccgcctcctagcatcagcgctcctagcagaaagaaggccacgcccttcatatttcctgtgaaccagttcgaatatgagtatttaaaagcggctcccacacccaatataattagcaaaatccccagcttgttgatccagttcaagcctagcttcatttcaaactgattttgcttcatgcgcttctgcatcgtttcctcgctgatctcttcttctccgagttgctgaaactcgcttgccgtctgatgaagcaattggcgctcggcctcctgaaaccgctcgcgttgttccatgatccggtcacgaatctcctctgagaacagtcgtaatctggcgacgatctcgtcctgatcttctttaagctcatgcgtagtttgctgaataagctggtccacccggtttttagccccatattcaaaggatgtcagccgatttttcccttctgcggttctggaagcaaaataggtctccagcttttcacgcgaaatgcgaatcatattcgccttttcactcagcatttgctccgtcagcgcagtgcgcagctttccattttcctgctcaatatgtcgtactcgctcttccaagtgaatgcagcgagcctgatgatcctcgaacttttttcgcagaacctcattctccaaaatgatatctgaggcttcatagtccgcgattaatgtttgatactccttgagcagcttgttctgttcttggcggatcgtatgtaaacgatctttaaaatcctccatgttctcctccattgctgtccattttggtaatcattacattttacatgaaattaaaaagtcattatagagactatagcccattttggacggtaaattggggcttttacttatatattcttccagtttcatgatcgcagatgaagtaggatggatatacatatgaaataaagcctacctttccccttcgcaaacatgaaatccgcatagatgtgttgcagagtctacgctgtgtatttatttttattggaaagatcacgatgaaaaaaagaaagaaccccgtaggattcttccttacacaaaattaatactttttcatgaaagtcgtcacagactttagagctttctgcatgtcacttaaaattagctttcttattttttgtaatgagtgtaaattttaacgattggttattcttccttaacataagtacgtcatatgaaataattactttggttttatctgtagcctctggaacattgtaaaccacttcattttgactgaagtttttccacaaataattcatccttcgttttgattctgtcaggatactgagaggggtaaaagaagtgatgaatattgataatctccaaaagttgatgtgcgcaaccttttggattataataatcatgtttatattttttggatttattacataaaattataaagggtgatgacaatgaatagggctgcgacaggaacaatattttgttttatatctgctatgttgtattcttcttattatctttgtgcagcaattacaggagccgggcagttaaatcctttttatgctccgtttggttctttaaaagtttttgccgtaatggctttgattattggagtagcttacttaattataagtgaatatggatatttgaaaaaaaagaagaaggcctaggcc

SEQ ID NO: 30 - DNA, 224526 bp, Unknown
  Kingdom: Bacteria, Phylum: Firmicutes, Class: Bacilli, Order: Bacillales, Family: Paenibacillaceae, Genus: Paenibacillus
  misc_feature (191818)..(191819): n is a, c, g, or t
accgtaaacgaaaagagacgattgagcgaagcttcgcggatgccaaagagctccatgggtttcgctattgccgtttgcgcggacttccgaacgtcagggaacaagccctcatgacggcaaccgtgcagaacatgaagaagatggcgatccacctggatcgcctggagaaacaggggtaacaccccgtttctcccagataccagaccattattatgtaaagaaaaagaacccgcgtcttaaaaagacggggtttctcgacaatctggcagcccctacagggctgcttttgtactacgggctaattgctcgtgtattttacccaatcatattcagcgtatagcggattcactccattatacgaacccagccagtcgtcaacgccagtaccattccataaattcatcataatcttgcctggcgtgcttggtatgtttgaagttgccgtatgctttaaaaccccgtcaacataccacttaatgtaccctggctgccaatcgaaagcataggtgtggaagccacttgatgcatcaaagcccagatcaacaatcttctcgtgacccccgaccccgtttgtataatagttgaattgcacttttgtcgtgtctttgcctaaaaattcaatatctatttcatcccattgtgtgccatcagtaggtcccgtatacgtaaaaaaggaagatacgatcccagtattattagcaggcttcatgctgacctcgtataagccgtatctgtaagtgttcgtcgatcgatactctccgcagtcaaatttattgtacgcagaacttgttaagccaagcttcattttgccatcgttcgtaaaattgacattattggcacgccaagtgcaattaaacatgttcccattggaatatccatccgccttttgccatgcaccagaattgaaactattaagtggttcccaaaaaacattccccgcataaacgcttaccgaaaaaaacagagagacaatacccgtgaccattaaagtaaaccaagatttcttcttcactttacacctccataaaagattgaccaaacatgaaagaaacggctggcaataatacattatttcaagtattgaccggcttatcgaaaaaatataaaactcttccatatttggtatcttcattgtagcttgaaattgaggcgtagactatagcaaacttaacacttgaaaaaaattttaaaaaaactaaattttatcaagttgtggtttggaaatgtaagttatacaattagatgcaagaaatacaaataaacgttataattttccattaagggagatgatgattttgcaataggatagactcaggaagcggagccactacatgtttataccattttattcttttggcataatagtcaattaaatttttgaggaggaggcctttctttgaaaaaattaggtatggtatgtaaaatagttttgatacttgtattcatattgcctttaaaaccggtgtttgaccaacatatagatgcatggtcaggtatgcccatgggagagctccatgtcaggggcaatcaattggtgaacagcagcggaaaacctgttgttttgagtggctggcatcagccgtcgggagcatactggacctatcaaaacagtaattattatctcaatttgaatggtaacaatcgtcatgcagcaatgttggcttatttgaaggatatcaccgacacctttacagacaccagaccgaagtatggaagcaaccacggttggtatatgaatcaggtccgattgtttattgaccgccaggatatgggagatgtggccgcagggtcatacaacttcgccggtttacaggcagttacacaaaatgtaattattccatacatcaattatgcgaaaacaaagggcgtttatgttacccttggtcttgatttcactttggctaacgaccaggctacaacacaatccaatttggacaaatttaatcaaatctgggggtatcttgcctcgcagccgtctattaatagcgcggataacgtcatgtttgaactgatcaacgagccaattaagtcgtatgcgaatgggcattggggaggctatcccggcgagaatgattttcttgaccattggaatgatctgagaagattccagaactctatcatttccacgattcgaagtaaaggagcggataatgtcatctgggctgcaggacttggatacaaccaattttacagcccggtggcaaaacacccgctgacagaccccttgaacaactacggctatgctgtccactggtatccgggctacggagcttatgataacaaggacaagctgcaatcgcaatggaattccaacattaaggcggcagctcaagcctatccaataaatattacagaatttacctggttcaaaacacaacctggcgattcagagtactggaatttgtttaacggctctaatgatggatttgggaaaaacacgaagtccatatttacagcagccggtaatgtcagcatgaccgcacacatgaatggctttctgctggaatctggagcaaggagttcatttgcggacccaacagcagggttaaagtgggatggcgatacccgacgtcaggcgatggcccgcttcttgtttaactggtactatgagcgtgcacaggcctatccgagagcactactccagaacagtgaatcggcaacggatagtgtgcctgcggatgcaccgactgatgtgcttacagatacatacattaatgcaccgactgacgcacaatcagaatgatgttaatactttcagcaaccaacagcctatccaattggataggctgtcgtattattttatagaaatgagaattcaaaatcactcagcaggcggtgaacaaatggaagaagaaagctcttcgtgaattatgtatgatgatcagtttatatgaagttagtagaacttgctgtaacctctaatttgggattcgcaaagttcagtcacctaacatttacggccatttttaggcttctgttatgtaaggttgttgaaatgatgaggagagagtatagtttgtatgtatttattttgtgcgggaagaggttaatatggcgacaattcatgatgtagcattaaaagcgggcgtgtcggtcacaacagtatcccgtgtaatgaacaaccggggatatatcagcgaaactacacgcaaaaaagtgttcgacgcaatggaggaacttaattatcaaccgaatgaaatagcacgatccctattgcgcaagcagtctaatattattggcctgattattcccgatgtctcgcatcctttcttcagtgagcttgccaatcaggttgagttctatgcctatcagcaaaactgcaaggtcctgctgtgcaattcccatatggatcccgtgaaggaaaaagtgtatatcgatatgttgaagcggaaccgggtggatggcatcattatgggtagccatacattagaagtagaagagtaccgacatttgaattcaccgattgtgacatttgatagacagattgacccgtgtattccttacatatcctcggataattatcgcggaggcgagctggctacggagctgctcatcagcaaaggctgccagaaaattgcgcatatatgcggaaatctggagctgaacatgctgtccaatgagcggaccaaagcattccgggatgtcgtgggcagggatggtgtccagcatgtgatcgttcaaacagacttgaatgtgttcgaccagaaggagtacgagcgaatcatttcaaaactcgttcatgaacatccggatgttgatggagtgttcgcaacaagtgatattattgctgcttttgcgctgaaagaatatattcgcgctggaaggcatgtgccagagaatgtacgcattgtaggcttcgatgatgtaagcgttgcttcctggctgacgccggaacttacatcggtaagacagccgattgcagacatcggcagactggcggtcgagctgatccgcaggcaggcggaaggggagcaggtacaacctgtcaatctgctgcctgttgaactaattgagcgtgcaacgacctgaatgaaaatctgttcctctaacagggggaacagattttttttagtacatgttaaaaatttaacatgtcaaacgattgacacaaattaaacctttgacatataatccatttgtaagcgttttatttaagcgttcagagccattatataaataaggggatgacaacaatgaggaaattcaaaagagttcaatggatggtaatgctgcttcttttggttatggtggtgtctgcatgcagtggctccggaggagaaggtaattcggcttctggagggggatcaggggattcgaaaaatgtgaaaattacgcttttgaactccaaaggcgaaatccttccacagctggaggaagccgcgaaggcgttccagaaagacaatccgggcattactgttgaaatccagccggttccgactggtggatctccttttgagcgtgcctctgccttgtatgcatcaggaaacccaccgaccatgatcatgctagatacaggtgatgttgagaaatttaaggaccgtatcctcgatctaagcggggaaaagtggaatgcggacactgttgaaaacgctaccactgctacgacagttgatggtaaaaattacgcgtttccactggctgttgaaggctacggattcatttacaacaaagccgttgtagataaagcggtaggcggaagctttgatcccaccacaattaaaacccgaaatgaccttgaaaaactgtttcagcaaatcgagacatccggaaagaaagcactggtgatttcatcaatggactggtccctgggcgctcattatttgcctcttgcttatgcaggccagaacaaagacatggctgaagtggacaaattcatggcgtcactaaaagcgggccaggcggacttggctaataatcctgtatttaacggacttatggatacattcgacgtcatgatgaaatacaatatcgatcaggcttctccgctagcaggaacttatgaacgcggaccggaactgctcggcaaaggtgaagttggcatttggttcatgggcaactgggcatggccgcaaatcaacagttttgataccgctaacaaagaatatggttttctgcctgtacccatcagcaacaatgccgatgactacggcaatcaggagatttcgtctgctgtatccaagcgcattgttattgacaaggagaagactactccagaacagcaagaggcggcgaagaagttcctgaactggatcgtctatgaagagaaaggccaggatttcctcgtgaaccaagcaaacatcatcccggcgttcaaaaatattacactacctgcggccgatccgcttggaaagtccatccaggattatatcgcaaaaggcaagtcagagcagtcgatgagtatgctgcctgccgaccactggtccaagactggatcttccatgcaaaagtatctggcgaaacagggcgatcgtgcaacactggttaaagaaatcgaaaactactggaagaccgtaaaataaggttgttttcaaagtacccggaatagagagagaaatcagggacaaagagagggggatcatcatgattgcggaaaaaggagtatggaatcggctgcggacgcggctgctgtttaccggaccaaccttgtttgccttcataacggtaatgatcattccatttttgtacggcatctatctgacgttcacaaactgggatggtatttccaccacactatcgctggttggcgtccaaaactatctggctgtttttagagatattgagttttggaaatcgttcagcttgacgctcaagtatgtgttttataccgttgttcttatcaatgtgatcgcttttatgctggcttatgtgctgacaaaagggttaaaaggacagagtattttccgggcgggatttttcctgcccaaccttgtcggcggcattgtactcggttttatatggcagtttatattcaacaacgtgcttgtctatttgggacaacatgccagcatacagtcgctcagcacgacttggctggctgatcccgacaaagcgttctgggcactcgtgattgtaaccgtgtggcagaacgcgggttacatgatggtcatttacatcgcagggttgactggtgtcccgaatgatattatggaggccgcaagcattgatggggcaaacagctggaccagactgcggaaaatggtgctgcccttgatggttccttctttcatcgtatgtatattcttgtccctgcagcgcggatttatggtctatgacgtgaaccttgcactcacgaaaggtgggccgttcagcagtactcaaatggtgtcgatgcatgtgtatgaaaaggcattcctttcccgtgattatggtgtggggcaggcagaagcattcgtgttgttcctgatggttgctctcatcactctacttcaggtttattttagcaagaagttggaggtggaggcgtaatgacaagaaaaagaattgcttcctccgtgatcaaattcattgtgctgacagtcatactcatattgttcatcgtacctttcgtctttctgctgatcaattcgttcaaggaaaacatggccatcacctcaaatccgttatcgcttccagagagcttcaatatggtcaattatatgaatgcatttgataaaatgaattacatcgctgccttcaccaactcattggtcataacggtgttaagtgttctgtttatttcactgttcgcggcgatgacggcccattattttgtcagaaacaacaccaagttcaaccaatatacatttatgctgatggttgcatccatgatcattccattccaggctatcatgattccattggtgaaaatctacgggtcacttgatctgctgaacagcaagtggtcgttgatttacatgtatatcggttttggcagctcgctggccgtcttcatttatcatggttttgtaaagagtattccaaaggaactggaggaagcggcgctaattgacggttgcacgcggtttcagacattcttccggattgtgtttccggtactgatgcccacgactgccaccatttccattctcaatgtactgtggatctggaatgattttctgctgccttccctcattctggtcgatccggagcaaaggacacttccgttgtccacgtataacttttatggaacctatacagtggattatggtccattgatggcaagtttggtactgacgatatttccgatcattatcatctatctgttcgcccagaagtatattattcagggtgttatgcaaggctcgattaaataactgcagggggaggatgctttatcaaacagactagaacgtatacgagagagcgtgcagatcaatttatttcccaatcgaagcatatgcttcggccagattatcggctgcactaccatttaatggctgaattgggctggatgaatgatccgaatggcttcattcaatataacgggcaatatcacttgttctatcaacattacccgtataaatcagtatggggaccgatgcactggggacatgcagtcagccgcgatcttatgaagtgggattatctaccgatcgctttggcaccggacggtgagttcgaccaggatggctgcttctctggcagtgcgattgagcgggacggaaagcttgtcctgatgtataccggacatgttgtaaccgggcctgacaaagatcaggattacaagcagtcgcagggaattgcagtatcagaagacggaataaggttcgaaaagtgggagggcaacccggtcatcggttatgacgctataccggacacgatcagccgtaaagacttccgtgaccctaaggtgtttaggcacgaagatcaatattacgccgttctcggttctaatgatgccaaagggaacggacttgtactgctttaccgttctgaagacctgaaaagctggacgtatgtcaatatactagccgtgagtgacggacgcttcggcgataattgggagtgtccagatctgttcccgctcggtggtcggcacgtatttatgctatccccgcagcgcatgcctgcacagggggaggcttaccgcaatctgcattccaccatgtacggtataggtgatttcaattccgctgccggaacatttacggcagagcggtatgctcaggtggatcacggattcgatttctatgcaccacagtcaaccttggatgataaagggcggcgtatcgtcatcggatggatggatatgtgggaatcggagatgccgactcaggaggggcaccattgggctggtgcgatgagtcttccgcgggaagcggttatcgacggcgccaggctgctgttccgtccacttgaagaggtaaagaattaccgatgcaatctgttcgagcagcgagatatcttactgacaggtgagcagattatggacacgcgcggagatagctacgaactgaaggtcgtatttgagtttgagtccagtaacaccgatgaattcggtttgaaactgcgggtgggtagcgaggaggagactgtactgtcgtaccgtcccgatgacggtctgttccgttttaaccgagaacgtgccggtataggcccgggtggagagagaagagtgcctttgggcttaaacgagggccgcctggagcttcgggtttttgtcgataaaagctcggtggaaatattcatcggcgacggtgaatacgtcctcacaggaagagtgtatccgggattggaatctacgggcattcgagcgttcgcgaacggaaactgtacgattgcctcgttccagaagtgggatatcctcacatagaatcgcatacaaacaggaacctgaccgtggatggtcagattcctgtttttttgtggccattttgctcgtgtgattttaggcgtgcttatgttgcagataagcatcaagataagcatcaatttttgcgagagcttcttttgtaccgccggattgctggaagctgtcatttattttttgtacgccctctttatacgctgcgtttgacactacctcatgtacggcatctcttaacgtttgtgtattgatttgatccttagttattcgatagcccgcttgaagttccgttaaccgctgcgcgaccatgggctgatccttgtcctgaggcagcacgaccaagggtacattaaagtgaattccttcattcacactgttcattccaccatgagtaataaatacatctgaatgacgtaatacctccaattgaggaacataagacgagatgataaagtgctcaggagccgggttaattttggtaaagtcagctttctcgccagctgcaatcacgacgatgccttcaaaatcggaaaaagcctcaatgcaggtgttaaaaaagtcttcagtgtggtccagcacagttcccatcgaaatatataaaacctttttaccctgtaggctgtccagagggaatgaattttctcctttgcgctccgggaagctggggccaataaaaagatgctcgtccccaaattgttcaccattcggttgaaaatatctgctcgtatatacaacattcaaagctcctgaattgttcataaattgaaccagatctttgggagcaacaccgaacctttctttcatgagatgcagtgaagacgtgacttgttcatcaggctgaaacggtactttagcgtcggagcggaagagattggcagccatcagatgatttgaaatgagaaaagatggggatgaagaaatgcctggaatattcaagtaatctcttactaattcaccagctccgaatcgatcatagaacaccaagtcaaattgaatacgctcggacagctcctgagtgatggctaagatgtccatcgaagtctggatatgaatattcataaatgcgttcagtcctgccggagtgttggtatcaatggaagcagtcctgactagatcaggatgcaggtgaaccttcgctccaactgcttcgagtctattcttgtatttctcagttgtaatgtaatgaacctggtcccctcgtgctgcaaaggcttgcgtgatcccaagcgtggggtttacatgtccttctgccggaaagttaaccattaatacgtttaacatccatcattactcctttccttctctttcatttaagatgcagttttcactgaatctcttaatccataataacaataatatttattttttcaaatgatatcctttcatgatcgtgaaacacatgttggcatgaaatgtgtataacaaatatttaactcgtgcatagtaaaggcgaactctacttagcaagggaggttttttctaagtgaatgttcaaagagcgcaagaaatagcgtcctcttccattatggcgaatgtgttgtgtgatgggttacccatttatattcagcatgtgaacgagcagagtgagacggcacgcatttatgcgctgaacaatccggaagaggaacgggaagtacctttgtacacgttaacggaacgagatcaggcactggaataagaaaggagcgctatgaataatgaaacccaatcaacagaaagaaatcgaggcagaccgcttgaattttcgtgaccagacggatgatgtggttagagaagtaccggccacgacggatgccagcgaagccgttgcagcaataacttcacatatcaataaatacgatgtaccggatgagttggaggagaaatagagaatgaccaagcgcgcacgggataacctgttgcgtgctttttatatgacacatatttggctggagtcgaacaaatagtatttaatgcccaaacgtacaaatgatattgcccatgtgtacgtttttttctgtttgtttttttgtaaaataataataaatgatttctgtccaaactaaattgaccaggtcgtcatagcggcgttgtctctaataagttgaaaagccgaattcagaattgtaggagggaattatgattgatgtattcaatgaacagattcaaaatctagatccggaaataagtgaaggtgaatttgagaagaaagatatttcaaaagtattaactataatatggatttttgtaatttatagtgagtctgtcattcttcaacatttgtctagtggtctaaatctgctgcaaagtgtcttattcactgtaatcatcatattgcacatcctcttgtacttgcatgctcatagagttgcaaaatattattcatgggcttattttgttgtgcaagggggattgatcttttcaagtgcatttcttctacctgacagtttttcgattgtactggttgggttaatgccaattttggtgggtcagagtataggtatttattacaagccgcttaaggtcattcttgtatttttgatctcctatgtacttttttgtgtagctgtggtctggcataatgatggcaggcagtttgtgttgttcatcccgctattttttctaattgcagttgttatagtagcttatgccgttctttttctcaaacaagtcaaagcacgaatccgaacgcaaaacgttcttaaagaacttgaaatcgcacatcaaaaggtcgaagaacttacaattgctaacgaacgacaacgtatggcccgtgatcttcatgatacgctggctcaagggcttgctgggctaatcatgcaacttgaagccattgatgcccatctgacaaaagggagtacgcaaagagctcaggagatcgtccaacaatcgatgtcacaagtgcgaagaacattgtctgattcaaggcgagctatagacaatctgcgttcgaaaaccatctcggaagttgattttgcagaagcagtggaggaagaaatacagcgatttacaatggctacgagcatccgtgtaatacgcaacatcaaaattaaagcttccgtccccagactgttgtttgaacatggattgtttattataagcgagtgtttaaccaacgtagcgaaacattcacatgctaataccgtatggattcatattttagataatgaaggcaagattgaaattcagattcgcgatgatggaaaaggatttgatacggatattattgccaagcaaacagggcattacggaatcataggcatacatgaacgtgtacggatgctgggtggaaaaatcaatatcagcagtatatttcaagaaggtacagctataaaaatagaggcgcctcttactaaaggagacctatcatgaaatacaagattttaatcgttgacgatcattgggtagttagagaaggattaaagctggtgctggagaccaatgacagttatgaagtgattggtgaagctggagaaggtgtaacggctcttaaattgatcgaagaacttcagccacatgtcatattgttggatttatatatgccacaaatgagtggtttggaaaccatgaaagccctcagagaaaaacaaaatgacacaccagtcattatcctgacgacctataacgaagatgacttaatgattaaaggactctctttgggggcaaaaggatatttactaaaagataccagtcgagaaaacttatttcgcactattgagtctgcgctaaggggtgaaacgctgcttcagccagaaataacagcaagggtattcgctgctacgaataagagagaagctgagatagaatcacacgaaagaaacttaattctgactgataaggaaagacacatattaaagtctgttgcacatggttttaaaagtaaggaaattgcgtttgatatgggaatttccgagcgtaccgtaaaggcacatttaacgaatatttataacaagcttggtgttgattccagatccgaagccgttgccgtttcgttggaacgtggtattttacagctttagaaataataactgaaaatatgttatttatttgcccagtcgtacataaggtgcttgcccctttgtacgatttttttgtttgttcattgctataacatgaaaaaaggatgaaaaagtttacttgacccacgggttgctgatagcacctttagaagagagaatcagagaggatgacattagttgaagagaaaagaaatcaggataatgattgcaggggttgcattagccttagtagcttccggttgctccagtgcatcggagaactctgtaacagaagcgagtcacccggtaaaaattgagaaacttgcaatgaaacctttggccaatgattttaatttggcgggaacattgcaggcaagtaatgaggccaatgtttcctttgaagcggatggacgtatattgaacaccatggttgaagttggggattcagtagaaaaaggaagtgtccttgcgaagttagatacatctgcttaccagttacagctggatcgggcaaaggcaaccatggaaaaggcaaaggctggtgtaagccaagcggaggctactgtccaatcggcccaggcgggcattcatagttcacaatcccaggtcaacgcggcccaatccaaattgcaggaattgaacaatggcgccaaaaagcaggagattgcacagtctcaaaatgcggttactgtagcaactaataattataacaagaagaaagcggatgccgcacggtcccaaagtctattccaggcaggtgcagtatcattaacggaaaatgagaatgcgcagctggaattagcaaacgcacaaaaaagcttaagtgatgcgcaagagaaattgtctcttttgcttgcaggggcatcccaggaagagcgtgcccaagcttcggccggcgtagatcaggccagggcagggctggaatcggctagggctactatacaacaaggactagccagtaaagctcaggcgcaggctacctatgaagatgcattggctgcttatgaacagtcagccttgtcactgaaaaaagcaactttaacttccccgatcacgggtgttgtgattgaaaaaaagatatctgatggtcaactgggctccagcgggagtgaggcatttgttgtcggaaatattaagactttaaaagtactcctccccgtaccggacagtgaaatcttatcgtggaagaaaaaccaaaaagtaaatatatctctctatgatgaaattagaacagggaccgttactcagatctatccatcgactaactccaaaacgggaagcatcaatgtggaagttagcattcccaatcccgaactgaattggaaacctggtcaagtcataagcgcatctaaaagcatgaatcaaaacgaagcgcttttagtgcccgtagaggccgtaattagtacgggaagtgatccttatgtctttaaagcagtaaacggaaaagccgtcaaaacaccgattaaactggggaaagtgactaataatcagctcgaagtggtctctggattacaggcaggcgatcaaatcgttacacaaggagcaggaaccttatttaatggtgatttaattgggaatgacgtacttgagaaatcggaggagtcgtccgaatgattaaatatatcgttaaaaaacaaaaaattacactcattttctttggcatgtgcattgtgctagggctctacaattttacatcgttacctaaacaagagcagcccgatgttattcccttgtcagccagtgttacaaccatctatccgggcgcctcacccgaaagaatcgagcaaaccattactaaggtcatggaacagaaaattaaagccgtacaaggtgtcaaaacgatttcttccacttcatctaaaggccaatccagtataactgtagaagcttttgaagatgcagacccgacaaaggtatgggctgatcttcgtacaaaggtacaggatgcacagtccgagcttccagatgatgcgatgcagccggttatcaatgatagcatgacaagctctttcattggttcatatgcgattacttctgataaaattgagaatttatactcgttgaatgaattgatgaacaaatggaaagatcaattaaaaacggtctcgggtgtttcgcaagttaatattcaaggaataccagatcaagaagtacgaatcagtttagacacacaaaagatgcaacaatataacatctcctgggagcaggttgttcaagcaatcaaaaatgagaatgaaagagttcctacaggtagtatggatttcaatgaacgtacttatcagctgacggtaaatgcctctaccgatccatccattctaaataacgtccagatttcaagcaatgacgatggattcccgatatctctgaaagatgtagggacagcctcacttgtttttaaaaaagcagctagttatacgtatgtgaataacaagcctgctatttcgatcagtgtgagtggagatacaggcacagacgtgccaacggtatctaaagcgactacagccaaaatcaatgaacttgtgagcagtttgccgaaaaatgtacattttgagctgctttttgcgcaaaatgatcgagtagatgaaatgtttggaaacctaaccaaagagatgatcatcgctattatatcggtcattgttatatgtacattaggtttaaatttgctgacttctgcatttgtggccttggccattcctgtttccatcgccatcggctttattttcttgcccacaacaggaatcacgctgaatcaaatttcagtcatcggattaatcatcgtgctagggatattggttgatgatgccgtcgtggtcaatgacaatattgaacgccgacgcactgaatttggggaagatgctacggaggcagccattaaaggaacgaaagaggtatccttatcaatcattacagctacactagctacggttgcagcatttgccccgcttttattcctgccgggcaccattggtgactttattaaaccgatacctaccgttatttcgttaacgatgctggcgtccatgattatgtcattaacgatcattcctattttccgtcaatggtatgatcaacgtcgtaaaggaaaagagagtagtaggacagttaagccacctggacttctggggaatcaaatccagtctctatccaatgtgtactctaaaaactggatgccaagaatactgcgacgcccacttttaacagcgcttattggtcttatgatgggtacagcagcttatggactacttgctgttgttcctattgagttatttccggattccgatcaagtggatgccacgatcagtataacgatgccagaaggaacatcgttgcaggcaaccaatcaggttattaacgagattggcatgtgggtcaaaaaacagccagaaacggagcggttggcggcaacggcaggtggaggagcgcctcagttgtacagcgatgttgcaggtggtcacggctctgggggggcggtaaatggccaaattgctgtcgttggaaaagaggggctatttgatctcaaaaaaacagtggataactggacccatacgctacaagctaaatatccatctgcattaatcagcattcgcgttccccaattaggtattccggtcggcagtgcggtgtctatccgtataaaaggagaagacattgataagctgcaaaacatgacaactaaagtcaaagaaatcgttgcgggaacccccggagctgtagatgtgaccgataatatgggtatgcaaagctataatctgaatttccaaattaatcagcaagccttggataaatatcaggttagctattccgatttaacgcgtactttgctattaatgggtgacggggtgaatgtaacggattttgatacgggtaaggaattgcttgatgtcaatatatacatgaacaaaccaaaccatgatcctgaggtattattccaacaattaagtgtgaacaatgcggcaagggagcaaatccccttatcccaattagccacgatgaaaccggacttttccatccaacaaatccaccgctatgatctggaacggacggtaacgatctcagccaatggaaatgggcgtacggctacagaactcactaatgatatccgtagcaaacttacaaatacccagtttgaaccagactacacctgggagatgggaggggaaacatctgcgcagtctgatatgtttaaggatttgggcaaattagctgtgattgttatttttcttattctcctcttaattaccatgcagttttactcggtttccacaccgctcattattatgaccactgtttatctggcagcggcagggggaatccttggaagttttatttcggggatgccaattggattcatgagtattatgggtatcatttcacttgctggtatcgtcgtgcgtaacggtatcgtgctgatagagtttattgaagatgcgcggcgtgaaggcgctgatttaacagacgccattctaatggcatgctctgcccgtttccgtccgatcttgcttacttcgctaactgcgattgtgggtatgatccctattgccacaataggcgagatcttgttcaaaccgttagcaacgaccattattttcggactgattttttcaactattttaacattgtttgtagttccgacgctgtatatggtcgtagctcatctgaagctaaaacggaagcataagaaggaaaaggctataaatagcaatagctcaatgaccttgtaggtaaatatatgaaatcgtgcattagacgagtgtcttaatgtacgattttttcttttgtcgatattgattattatttcattgacagagtccacaaaaatcattactataattgttgcaaaagtccactaaattgggggagttatgatcaatatagatgctaatatgatagcggatatgaggcgttttaatcgattctatacgaatatactgggtgttttagatagacatgtgctggatagcggatattcctttactgaggcccgtgtcattatagagatcgggttgatcgagccatgtattgcgaatactctagtcgaatctcttaaaattgaccgcagctatatgagtaggatcattgctaaattttgcaaagagggctttcttgttaaggaaaattcaacgttggataatagaacaaatctgattcggttgactcctaaaggaaaagcattctacaaccaactgaatgaaaggtctgatgaacagattttaaaattagttcaaggactttcagaagaagagattaaggaattacatgcttctatgttgttaattcagaagaaattggataatttggagaggatacagaatgatacgatttgaatgcgactataccgaaggtgctcatgagcgcatattaaagcgactactggagactaatgatgaacaaactccaggttatggtgtcgacgatcattgtgaaaaagccagagcatatattaaagaagcatgtcactccccaaatgcggatgtacactttttggttggaggtacacagaccaataccaccgtcatttcttctattctgcgtccgtatcaaggcgtcgttgctgcagtttctggacatattgccgtacatgagaccggagcgattgaagctactgggcataaagtacttactttgccaagtgatgatgggaaaatccgggccgagcaagtaaaggagctatatgacgctcactggaatgatgccgctcctgagcatagtgtacagcccgggatggtttatatttcccaacctactgaaaatggaacgatttatagcaaatcagagctggaagcattaagtagagtctgtcaagagtgtggtttaccactgtttatagatggagcccgattaggctatagcttggtggccgaagatagcgatgtatctttagcagatatagcgaagctatgcgatgtattttatattggcgggaccaaaattggagccttgatgggagaagcagtagtcattctaaatgatacattgaaaaaagattttcgatatatgatcaagcaaaaaggaggactgttggctaagggaagaatgttgggcattcaattcgaaactttgtttgaagacggtttatacgttgaaatttccaaacacgctatagatatggcaatgctgcttcaaaacggattatctgagcaaggtttttcttttcaataccgttctacaactaatcagcagtttccgattttgccagatcgcatactaaaggcattgagtgaaaaatatacttactccttttgggaaaaggttgatgatgcacatagtgctgttcgattctgtactagttgggctacaaagaaagaaaatgttgcaatgctgattcaggatattaaagcattgcgataaaggtcatagaaagtgtaatttataattttaaagatgtagaatgactatggaatagccatacttcgttgcatgcattgcagcgaagtatggtttttttgtgcattttacttgctccaaagcggcttgtctttagttccatgaaagagcaagtggatataaaaatggaaaaacaagacaagagcggatgtataaagtcggcgtctaattctttacactgaatatctaccgaacctgcttgcggtactgaagaggagagagcccggttatttttttaaagattttattaaagtgggaagcatgaccgaacccgacatcctctgcaatatgctggattttgtctttggtggttcgcagtcttgtttgggccgccctgaccctcactacgcggatgtattcgctgaaatgaaaaccagtcaactttagaaagatacggcttaggtaagctggactaatgaaaaagcaggcggccacttgttcgagagttaacggttcattgtaatgatcctgaataaaagaagaaatttccgtgattttctgatgcatgggatgagagggaacaggttcactacgctcgatcgcttccgatcggtgcaccagaataagcatttccagcagtaaatgctgtacgcaacggtaatgcagaggctgcttattcctgcattcggtattcatctgtaggaataaacgttcaacctccacttgctctctcgcaggtaagcgaagcaacgcggattgctgatacggtggcaggtcaagaatgtcatgatcctgctgtgggagaaacgtcggagaaaaatgaatcaaaatgcgttctgtttcctgcaattgcgtactggcggtagaatgcaagtcatgaggaaggatgaatatcagatcccccttgcgagcggtgtataccttgccattcataaaatagatgcgttctcctcgcagtaagagatacagctcatagttctcgtggacatgaggccggggcataaccgtgaaaccggtacgatagatgtgatgaatggagaattgttgttcgccaaggacatatttatcttctttcatttcattcatgtgcttcttcctttacaaattaagataagtaagcgcattcatataccaccagtatatatgacaacctgccaatgataaaagcagaaaagattgatgaaaggaggtgaaggcgcttctgaacgtctcggatcgtgtttttataaaaatatgcgctgatgtggaagaaaatcttagggaggaaacagaatatgagcaagcagcgtacatggaaaaaggtgctatgtaatgtggttgtgggttcattgttgttgaccttgtgcccaccactaatccaagcggagactgcggtaggaacagagaacgcaaaggtgtcaaaagtggcgacggatattccggcgtttccgggggctgagggtggcggtaaatatgttaccggtggacgcggaggtgaagtgtatgaggtcaccacgctggcagactacggcaaaggggaacagataatacccggatctcttcgtgcagcagtcagctccgataatcggatggtcgtattccgggtgggtggaacgattcatctcaaggagccacttaaaatcttgggaaacaacctgacggttgcgggccagacagctcctggcgatggtataactgtaagcgattacacgacagggattgatgcagataacgtcattctccgttacctacgtttccgattgaccgaccgttaccccagtgaggatgacgcgttaggagccagataccataaaaacataatgattgatcactgttcctttagctggtcggtggatgaggtactgagcctgtatgacaacgtcaatacaacggtacaatggtccattgcgtccgaaagtatgctaatgaccacgcatcagaaaggtcgccacggctatggcggcatatggggcggacgaaattccacctatcatcataatttgttggctcacaatgcaagtcgtaatccgcgttttccaaccgataaaaaacaaatcgacgctgtggaaatgaccaataatgtcatttataactggggatttttctcttcatacggtggcggtgaaggattgtataatgtgctgaataactattataagtatggccccaacacatatgaggacgttcgcggtcaaatttttgtagacgtgggtagtaaaaaatataaaacacgcatctttattggtggtaactacatgtacggcaatgactcggttacgaaagacaactggcagcttggcacatccattgggtcaattattgatccttccacccgtttggcggagccgattgaagtcagaggggaatacgacaacggaatttcgccggatgcgtatggtccatatcaagcgacggatgcacaaaccgcatatacggaggtgcttgccggctcaggagccacgctgccaagaagagatgcggtggacgcccgaattatgaatgatgtgaagaatggaacgggtgcgtttattaactctccgcgtgaagcagggtggatttacgacgattctaacgtaacgacgacggagctttctgacagtgaccatgatggaatgccggatgaatgggaacgtgcccatgggctggaccccaataatgcagatgatcgtaacggtcaattgcttgccggcacagggacgtatgctcattttgccaagggttataccaatctggaggtctatttaaatgatcttattgagaagctgtcgaatggaaatgaggtggataatccagaggccgtcgttcaggtgtcggatgcaaacggacgttcactaaagcataacgatattttggaagcaggccgtgatgcgaccataacagcaacagccaaggacaaagatggtattgctcatgttgaatttatcattgacggcaaacttgctggtaaagtagagaccgcgccttatcatctcgattggaatcatgtaacagacggtgcccattatattattgtacgggtgaccgatcgcaaggggtctgctgcattttccaatcctgttaccattcacgtcaatacgactgcgccatcgggaagttggctcagcgaagagattggctctgagggcaacgatggttatataaaagggcatactcaggtcttaaaagaagatgcaagcggcagcagtataagactgaagtcagcgggagacgttgacggtaaggcagatattttccattatgcttatcaaaaatgggaaggtaacactgaaattacagcccgtgtggaacaaattactccggtggatgataatgccgaagcgggtgtaatgattcgtgagtcgctgaagcctggatcaaaaatggcctttatgtctttagcatttgttaaatatggcaaacagggtattcttattagtcgtgatcaaacggatgccaagacgaaacgtgcatcaatggagacgtttattgcaacgccatattcggttcgtctggtacgacaaggacaaaaggttacaggctgggtatccgcagatggtgtgacgaactgggagaaggttggtgaaactgttatagatgtgccggataatcagccgctattgttcgggttggccaccgatgcatccaaacaacaaaacgatgtatggaattacaatacgtcggaattcagcaatgtcaccctccgcaacctgacagactcaggaggaactcatcccactagtgtggtggtagcgacctatggccctgctgactttacatctctccaggcagcgattgacgcagtccctgacgacagaaacacaaggacagttatccatctcaaaaacggtacgtatcgtgaaaaaataaaggtgcattcctccaaaaaaaatctgagtattatcggagaagaccgcgacaaaacgatcattgcttttgatgatacggccaaaacggtggtggacggaaaagaattaggaacaagcaacagctatacaatgcgtgtgcaaagtcccgattttgtgttggagaatgtcacggttgccaatacagaaggaaccgggcaggtgcaggctgtagcgttatatgccgaaggtgatcgtggtaagtatcacaatgtcaaaattaccggcttacaggatacgttgcttgtgaaccgtggcagacagtattttaaggacagctacatcagtggtagtgtagattttatatttggcaatgcacctgccgtgtttgataattcgatcatacacagcctgcgtgctggatatgtgacagcagcttcaacagaagagaacaagccgggctttgtatttattcaatgtcgtctgacaacagaaaatggcttgacaggcaaggtggatcttggacggccatggcgcccttatgctcatgttacttttttgaagacctatatggatgaccatatcaagccgggcggctggaacaattggggcaaggaatccaatgagcaaaccgcaagatttggagagtttgacaactttggacgaggtgcaggaagtagcgggcgtgtaccttgggccaaacagcttaccgctgatgaagcaagtcagtacaccgttgaagctgttctgagcgggacagatcattgggattggcgtctttaaatttgatgttcagtggttaagcggggcaagcgcttctagcgttcagcctcgcttatttctatagtttgagtagaggatacatacttgattttcggtattgaaaatacttgtttatatggtaaatgtttgctatgttaaaagtgcatttatctcaaattgaaatttattattgatttggaggtgtaggatatggcacgtgtgttagtagtgatcacgccagctgaaggccatgttaatccgaccttttgttacacatgcggggatgaacagtacaagtgaagccttatattacaatgtaccgcaggtcatgattcctttaacatcggatcagccgatcgtagctagtcgggtgcaggaactgggagcgggtgttgttgtggataaaaataagcttacacccgctagtttgaaagctgccttattagaggtattgagtcatccaacctataaagaacaggctcatgtgatcggcgaatcattacgccaggctggtgggtacagacatgcggcagatacaattatgagtcatttctccaccatagaaaaataagcgtagtctatatactgtgattcctttcttttaaagcagcagatttttcaaactctaatttcttcgaaattgccagaagacccagggagcagatgattagggccaaacatacccaataggtgtttcggtaacccatccattgagcggttaatccgcccattaagctccccaccagtcttccgatagttgtcgcattggaatatagcgtcgatgcgtaccctggaagagagggcaacaaatcctgcatgtaactaatgccaatggcagaaatcactgcaacaaagaaggctagaagaagttgccccacgaatagctgccacatctccgtagacataaggacaagaatataatagacaactcctgtcaatgctcctaaaaatacaagcaaacggttggagtatttagctgctagtacgcctagcataagcatcaagggtatttctaaaatggcgcaaatactggatactagagcaacgtcacttgtgtcaccttttaaattgtgaatgataaacaaggaaatatttaaattgttcatccagtgagacgtatagagcagagtaagaactgagaaagggatcagaatctcaatatttttatgtattgtaatgttatgaagtgaaagttgattcttatgtttaagctgagcgggaggctgctggataaaaaagaataaaagaacagcaataagaacaaaaatagaggtcgtccccataaagatacctttaaagcccgtatgtgcaatcaaaaaggaaccaaaaagcggcccggtaataaatccaagagaaaacatagaccgaagtgttgaattagcaaaggcgtgatccgcagatttactgcgatctactgcttcacgtgcactggcaaataactgcggcatcccaggagcaccaatggccgtaaagatcgtcatataaacaaaaagtacataaaaattttggattacaagatatcctgcaaaggctatggcattaaataacgtacaaatcaccaaaatttgtttacgatctaatccggtatcagaacgtttggcaatcagagagcttatccatatgccacaaatcaaagttaccgctgtaaacacaccaaaggttcccacagataccccaagtgtacttgtaaaatatacagctaaaaaaggtgcgctgatggatatagccatgccttgcaataacatgcagatcatgaacaatgggtagttagggataacaaaaagattctgaatacgctttagcatttcatttttacactccttccgaatacatacctatcccaaccaaactatatatgactttagcataatttgtatatttacatagtgtaaaatattatataatattttacactttgatgagcaggacaatatacaggcaaagatactgtctattcgttcctgatgattggtagaccgccccttgctcatagctttcgctttcccattccgtacaactcatagcgatgtcgccatttcactaaggtggtaacgctgatgttatgttttttttgctacttccacacggctgctctgtcctgcttttaactcctgtatgattgctagtttctcaatcgcattgtatgcgttcttcttagacaaaggaaaactccccttcaagtagcggtttatttattaaacctgcctacttgaaggggagcatatcaaaatcagtagcctgttcgtaatttataatagcgaggttacgaacttcacctccggaaagcggctatccggtcctttcattaagattccgccttgatttttcagatacctatcgaagaaatccagcatataggcattgataacggagttcgctctttcgggcgcaatctgtcctgtaatgcccagcatttcgaaaatcggagaaataaactgtacgtcggcaaaattcaaatgctccgtattttcgatatagaggacttgtcccccttcgttgaccgcttcgcgtatccgttcaagctccaactttttatcttccgttacttgatcctcccactctcttgttgagcccatacggttaagctctgcatccgtgtagacccggttatccatcaccatttttaatttttcgaaatagctctccgagttgatgaacaaaaacggctttcgcagaccctctctgtcacgcagtcgataaagccctccatcaaggtctattccaaccgcgattcgcggatcgtaagaagcgtcatagaccgtcgctccgccgatggaatgaccgaacaccccgacatgaccgagatcaatcctcccttttagatgacttggaatctgccccgattggatgagctcgaattggtccagcgcaaacgccacatcaccggttaaaacttgtcccaacttgtcgcgatttcccctactcgtctggtaatcatgggcgggcgagaataagtcgttggttgtgctggtcgtgattcgcccgtccggaaactcggttgcaaatgtattgtaggtgtggtcgatcactgccacgatatatccatgactcgcgagattttcggcttgcgacgtgtggaggaacctggaagagccattgccgggattcgcaaggatcagcgggtatgaagtctgtgccgaagagacttcggcccccgaataagcatgactggatacgtacttcagatgttgaaaagtaaactcaggaaggccatagtccgcggccatatagcgtaaaatctgggtatcgggaataaagggagcgtacttgtcggtgccagcttgagccggataccatacctgaaccatcaattcccttttgcctgtcgcggttttgccaaatgtctcctcccggcttggatcgatgaaatgaaagacttgcgtgcctaccttcaactcgccggttggcgccggaaagtcgaatacgggaaacacatagaggaagcacgccgttgcgattagcccaatcacgataaaaagacggcccagcaccctacggattcgcgaggcagtccgaacgactttcagcgttatgaaaacgtctataagcgaatgcataagcatcaggatcgtaaatccgtataaaaataaaagctgaaccctgtatccttcgacaagcaaatgtatcactaaaaaaatggagcctgctccgcttgtcaggagcaaagctggtcttcggatacgttgattgataatgaacaggagtgccaacaaacaagcacttgaaaagaatagcagcatttcaaaaaacctcacgccaactcccccttaaaaataatcctatcaatggattagtatagaggagcagctaggttgataccattgatctagatgacaattgcctaacactcttgtaaggttgcgcgacgatggcgcagaaaacggcatgtaatgtgctgatttctgcctttcgaccggggtccgtgaaggaatgcccatccgccgcatgtcatggccagcggatgttgaacaggtggggggctattgacgcttaacgtaacaggagtgggatgtagctatgtatgtggaattatcctgtaggatttgccttaaaggctgaaccgatctacgaactgcttgatcagttcattcaataatccggcggccttcgtaggaaggcgatgatcagctttcttaaggaaaaccagctcactatttggtaattgttgatgcaatattttggcatagggatggaagtgcttatctttttcaccataaacgagcaggacaggaagatggatttccccgagccgtgaggtgcagttgtacttcaagctgtatcgataatattgttcgacattcctgggatttccctgcttcgcatcgttgaataacttacggaataaagatagctgtttcgtttgtgaccaagcattagaaagggcaatcgtaccgattgtgccgattttggaaagagcaatgcccaaagaaattttatttcttagtcgccattcgcttacttccgacattccactgataacaatgcctccccatgcccgatctggataagtcaagaggaattcaagtactatcgagcccccggtagaatatccacacagaaatactttatcaaggctcatccggtccatcaaatgtttaatatccagggcgatgagagggtaagtaaccgtttgctgagaaggctgacttttaccgtgtcctctaatatcaaaagctatagttcgaaaatggggcgagagtccttggatttggtatgtgaaatttaagcttgtgagtactggagggtgaatgaataggatggcgaacccttttccggaatcaatataatgcatcgaatatccgtttatgcttgtggtagtcatcgttatattcctctccctgaatggtttgactttaaatttggcctattggatccaaaaaattcatggaggtgtaactttaattgcttgtatgagatacctttgtcccgatgacccaatgcaggaataatattttaagtacaagaaaaaaataagaagatcaagtttttctaagaaagggacacatacatgggcatgaaaaataaagttaccattgcagtagtgctaagtttattgttgttgatcttgggctgtagagcggactccagtcaacagctaaaacaacagagtgtgaagccacctattacagtaaatcaaatggggaaaaaacctgtcattatgatcttgattgattcgttaatggataagcctttgcaagatgcgattcaagcaggccgcgcaccggcaatgcaatatctcctgaaacaagggcaatatttcccgcaggtagtgagttcatttcccacgatgtctgtgacaatcgacagtacattattaacgggaacgtatgcagaccaacatcatgtgcctggactcgtttggtacagcgaccaaaagaaacgcatgattctctacggcaatggtgccaaagaagccttgaagatagatcaaatgcaagtatttatggatgctatttatcagttaaatcaagttcatttgaacaaaaaaacaaaaacaattcacgaagagctggccgacaaaggaaaagaatcggcatcaatcaacgctattgtttttagaggaagaacggaacatgacttaaaagtacctcgctttataacgaacagcaatcgtgtgccagaacaattgagaataacaggacctaaatggttttcttatgcaacttttgcacaactggatccaaagaatagctggaatactcctccgtggaaaaaattcgggatgaacgacgagttttccgcaaaagataccgcttttgtaataagtcagaagaagcttccagacgtaaccatcacatactttccagaaaatgataatttggcgcatagaaagggcccgactcaactggagggaatcgaaaaagcggatcaagcacttcaaactgtgttgaatgcatatggttcgtgggaacaggctgtaaacaatgcgacatggattgtcatgggtgacagtgcgcaaagcgctatttataatgatcgacaggtagcaacggttgatttaaagtcgcttttgaatcattaccgcattgcaaaattaaatcaaccagtaagaaacgatgaccaaatcgtgatttctgctaatgaacggatggcttatatctatgccataaacgatgatgtggagttatccaatgtggtgaagtttttacaaaatgaggacaagctcgacattatcgctatgaaagatggtaaaaacaatattcatgttacaaaggggaaaaagagtaagctattttcttatcatcctggtggaaaatacaccgatgaatatggacaatcgtggacattgtcgggcgaagaagaccttgtggatattacgataaataacaaccggatcaaatatggaaaatatccagacgttttggcgaggctgcacggggcaatgtattcacatggaggtagatatattgtcgtcacggtacaacccggatatgaactcgtcggtgaaagttctcctacccacatcggagggggagctcatggttcgctgcatgaaatagattcccttgtcccattaattatttccggaacgaatacacgccccaaaacactgcgaatcgttgatataaaagactggattatgcaattggtgaacgaataagtattattgttcttgatattaaaaacgtaccccattagtatataagcatacagttatataaatgaaaggaggttacacattggagcaacttggttatatagccgatcatttaaagctattgggcgataaaactcggttggccatgctttccctgctaagagagagagaatggtgtgtttgcgaatttgtagatatctttgatatgtcgcagccagcaattagccaacatttgagaaaattaaagtcgcaaggaattgtaaaagaagaacgacgaagtcagtgggtatactattccttaaatgtagacgacaagccgcatattcaagccgttcttgagcgtatgccagactccaagcagattttaaaatggctgaataaagaggagccgatagcatcttgtgcaccggattcatcggcttgctgctcatcctaaaggctgttccgtttatctccttgggggatagacggtgtttttaacataagtatatgtttataaggtaatgtaatggaggtttaaaacattgattttgttggcatgcattatatttttagccactttagtgctggtgatctggcagcctagaaatctgtctatcggctggtctgcttgtggaggtgccatactcgccttgctggtgggtgtcgtcgatttgcatgatgtttgggaagttactcatattgtctggaatgcgacactggcttttgtagccattattctgatttcgttggtgcttgataaaatcggctttttcgaatgggcggcgctccacatgacacgagctgcgcgaggaagcggaacccggatgtttgtttatgtgacccttcttggcgccgttgttgctgctttttttgcgaatgacggtgcggccttaatactgacaccgattgtactggcgatggttcgagcacttaaattggatgagaaaatgatttttccttttatcatagcgagcggttttatttcagacacgacgtcgcttccgcttgtggtcagcaacttggtcaacattgtgtcagccgatttctttgggattacctttatggaatatgcgagtcgcatgattatacctaatttattttctttagcagccagtataggggtactgtatcttttttttcgcaaaagtattccgaaaacgtttgatgcggcacaattaatcacgcctgcggaagcgattaaagatccaaaaatgttccgtatgtcttggatcgttctcgcggttttgttcgttggctactttgcatgcgaattttttaacattcccgtttcggtggtggccggtattattgctatctttttcttattgatagcgcgtagaagccctgcagtgccgatgaaagaagtcatcaagggcgctccatgggccatcgtatttttctctatcggaatgtatgttgtggtgtatggtctacgtaatgccggtttgacggatctgctggcccatgtgattcaagcggctgccgatcaaggtatgtttgtggccaccatgggcatgggttttattgcggcgattatctcgtcggtcatgaataacatgcctacggtcatgattaatgcgcttgccattgatgccacccatacaaccggtatggtcaaagaggcgttgatttatgctaacgtcattggttctgatctggggccgaaaataactccgatcggttcattagccacgttgttgtggctgcatgtgcttcgttcgaaaaacgtgaaaatttcttgggggacttattttaagacaggtattgtcttaaccattcctacactttttatgaccctactgggcttatatctatggttaatcatttcataattgaacattgaaggagacggtaatgatggaaaagaagacaatttactttttatgcactggtaattcttgtcgcagtcaaatggcagaaggctgggccaaaaaatacttgggagaccgttggaatgtatacagtgcgggcattgaggcacacggccttaaccctaaagcggtgcaagcgatgaatgaaatagggattgatatctccggacaaacttcagatattatagatcctgctttgctgaacagcgcggatttggttgtgaccttgtgcggagatgctgcagataaatgtcctatcacacctcctcacgttcgtcgtgaacattggggatttgatgatccggctaaagcacaaggaacagaagaagagaaatggagcgtgttccagcgtgtacgggatgaagttggggctcgtattcggaaatttgcggagactggtgaataaacaaggtacacagctatagtatttcaaacaagcacgcctccttaaagaggtggtgcttgtttggcgtttttctccttcacagaatactcttccagcacctttgttttatctccatagatcctatccaaatgatcttctccccataagcaaaaacgatcaagcagatctttaaaatcccatccatattcactaagctcgtactccactttgggtggaatctggttataaatgatgcggtggatgattccatccttttcaagctctctaagctgttgggtaagcactttttgggtgattttcggaatgagttgacgaagttcgtatgtacgttttctgccgctggttaaatgatgcaggatgatgcctttccactttccactgatgacctccaaagttgcctcgatcccgagcatataggttttggctttgtgttccatagactttccccctctccgatctgtagtacaaaaggcactaaggaacctaaaagtacctacagtacattgaagtgcgtacttcacactttcatatatatcaaccataatagcatctgtagacagggttcaacaattatgaggagaaagaaggttacggataacatgaaagttctattggtcgtgacgcatcctagagaggattcacttacccttacagtcatgaatcgttttgtagaggaattgaaggagaataagcacgaggtagatattttggacttggatcgggatgggtttaatccggtatatagcgcggcagatgagctggattggaatacgcctcataaacaatatgctcctgaaacacggagagagatggacagaattgctgctgcggatgctctggtctttgtgtttcctctatggtggtacagtgtgccttccatgctaaaagggtatctggataaagtgtggaacataggtttacttcaggaatttacgaagaagcaggtgttgtggatgtgcttggcgggagggacgaaagaacatctgatcaagtatgaatatcacgatttggttactaattatttgaataaagccattgctggttacgcaagagtaagagagtccaaggtggagttcttctatgatactttgtccgagtcgaaagaatacattgaaggtttactggagcacgcttatcaattaggtcgggcaaataagtgaattttattctgataacaatggaaagttaatattattaaaaaagggttaaggctcgttagacggcacttaacccttttttattttacagaccagactctatccttttataggctcgtgcataggggctgacggtgccccttgcatagataacccgccgccagttgtgcttgctggaaccacgggatgtggtgagcccttttcagaagcagaacccgcagtttgcttggccagcttctgtttttcccatagggctctggcgatcaccagcatggagagtacacccacatatagtaacagagaaccgagttcgggaagcatctcttgcaaaggtgcaccacgcagacccatggtgcgcaggaatttatacatccatacaaaggggaagaaatcaccgatttgaatcgctaaaggtggaaacagtgatctggaaagaacagcccccgatagaacaaaagcaggcatgagtatcatcaccattctgccaatggctattcccggatgtgcagcgccccatgcaaccaggacattgatacaaacggtaccgaatacatacaggacaactggaattataaagagaattggattggcctcgaaacggcctcctccaaacactttaagcatcccgagagagaagattaagccagccgtcgaaaacagcgtataaggaagcatacgcagcaggatgttgaatggattttgcagctcagcagccagcctcttggaaactcggagtctggcgaccagaggtaagctatttatattcagtatcataaaagagaacatacaagtgaatgcaagtatcgtcgtattctgatagtcattagttggattaaacagggaacgcacttccaaggcgataccattgagggccccttgagcctgttctgcgttcatcccggttttcaacatagctggaacagacaattccatattctcggaaacgctaatttcctgcatagctgtacgaatcgaagtaatagattgaacattggtattatcgagaatgagacccacgcggctggaaagggagcgattgtgattatcctctaaaccatgcggtaaggaaataacagccaaatattgttcatgataaaaatactgttctgggttgtccgtatacgaaacaatctcagctacgttcatatacggggaagcatctattttctgaatgaactcacggctgtaagctgtgttatcttgatccaccactaccacgttagcgtcgttaatttggctgcttgggagcaacagtgaataccccagtacggcaatcaacgggaagataatagctatgatcggatacttggagtgaaccagatacgaccattcatcacgaagagatttcatttgtattcacctcaactgtcatgcctggtagcaaagctgcttctcttgttacatatacacgtacctggaatgtagcggtatctgcttctcctttttcacgggacatcttcacattagcgaattgtggtgcagcagttacatagcgtaccgtacctttcaggtccttattgagaccagagatatgagttttaatttcttgattggccttgaatttccccgcttgttcttcattcacataaagatcgtaatataaatcattggtttccagggtaatcacaggagccccttgcgccacattttcgccgactttggtactaatcgaagtaaccttgccatcctgtggtgcttttaacaccaggcgttcttttttgagcagcaacgttttaagctgaacttcctgtgtgtctttttgttgctttaagaggtcaatagccagcttctgatctgccaactgttgacgactctgctgaatagtttccagctgggtcttggaacgatcgacggacaattgggcaccgcgaatttcttcctcggcttgttttaccgaaacggctgcttgtgtcgtctgttcactggcctgcatacgttcttcggaagtggcaccatgaagtagtttttgaagagactctttttgctggctcaactgatttgtcgctaaagtcaaagaggattcggcatcatccaacgctgctttggatgcacttcctgcatcatagagtgctttattacgcttatagttggtttgcgccgtctgaacgtttttggtggctgaagctacggcaattcgttgctgctgaacatcttcatcccgagccccgttattgacctgttgttccgcagcagtggcttgacgctcagccgcttgtgcccgctgcaatgccgcctgacttttacgctcagtcacttgagcttgcgcgatatctagctgtgcctgtttttcctgagttgctgctcgtgtataccctaaatggatggattgttgttgttggctgatttgcgtattgaactgggcgatttgtgtccgcagctgctcaatttgcagatccacatctgtggaatccaaagtcataaggacagttcctttttttaccttagtttcttctgttaccgggatgttcaggattttgcctcctacttgttcaaacgatacatgaatgctatccgcatttaatgttgtgcctttaacggatcgagaagcattgacttgatcttgtccgttggtctggagcagaaaccccccgccgataagacaggcgatagaaatgagagggatgatgaggctggtgacttgtgtgcgattcatgaataatacactccttaaattcataaaatgagttaaacatagactcgaataaatatcctggtatgtacattttatttattcttttatttaataatttaaaagttagtcggctaactaaaacgcaaaattaaaacttattctggttttgctgctttatatatctcttttgcttgagggatgccgctttctattttttgcagtaacgtcaggagcagctctttttcatcggtggacaggtggctcatcagtgtggaagtgcttgtaaaatgtataggcagcagtctttccatcatttccgttccttgatcggtcagtttaacaatgctcatgcggcggtcggaaggatgaacagatcgaataataagcccatcgcgttccaggcggtcaagcagaccggtaacggtaggcttgctaacccctactttctccgcaagctctgtagccagcaatcctgtatggatgttgcggtacagaagaattaatatcgaaaatttaccatgagatataccgaatttctcaaagccctcaaagctgactttaaagacgctggaagatacccgcatgaaaaatagcatagcttccgtcgctcttacatcaatctcggggatacgcatagaaaattcttgcagcgcctctcgagtgggcaagtcccgtaaatcaaaatccataaggttctcctttctccttacagtatgttccaatcaataaattagttagccgactaatcttaatctattcaaaaatgaatttcaagctaaattttgttaatcgtcatgcggattttcaccatatggagggttcttcgtacaataattcaagttattccctacattgatatttacaatgaagtgcttgataataagtggatatcgtacgagaccaaaactcaaaagtgaggaacctgtaatgacgacaaaattatactacactgctccaaatcttacggagtgggacactcatattacacagaacatggaaagagacggaaaatatttggttatgctggaggaaacggccttttatccgcatggcggtggtcagccttgtgatacaggaacaattcagggcatccgtgtattagatgttgttctcgaagatggggacatttggcatcaggtagagtgtttgccggaggataggaaagtagcctgccaattggattgggagcgcagatttgatcatatgcagcagcatagcggacagcacttgctgtcagcggtttgtctggagttgctgggtgcgcgtactgaaagctttcatctgggacaagaatatgccacgattgatgtgaactgttcggatgtaacgcctgcgcagctatcggcaatcgagcaggaagtaaatcagcaaatctatagtaatcgcagcatcaaaagtttttttgtaacccgtgagcaattgaaggatattccgctggtgaaaacgcccaaagtgacagaaaatattcggattgtcgagatcgagggcattgaatataatgcttgcggcggcacacatgtagctcagaccggggaaattgggatcattaaatgcttaaaatgggagaagcagaaggggatggcaagaatccatttcaaatgtggcgttcgcgcactccaggattttaacgatagtgttcagatattggacgtgttatctacgaaattcaataccgggcggaaggatattttgacccgattcgaaaagtgggagcaggagcataagcagctcaaggcgcaagtggagcttctgcaagaggaaaatgcttcgtaccaggcgaaagagttgctatctgctgtgcaggggcatgttcttgctcgtgtattcgaacagaaatcctttcaggagatgcagcaattggctaccaagctgacagctgagcatgatctgcttgttttatttgccacaacagcagaaaacaaaatcattctggcacacaacggtacccaatccattagctgcggagcgtttttaaaggaaaatctgggcgcgtttcacggtaaggggggcggtagcaaccaatctgctcaggcagcattctcgtcccgcgaagaccttttgaatttctttgaaacggcccagcggcagttcattcagggctgatgtaatggaggattagtggcgtaggggaagcttccacttttccttttctgtaaataaaataaaagaaaaaataagtacaacaacagcgccccaaacggctttatccccaattgtcaaagttagaaatccccccagcaaggctcctaccaagaaggctgccaggataacaccataacgcatcgctcgaatggcagcgttcgtgtccttggtcgttatggcgacatacacagcctcgatagctgatcggaggttaccggtgctgaccgtggaggtgtacggcacatcaatgagcttgcggaaggaagtcatttgcacggaagcgacgaacgagacgatcaccaccactaccgtattgggaactccttgcggaatcagtcccacgatgaaaaaaattgcaatttccaataaaataattgcgcgggtccagtccggagttagacggtgggttgattttcgtttaatcccttcagcaacaaaaacgcccagtgaaaaggcgatcaggggtgggatataggataacgcctgaatccagtgcccctgaatgactttgacagccagcagcacgatattgcctgtctgtgcgttggcgaaaacaccgcctcttccaacaaaggtatatgtgtccaaaaagccccctactaatgatagtaaggcgcccagtcgcaacgattcggacgttacctgatgtaaatggattttacctttcataaacacggcatataagcctcctatgctaaacgtcgattgtttaaagctaacacgaaaatccaggaccatacaattaaattaatcacttaagcatgaaaatgacacaaagaagccacatcaggtcccatacaatagaaaggacgtgatgcggcttctttggggatgctcgtttttagtccccatacgggactttaaagggtgcttatcgcagggcttgaacgagcgcctcgccaaatgcctgtgcgccatctggaccgtcggccgtaataatgtcgctatgcgcaacgacatgctgcgccacatattcggcttgatgcgattggagctgatctttttgtacatccactggatagcatgtagccgttctaccagagagtagtccggtttgagccacagctacagagcctgcgcagatgccagccaataaagtcttttgctcatgagtttgttttagcagagcttggagatccgcgttattccacagatggtcattcgtacctgatccgccgatcacagatactacatcataatcagccagcacagcgtctgtaaaaacaagatcagctgtcgctttaccgttgtagtcacccgtgatttcgcctgtttttgtactagctagcgtcacagtaacacctgcttgctccagtgcttccttgggtttaaacaattcatcctcattaaagcgctctgggggtataataaaaagagcttttttactcatactttattcctccttgaatgtgtaacgttatctactattgtagggtggcttcgtcaggctgtgaagaatgcactttcaagtacggaggttacctgcaggttactattagagtgcaagaccatgatggtttagaaggagttagttgatatatgaccgatacgctgagggaagaaatacgggaaaagatcgttaacggagactataactgcgaaaaggaactaaccttgtcagtgttaagcggaaaatggaaggtcgtcattttatggcatctgggtgtggaaggagcgcaccgtttcagtgacctgcaaaggctgtttccgaagctgtcgcataaagtgctgaccaatcagttgcgggagttgatggaggacggtattgtgcatcgggaagtgtatcccgaagtgcctccaaaagtggaatattcaatgactgagctgggaatgacgattttaccgattgtggagatgatgtatgactgggggaaaaaacgggtgcaatccattcgtgaggaaatgcaacgcagcggtgaggggaacgtttaaagttcctttatatgaaaaatagaacgccttgcactatgagtacaaattgcacttagagcaaaggcgttctttggcatgttagcagtctgtgtgtggttatcatgttagtttaggaaaaatagctgtagtccatatagatcattgcttttctagtgctggtagaacctcaatccagcgtgtagcccaagtaccgatatggtcaaacaaaggagctaagtcgcgtcccttatctgtaagagagtattcaatccgtacaggcttctcaggataaaccatacgttgtatgatcccttcttcctccagctctttcaaacggtcggaaaggacctttccgcttaaattagggattgaattctcaatagcgacgaaacgttgcggaccattggttagttgaaatacgatcaacaccgtccaacgcttactcagtagctccatagctttttcaaaccgtgggcacatctgcggaatgttcatgtgatcacctcatgctcttattattaacgattcactgttaaaagtaaatgattttactttacataaatttattacttgacgaaatcgaatgatataaatatactttgttacataaagtaacttgttggatttgatacggagccttttatgtgaatacttaaaaattgaacttgttttgataagattaatgataaaatgaacaggtacgaacgaatcgttgtggttatggtttgggcgcagggggaagtcggatgaagctggaatgtgaagtgtgtgtagttgggggaggacccgcagggactttgttatcctgtctactggcggagcagggtgtttccacgatattggttgagcggcagagcttgcccggaaaggctttccgcggtgaaattttaaatgatgagggtcaagaagtgatccaaaagcataagctgctcgaacaaattcatgaggattatattctcgcctccacaagaatcgagtattggcagcaccagcagcaggtaaaaacggtcaagccgggttcagtaaatggtaatgtaggggttcatattccacagcctcgatttttggaggctttgctcaagcaggcgtccatctacgagtctttccgttacctggcaggtacaacggtgactgcgttggaggggaacagcacgcaggggtataccggcttgatcgcccgcaataagaacggtcatgagatcacgattgacagttcgttgattgtaggggcagacggtcgctattcgactgtgcgcaagctggctcagatgcctgtgacgaacattcgacacggctatgatctgctatgggcgaaaatcacggcacctgctgggtgggagcctgtcactcgtctggcacgggtcaacggagggcagttggctttattctcgcaggctgagggctatattcaaattggctggaatgtggaggaaggtagcttttcaaccctgtttaagcaatcctttgaaccatttatacaactgtttaccgaggcttttccagatttgaagcatagtgtgcatgatcacattcgttcatggaaggacttcgtaccgttggatattttcagcagccgcagtgacacctggacgcagaacggactggtccttattggagatgcggcgcataccatgacacctaccggagcttttggcttgaatgcagctttgaaggatgccgatgtgctagctagtgagcttcttcgtttacgacagaagagctataccgcaggagacctaaaggcgttcgaagacggacgacgacaggctgtcaccgagcttcaggaacggcagctgacgatggaatccacgtttcatgaacatttcttacacatagttcaatgatttataccctgacaataacgattagcctttgaagaattaggcatttttctatatagagctcatataaaggatggtgcagagagatgaaccaaaaagatgtagctacgctacttaacgataaaattcaaaccgtccgcggagagcaatcttcgacgattttggtaggaccgatcaagctgccagttaatttggaaggagaaacggttgtttttcagtggtactgctggttgcccgtacgggatgaggaagatcgtcaggatttactgaatgccactgctgaaacgattgtgaagcgattgtccacactggatttggcagagggacaacagtcaagcgttttggtgtacggtgatcttcaacagtcggaaaatgcattagttcgcatgcatagtatttgtcatactggagatatttttggtagcaagcgttgtgattgcggatttcaactccaccagtccatgaaaatgatcgtggagcatggaacgggtgcattgttctatctggctaaccatgaaggccgcggaatcggtttgtttagtaaagcaatggcttatattctgcaggaagaaggcatggatactgtcgaagccaatcatcaattgggttttgaagatgatacacgcaactatgcggatgccattagtgtgctccgtcacctgagacaaaaaccggtaactttgattacaaataatcctaaaaaaatggatgccttgaagaagtcgggtatgaatgtggcgggtcgcatgccgctctggggcgatgtgtcgcaatataatgaacggtatttgaatacaaaagtggaacgatccggccatttgcgggattccgatctcagggaggttctatgaccactcacgaaaaatatatgcgcctggcactggaaaatgccagaagtgctaaagggcaaacagaacctaatccgctcgtcggatcagtcattgtcaacaacggtcgtatcgttgggatcggcgctcatctgaagcccggcgagccacatgccgagattcatgcgttgcgtatggcgggtgaacacgctcagggagcgacgatttacgtaacgctggagccgtgttcccatcacggccggacaggcccgtgcgcggaagcgattgtgaaggctggcattcgtcgagtggtgattgcagcgctggacccgaacccgctggtttccggcagaggggtacagattttgaaagatgcgggcattgaggtcattgtcggagtatgtgagcaggaatccatccgcatgaatgaagtgttcaatcaatatattgtgagcaagcgtccttttattacgatcaaatcggcagtaacgctggacggtaaaattgcgacccggacctcggaaagcaagtggattacatctgaggctgcacgggaggatgtgcatcgtcttcgtaacgagcatgtgggaatcctagtcggtgtacagacggtgattcacgataatcctcagcttacgactcgtctaccggaaggacggaatccgattcgtatcattttggatagcaagcttcgaattccattggatgcccgtgtcattacagatggggaggcacctacctggatattcacaggacgcacttatgatgaaagcaagcgaagccagttggaacagcttggtgtgaggatatatccgacacaggatgaaaacagcgatcgggtgaacctgccgcaaatgctggatattctgggtgcggcggaggtatcatcggtgttcgtggaaggcggagccgaggtgaacgcttcgttcgtgcagcaagggctggcagacaagctggtgctgtacattgcaccaaagctggttggaggacgcgctgccccgggatttctcgggggagagggcgtgtctgcgatgagcgatgcggtggcattgcaggatttgagcgtaacgcaggtgggcgtagactggaaaatagaagggtattttgagcggggaaaatgagtgagttgtttcgagtgaaggaggctccgcgaaggggttgatcttccgatcgctgttgcagtggattcttcggattgtattaagatatttaaaaggtaagaatcccactgcaaaggcgaacgctaccgcttctccagattcaaccccctcgctccgctgctgcccaccgcaaagtcactcatttttcgaaatggtacggagcatgggaaggtcattagaaactaaatactcaaaaacttataaattcaaaacagagaatctgaagggctaaaaggcctggaggattctttttttatatgctaaacgtttattagggtgaatggttaatgggatgaataactcatagggtgaatgtctaatggggtgaatttgagataacataattacgcaggcttgggcttttcgtcctggtttcttatgtatttttagagactttcgcctcgtttagttagaatatagaaataaaaggattgacctggaaattgagatcaagcacaatgaagttgaattcaacttggaagagaagggaaaagccttgcagtgaaagggattagagaaatcaaaggaggatgtaggttgtgaaaaaaacgatattatgcttgttaagtgccagtctgatatttttagctgcaccagtttctactaaagccttttcgggtgaggtcacacaaggcgctggctcatattcaaccacactacctaccggagcagcaacaccgcaaaacgagatttacaaaacagcgaatgtaaccagcccaatgcctaccaatgactggtggagcagtctggcctgggtaccgtactccgaggctcaatatccgcatccccttgccttgaaaaatcagcaaaacggtttacgcatctttaacccgagtgggaaaattacagtaaatcctggatacatcgcaggctggatggatgatgtgaacgattttaccgtcggtcattctgtaagcgcttcatttcccgatgccaaggtggactgtttcagcgactggtttgtcaaatcattatttcaaagcggcagcaataaaatgagtgctacctatggacacggctccccctatgttttttttgagtttggcggtggcaatcccaagctttcatttaatggggtaccagaggtatggtctgggtcagctagttctcctgtgcttggcattacggttaatggctcacactatggtctgtttgctccttcaggcagcacttggtctggcctcggaacgagtactctgatcaatcaattgaacgggaaaaactattttacagtggcggctttgcctgacaaaacaaaagcgacattggacaagtttcagcaatacgcttattctttcgttacaaactccaaagcacagtacagctataacgaagcctcttccgaggtaacgaccacctttaacgttgcaaccacagcgaaggaaggcacacaaagcggcactatttttgccttatacccgcatcagtggaagaattcatcacaacccctgctaggctatacgtacaattctgtacgcggtctgatgaaaacagcagagggtgcgtcttttcaaacgaaaatgaaatttacaggagtactgccttccctgcccgacttggggtcctacgataaaaatacgatcaacaattatataaacgaagcgaaagcagaagtctactccggcgatagagatacgtactggactggaaaacgtctgggcaagctggcagcgctggcgccgattgccgaccaggctggcaataccgcagcagcgacccagttccgcaatgagatcaaaagccggctgcaggactggtttaaggctagtgacagctcggggaatctgaaaagctccagtctatttgtgtataacaaccattgggggacattgatcggttatcctgacagctttggcagtgcagtagaattaaatgaccatcatttccattatggctactttatcaaggccgcagccgaaattgcacgtgtggacaagagctgggcatccgattcccaatggggacaaatggtgcagctgctcattcgcgacattgccaataccgacaggtctgattcaaaatttccgtatttgcgtaattttgatccctatgccggacacacttgggcttccggccatgccaaatttggcgacggcaacaacaatgaatcctcctcggaggcgatgaatgcttggtccggtcttattttatggggcgaggcgacgggaaatactcaaactcgtgatctcggcatctatctatacacaacggaaatgaatgccattaacgaatactggtttgatgtgcatggcacaaacacccctgcagggatgcaaagcgcgacggcaagcatgatctggggcggtaaaacggtagggaatgcaacatggtggaccgataatgccgcagaggtgcatggtatcaactggctgccgatcacctcggcctccttgtatctgacgcaatattcggagtatgcggctaagaactataccgatctgctgagaaaaagcagtgggaatttcagtccatgggaagatattgtgtatatgtacagagcgatctcggacccgtccgatgccaaggccaaattcagtgcacgcgtagcggccatgacaccggaagcggggaattccaaggcgaatgcctaccactggatctacaatttggatgctttaggcaacatcgaccgcagcatcaccgctaattcacctatttatgctgtatttcataaaaacggtgtaaaaacttatgtggcctacaattttacaaaccaggttaaaacggtaaccttctcagatgggcatagtattactgtgcagccgaatagctttaataccggaaatggaagcggcggtggcaatccgcagcctgatacggaggctccatccatcccggcgaatgttcgagctacgaccaaaacggcttcggtagtcactctggagtgggatgcagctacagacaatgttggcgttacgggttatatcctttataaggacggggctcaggcagcagaggtaagtggtacttccgcttcaattacagggctgagtgcagcttccacttacagctttaccgttaaggctcgcgatgcagcgggcaacctatctgcagcaagcaattccgtagaggtaacgacagagccagcatctggtggtaatgagggtggcggagaaacggaggattataaagtaggagctcgctttgtcagcgatcgtgaagcattgcttcaatttacacccaaaaaaacagcctcagcctatgttgacgtgcattatactttaacgggtggacaacagctcaattaccggatgacaaacaacggcggtgtttgggagcagcgggttacagacctcgatatcgggaaggctgtcagctattggtttacctatgaaaaggcgggattgcaatacgagaccccttcattcagctatacacaccagcagacttcttctacaacaacagacgttccacaacttccactaccgagcgttgatcccgttttcgaaaaaacatcctagtggatcagacctaagatacgaacgcgacagttaactatagaaagaaagacacaagggaagcacatacgcttctcctgtgtctttttttatagggtcgtaatactttcaccatgttcgtgagttccaggttgagcgataatgataaaggctgatacagaaagatattaccgaggcgtggatttccaaaggtcccgcagtgcctaccctgattgggtcaggtatcctgtaaatctgatgtatctatcaacaattagggttcaattcccaatcgccttccacgcgacttctgagagtattcgaatgatcgaataaaaacaatgaaaagacccggatgagagcatcccatgtctggtctcgatgacagatatcggggcgatggctatgcggccagcggataccggggagagcaagcgccgacaggctccgaagcttcgggagatgcgagttcacagtcgatgttgggctgacgaatcccatccctagaacacggaaacaggcggtatcttcctttttcctcaagcttggccccgccgtccacaccggagggatgctctgcaagggtcactaaccctactacaacaaataaaaataaaaaatcctcattttaaaagtgtgttgattttaaggcggatagcagcggagcggcccatttgaatctgaagaagcgaagcgttcgcctttgccactgaattttaaccctttaacgggttcatccattctaaaaattcagtggcgacagcgatcggaagatcaaatggaccgcggagccgccacacatagaaagaagcatacttttaagtggaggattttaatactaggagtgatacgatgtttaagaagataacgattaaatctgatgagcgcgggctgctgttcaaaaaaggaagctaccacaagttgttgcacccaggaacttacctattgaagacatttcagcaggaagcagttgaaattttgaatgtagccgcaccattttttgtaccggatcatgatattcgtttgtttttgacagatcccctattgcttgaacaattgaatgtcatcgatgtagaggaccatgaatatgtattgcattatgaggataatcggtttgtggggcttctgacggctgggaaatatgctttttggaacatgcttaaggagcatcgttttgttcgtgcagatactcggcagcctgcaattgataaagcattggggcaagcattcttgtccaagacaccgggcttttggaaggcacttcaggtggccagctatgaaatgggctttttgtattacgataatgtgttgcagggtgagctgaaaccgggcaaatattatttctggatgtccacagtgaatacagagatcaaaacgatagatatgcgacagcagcaaatggacctgatgggacaggaaatcatgacagaggacaaaatcacgctgcgcctcaactttgtctgtcagtaccgtatcatcgacccgttgcgggcattggaattccgagcatacgaggaacaaatgtacattatgcttcaactgctgctgcgcgagtacgttggtacgatgaagctggatgatttgctgaaaatgaagcaggagattgcggaatatgttttgactcgactaaatgagcagagcggcgaatatggagtgacttttacgtcagcaggggtgaaggatattattttgccaggggatatcaaggatattctgaataccgtgctgttggcagagaagaaggcacaggccaacctcatcacacgacgtgaagagacggcatccactcgtagtttgctcaatacggccaagctgatggacgagaataccaccctctatcgtcttaaagaactggaattcatggaaaaaatctgcgagaagattggcacgatttcgctgactggtgggaatacgttgctggaacagctgaacacgctggttcacatgaaagaagggcagggactccaataacggaaaatactcccgaacgatgagtgcaagccagctcaaggttcgggagtattttgcgttttagttcgtcttggtggaagcaagaaaagcatccatatcgatcaccggaatgagggtaccctgatgctccatcacagtagggaacaactcgcgctgccactcttcctcattgctttgtagctgactgtcctcggcagaagccgtgtcctccacctgatcgacaagcagagcaatcttcgcacggctgagcaaaatcattttgtcttcggaggaatcgcttgatgcaggaagaagcagttttttgcgtaaattaaggattgtaaagacaccaccgcgaatagttaccattccttcatgccacgcttcggaaaagggaagtggggtcccttttttggcattcatgacttcttctacttccagaaagttcaaagcgaactttttgtccgccagactgcacacaataaattcagacatagcaattctccttacatattcagataagccatcacaggttgtgaatgagcggtaaaatgggttagctattgcgttttgacagatggaacgataaagttgaggatgcggtaaagtagttgtagttaatcacagaatatcacaaacgagcagttaaatcttccaaattaacaatcatacggccaaggcgtggcttcaagtttcccttcatatataatgttggggactaaagctgtgtccgctggcactacattttaagataagcgggttgaggtagaatggatcatgaaaagcagcgattaagtatcgaggcagccagattatactatctaaacgactacagtcagcaagatatcgcggtcagactcggggtttcgcgtcctacggtatcgcggttacttcaggctgccaaggaacagggatacgtgcggatcagtattgtggacccgatggaggatatggacgcgctcggagagcaggtgaagaagaaattcggactggataccgtgttagtctgttattcgccgttaaatgaatatcaggagattaagaagcatattagcaaaaaagcagccgattatttgcatgaaacggtacaggatgctgatattattggagtgacatggggaacaacaatgcatgccgtagcgcttcatctccagcaaaagcaggtcaagggtgttgaggtggttcagctcaaaggaggcgtgagccattcacatgtcaacacatatgccgtggaaaccgtgaatttgttcgcagaagcctttcataccatagcaaggtatttgccgctgcctgtgattttcgacagtcacgctgttaagaaaatggtcgaggaggatcggcatatccagcgaatcatcgaacttggcaagcaggcgaacatcgctgtgtttacggtggggacggtcaaggaggatgcgttgctgttccgattgggctattttaacggggaagagcagaagctactgcaaagaattggcaagggcgatatttgctcgcgcttttttgacgctgagggcaatatatgcagtcaggaaatcaatagccgtaccgtcgggattgatttgcctgatttgcgaaagaaggagaagtccattctcgtcgctggaggccagcgtaaagtggaggccattcgagcatcgctgcgtggcaagtatgcgaatattttggtgacggatcagtttacggctcaagcacttttacaatagagcaagtcgtctcaacccagcaaaatgtacggttatggcgcgtacctacagggtaatatgaattgtaggtgacgccttgtgcataagcttgaacataatttcaaaatgtgttttacatatgttcaaagccgtgctatgatggtctcatcacagagaaataaatgacttttgtcttcacactatttatctaatgaaggagcttttagatatgaacattgcagcattaatcgaccatacattgttgcgtgcagatgcgacgaaggatgaaattacgaaattgactgccgaagccaaaaaatatcagtttgcttctgtatgtgtgaacccggcgtgggtagcttatgcagcagaacagctcgcaggcacaggtgtagccatctgtacagttatcggttttccgctgggagcgagcacgtcggcaacgaaagcatttgaaacgaaagatgctattgctaacggcgcgactgaaattgatatggttattaacataggcgctttgaaggcacgtgatgtacagctcgtcgagcaggacatccgtgcggtcgtggaggcagctgccggtacactggtaaaagtgattatcgaaacttgcttgctgacagacgaagagaaggtactggcatgtgagctgtccgtcaaagcgggagcgaattttgtgaaaacctcgacaggcttctcaacaggtggagctactgcggaagatgtggctttgatgcgcaaaacggtaggacctgagattggtgttaaggcttcaggtggtgtacgcagtctggaagacgtgcaaaaattagtagaagctggcgcaagtcggatcggtgcaagttccggtgtgaagatcatcgagggcgagcagtctacatcttcctactaagtttattttaaagtcatggagggattcgcgatgaaggatcaattgattcagaaagcgcttgaggcgcgtaaacaggcatacgttccgtattcgaattttcaggtgggtgctgcggttctcggaagcgatggcacgatttatcacggatgtaatgtggaaaatgcctcctacggcttatgcaattgtgcagagcggacagcgatttttaaaatggtatccgaaggctgccgtcaaattgattcgattgcggttgtagctgatacggaagggcctgtgtctccatgtggggcttgtcgtcaggttatttccgaatttgctcatcaagataccaaaatttatctgacaaaccttcatggcaacacggaagagtggacggtagatcaattactgccgggtgcttttcgacctgcggatctgggcaaataaaaaaaagaatgcctctttggagcgcattctttttatagggaatgtaagcgcttaatgtaatgagggggaaattaaatgaaatatgtaatcgctctggtgggactgctcgttgtatttgcacttacttacgttgccagcagtgacaagcgtaaaatcaggtatcgtccgctgatagttatggttgttctgcaagcagcgcttgctttcgtattactgcatacaggaattggcgaatttttggtcaaaggctttgcagaaggttttaatagtcttttggcatatgcaactgaagggattaacttcgtttttggcggaattgcgaatgaaggagcagcaccgttctttatcggtgtactgctgccaatcgtgttcatatccgcactgattggcattttgcaatatgtaaaagtgttaccttttattattaaatatatcgggcttgtcttgagcaaagtaaacggaatgggtaaactggaatcctacaacgctgtagcttcggctatcttgggtcaatccgaggtgtttatttccgttaagaagcaaattggtctgctgccaaaacatcggttgtatacgctgtgtgcgtctgcgatgtctacagtgtccatgtcgattgtgggagcttacatgcaaatgttaaatcccaaatatgtggtcacagctttggtattgaacctgttcggcggctttattatcgcttccattattaatccgtacaagattgagaaggaagacgatttactggaggttcaggaggaagagaagcagtccttcttcgaaatgctcggggaatatattatggacggtttcaaggttgctattacggtagctgcgatgctgatcggttttgtggcgctgattgccatggttaacgggattttctcctggttgtttggaatcagctttcaggcgttgcttggatatgtgtttgcgcctttcgcttttgtcatgggtattccgtggaacgaagccgttcaggcgggcagcattatggctaccaaactcgtatccaacgaattcgtggccatgctggatctgaccaagcaaacaggcttgtcggagcgcacggtcgggatcgtatcggtattcctcgtatcctttgctaacttctcatccatcggtatcatttccggggctgtgaagggtctgcatgaaaaacagggaaatgtggtggcccgctttggtctgaagctgttgtacggggcaacgctggttagcgtgctgtcggcaacgattgcagggttgtttttgtaaaaaaaacagcgagtcaggaaaggatttttataatgtctaaattcaaacggattcacttggtggttatggactcggttggtatcggcgaagcgccggatgctgcacagtttgatgattacgatgtagatacactcggtcatattgcccgcgaacgcggtggtctgaagatgccgaatatgggtaagctgggcctgtccaatattcgttccatagaaggggtggcagcggccgacaagccgctcgcgtattacactaagatgcaggaagcgtccaatggcaaggatacgatgacgggccattgggaaatcatgggtttgaacatttcggttcctttccgtgtatttcctgatgggttcccggatgagctgattcaacgcattgaggagcacacaggtcgcaaagttattggcaataagcctgctagcggaacggaaatcattgatgagctgggcgaagaacacgtgaaaactggagcgctcatcatctatacctcggcggactcagtgctgcaaattgcggcgcatgaggaagttgtacctttgaaggaactctatgagatttgcgagttctgccgtaaaatcacgctggaagatccgtacatgctgggtcgcattattgcacgtccgttcgtaggcgaggcagggaacttctcccgtacctccaatcgacatgattatgcgctcaagccgtttggtcgcaccaccatgaacgagctgaaggatgcaggtctggatgtgatcgccttgggtaaaatctctgacatttatgacggtgagggtgtgacgaaggcggtgcgtacggtgtccaatatggacggcatggataagctggtggctacgctcgatgagaatttcaccggattaagctttctgaatttggtggactttgacgctgtatacggtcaccgtcgtgatccgcagggatatggtcaagctttggacgattacgatgcgcgtctgccagaggtttttgccaaaatgaccgatgacgatctgctgatcatcactgcagatcatgggaacgacccgacgtatcgtggaacggatcacacccgcgaatatgtacctttgctggcatattccccgcgttttacagctgggggcaaggagcttgcggttcgtaaaacctttgctgatattggagcgactgtagcagataactttggtgtaaaactgcctgaacacggaacgagctttttggcagagcttcagtaatcaaggaccagcaagagtaagcaagattactagtaacgatataaataacgatacaagcatggacaaatgggacggaggaataaaaaatatgagtgtacacattggagccaaacccggagaaattgcagaaacgattttgctgccaggagacccgctacgggcaaaatttattgctgaaacgtatctggaggacgtgacctgttacaacgaggttcgcggaatgctcggattcacgggtacgtaccaaggcaaacgcctatctgtgcagggaaccgggatggggctgccttccatcagtatttatgtcaacgaactgattagcgaatacggtgtgaaaaacctgttccgcgtaggtacatgcggcggaatgaaggagcatgtacacgttcgtgacgtcattttggcacaagcatcctgtacggattccggtatgaaccgccatatctttggcggctacgactactcgccgattgccagcttcgatctattgaagggcgcttatgatcgtggtgttgccaaaggcctgaacatgcatgtcggtaatgtattcagctcagacagcttctaccgtgatgacaaatcagtggtacaaaagctgatggaatacggcgtgctgggtgtagagatggaaacttcggctttatatacgttggcagccaagtttggcgtaaacgcactgacgattctgacggtaagcgatcatttgctgacgggggaagaaacgaccgcagaagaacggcaaacaacctttaaagaaatgatggaagttgcactggatacagcagtatctctgtaaacgatcatacgcacagtgaggagaaatgacatatgagaatggtagacttgattgagaaaaaacgtgacggaaaagaactgagtacggaggaaattaattttattatccaaggctacactcagggtgaaattcccgattatcaagtcagtgcattggcgatgtccattttcttcaaagatatgactgaacgcgaacgcgctgatctgacgatggcgatggttcattcgggtgataccattgatctgtccgcgattgaaggtgtaaaggtcgataagcattccactggcggtgtgggtgatacaacaacgcttgtactggctccgctcgtagcggccttggacattccggtagccaaaatgtcaggccgcggcctcgggcataccggaggaacaatcgacaagttggaggctattgcaggcttccacgtcgaaatcagcaaggacgaatttgtggatttggtgaatcgcagcaaaattgcggtcatcggacaaagcggtaacctgacacctgcggacaaaaagctgtatgccttgcgtgacgttacggcgacggtcaactcgattccgctgattgccagctcgattatgagtaagaaaatcgctgccggctccgatgccatcgtgctcgatgtaaaaacaggtgcaggagcatttatgaaaaccgtagatgatgccaaagcactggcacatgccatggtgagcatcggtaacaatgtgggtcgcaaaacgatggcagtcatttccgatatgagtcaaccgctgggtgtggccatcggtaactcgctggaagtaaaagaagcgattgatacgctgcgcggccaaggaccgaaagatctggaagagctgtgtatgactttgggcagtcagatggtatttttggcagggaaagcagaatcccttgaaaacgccgaagagaagctcaaagaagtcattcgcaatggcaaagcacttgagaaattcaaagagtttattgcgaatcagggcggcgacgcttctgtggtagatcatcctgaacgcttgccacaagcacagtatcttattgaggtgcctgcgaagcaggatggtgtggtagctgaaatcgtggctgacgaaatcggtaccgctgcgatgttgcttggagcaggacgtgcgaccaaagaatccgagattgatctggctgtcggcttgatgctgaacaaaaaggtcggggatgctgttcaaaaaggcgattcactggttaccatccatgcgaaccgtgaagatgtagctcaagtactggagaaaatctacgcgaacatccgtattgcggatcatgcggaagcaccagtgctgatctacggaacggtgacagagtaagcgagcggtaagacctattcaaaaagttttgttgggtgtctttgatcaagtttgaaaaatatgacagctggactcataatagatatgagttcggctttttttattgtaaggccgagggcacagaggaggagagacatgttcagattatacagcgatcttcggggagcagcctatgaaagactgattgattatgctatggaacgggcagacacgtttatgctaggcatacataaatgggcgacagaggatgagaatggagtgatcgaccaggatactctgttcaaggaattactacagcaattgaaaccttttttactgtccacacactcatatgaggaaattaggggcatgcattccattgcctacacacaaggaacattttaccgataccaatgtgcgcctgaggcagggggattattaaagcaggcggcgtctagtttgttttcttgggtacatccccaattgcctgaagatttgtgcttccagaatgcggatggagaggattggatcattaacatagctcacgaacgaataggtagactaaacatggctacagaagaagcggatgaattggagaagcttattcccggtgtgtttattcacaaacctgaatatcatcagaatatagatgtttttctggacgatgctattcggcatcaaccggatcgagtggagcttatgtcgtttggcttgagggagataccggaacggattagagaactgcattctctgaagcatctgaccattttcgagcaggatatacgaacactaccgcacgctttgttcgaattggaatcgttggagtcactgacgatacaagtagcggatttggaagagctaccggctgatattgccaagctgacccggctcaaaagcctgaggatcagctgtggatgctatgatcgcccggcaccagatgtcaaagtaattcccaaagaggagctggcattccggcatttgcctcctgaaatcggagagctgcaacaactggagtatctggatatccagtatagcggaatccgtacgttgcctcctgaaatacaaaacttgaacaatctacgctctttggacattgtgaacggattcatcgaatcggcacccgactttatatataaaatgacttggctggatcgcttccttatagaagataagccgttccatctgtgcaatcacggtgacgactgaaggatagataagaaaaggaggaaatcaaatggtggagaaatgggtttggatgggggttgcaggggcaattgtgggttatgccacttttgctaatatgagcgttcctacatcaactattacagaagtaaatcagagtcattcgactgttccgcttagtatgcagagtaagcaaggaagtgcagcgaaacgcgttgtacatgaccaggagatgcaatttggaggacaaggacaaacgagctttagatttgaagaggggcgcaagttgtacatcagtattaagaatacaggcaagcaacccgtacaatacaagctcaatagtgcaaatggattagacttgcaagggtcaacgagcgggttttccagccaaacgttgcagccgggagaacgccacgatctgctgtttgtaaagccagaggggcaggatgaagctgcaaatgactccttgaaagagatgattttgaaagtaagtacggacgatggatcgcaaggaaacgttaaaaccttcgcatatattacactgtaagccccttccagaaagggtgcgacatgcggtcattagtctacttatgttacaatagaacggttgaagacttaatgaacagaataggtcagagcagaaagcagaaaggatgacccgttgtgcccaaaaaccatgaattcggtaatcaaaagatgtcacggaggctgtcactcacagccattttacttacacttacttttgtagcacttactggctgtggtcaggataagaatgctgaaaccattgatactggaagcagtacaagcgtgatcgagaacggagccggtggtaatcgtagcggttcagcccaaagtgacaaagcagcgaaagagagcgagagtgcagaaaacagcggtacggatgcacaaaagtcagctccttcggctccagctgcttcatcggatacatcttcttctccggcagtctccaatccatcgcaaaatccatttgaggtagcaggtattcaagatcctaaagcgtttttgaacacgttcaaagcgctgcagaaggcagttgccgacaatgacaaggagaaagtggccgattatattttgtaccctctgcgtgttaatgatagtgaaaagtcgctaacgattccgaataagaaagattttatggccaagtatgatcagatttttacggacgcaattcgcgaggcgctggtgaatcaaaagacagatgatttgtttgttaattatcagggagtcatggtgggttcgggtgaactgtggttgagaagagctacggacaatccgaagctttttggagtcttttcgattaatcttgaaacggttgccaactaagtcgtactccgtgtgtaaatgacctctaaacggtcggaaacatatatcatgtttctgactgcccccctttaaagaaagaaaagtacagatgatacataccaaaaaaaggtttgacatcactcctaaactctcgtattatatccatataactcattaaacaggtaggaattaaagaattaaagtatgatctcgccattttggcggagaacctctaggaacagcaggcagacactgtccacgcgacaggtttgacctatcagagctgcatcagggaattctccgctctttttttgattatgtctgtaaataacaggcgtaaatgaatacaaattacatagaattcggggtgtcttgatgaaaaggcaatggaaaagtggacttattctcggactatctttggttttaacgattatgctgagcgcttgcggggcaagcaagggagggacgcaggcggatggtagttctgctgccggttccaaggaagtggagttgctcaatgtttcttatgatccgacccgtgagctgtatgaggcatataataaagcgtttgccgcccattgggagaaggagaaaggacagaaggttacgatcaagcaatctcatggaggatctggcaagcaaagtcgttctgtgcaggacgggctggatgcggacgtggtaactctggccctgggctacgatattgatgcgctacaggaaaaaggatttgttaaagaggggtggcaaagtaaatatgagcataacagcgccccgtacacttcaaccatcgtgttactggtgcgcaaagggaacccgaaagggatcaaggactgggacgatttaatccgtggcgatgtgcaagttattacaccgaatcctaaaacttcgggcggggcacgttggaactatcttgcagcctgggcctatgcgctcaagaagaacaataacgatgaaactaaagcccagcagtttgtacaggacctgtataagcatgtgcccgtactggatagcggagcacgtggagcgacaacgacttttgtagagcgtggaattggcgatgtgctgattgcatgggaaaatgaagcattgctctccgtgaaggagctgggtgcggataaattcgatatcgtatatccatcgatcagtatattggctgaacctccggtagcagtagtcgataaggtggtagataaaaaaggtacacgcgaggtggcggacgcgtacctgaaatatttgtacagtgaagaagggcagaccattgctgccgaaaattattatcgcccaacactggagagtgtgacggcaaagttcaaggaccaatttcctaacttggagctcgtaaccttgaaggatgtattcgggacatggaaggagacgcagcagaagcatttcagcgacaaaggcatttttgaccagatttatgtacccggcagttcataaaataggtgggctgtgtaggcgattgatcggtagccgcgagtgtcatagtgaatggattcagagagggatgaacagaacatgagtcaagtgcaagccacccgaaaacgcgtacttcccgggttcgggttaacaatgggttatagtgtgctgtatctcagtctggtggtgctggtgcctttatcggcactgcttctgaattcaactggactgacgtgggaaaaattttgggacgtggcgactgatgtcagggtgcttgcttcctacaaggtaagctttttgtgtgccgcggctgcggcgctgatcgacctgtttctcggtttattgatagcctgggtgctggtgcgttatgagtttccggggaaacgaatttttgatgcggtgattgatctgccctttgctttgcctactgccgtagcgggggttgctttgactgctctgtatgcgcagaacggctggatcggttcattgtttgaaccgcttggatggaggctggcatactcacagacgggaattacgctagcattgatgtttattggcattccgttcgtcgtacggacagttcagccggttttggaggagctggataaggacgaggaggaggtcgctgctacgctgggagctggcagatggcgtatcttctgcagcgttattgtgccggagctggtgccgccgctgctgacgggttttgcgctcgcctttgcccgtggtattggcgagtacggttctgtcgtcttcatctctggcaatatgccgatgaaaacggaaattgctccactgctcatcatgtccaagctggagcaaaatgactatgcaggagctacggcggtagcgttgatgctgttggtgatttcattcgtgctgttactcgtgattaacagcattcagcgctggtcacggcgccgtgcagtttaacgtaactgcctaaacgcaactgtctaatgtaattatctaacgttaacatgcagggctgcgcatgatacccgcattctaaggagggatacaccatgtcacaagcaataactgggcaggagcttgcttctgcaccagtgccttcatccgcaccgcccaacagggtcacaaccgaggccacttgggtgaagtggacgctgattggtgctgcttttttagctttgctctgggtgctggtattgccgctaatcgtcgtgcttaccgaagcgctcaagcaaggatggggcgtctacgtcgaagcattacgggacccagatgccatgtctgcattgcggttgacgctgctggtggcagcgataacggtaccgctgaatacggtatttggtgtagctgccgcttggctgatcacgaaatttcaatttcgcggcaaaggcttgctggtcaccttgattgatttaccttttgccatctctcctgtcgtcggagggctgatgtatgtattagtgttcggcgcacagggctggcttggaccgtggttggacgagcatgatattaaaattatatttgctctgcctggtattattttagcgacgctgttcatcacctttccatttgtggcgcgagaactcattccaatgatggaagatcagggacagcaggaggaagaagcggcggtcacgctgggcgcgcgcggctggcgcattttctggaaagtgacgctgccgaatatcaagtggggtctgctgtatggcatcattttgtgtaatgcgcgagccatgggtgagttcggtgcagtgtccgtcgtctctggacatatccggggagagacgaatacactgccgctgcatgtagaaattttgtataacgaatatcagttctcggcatcttttgcggtggcctcgttgttattgttactagctctggctactttggtgcttaaaagctggtttggacgcaaacgcgtgcattaatttatgattttgtatatgattcctcagggcctctctttgcgtctatcgtctgttaacggcgagaagatgggaagagaggcccttgttctaaggtggcttatatggataataaaatgattatatcaaggcacgttggtgtgcccaggaggagcgaagggaaaaatgaaacatccgtttcagtcctaccgtcagctgtttccagtgctgtcctcacatatccatgtagggagttgttcccagggggccgtatcaaggccggtttccgctgccattgaggaatatcatcgaagtttgctgcaacacggtcataacggcgatctgtctatggcacgtttggaggaggctagagggcattttgccaagctcattggggcggagcctgacgaaattgcggtcctgtcctcagcctctgaggcgattgccggggtggccacagcccttccttatgtaccgggaaaagaaggcattgtgtatgcggacaccgactttccgacggtgggacacatctggcaggcacaggagatgttccgggatcacatctgctgtatcccctccatcgagggagaagtgacgatagagcagtatgaggagcatgttacggagaaaactgcactcgttatggtgtcacaagtgaactataccaacggatttcagcaggatttaaaatccattgccgatatagcccaccgaaatcaggcgttgctgtttgtggatgcttatcagtctgcagggatcattccagtggatgtaaaggcaatgggcgtagatatattggtcgcgggagcacgtaaatatatgcttggaattccaggcgtggcttttctttatgtaagcaaggaccgaatagaccgcttcaagccccgtcttacaggctggcttgggcaggagcccgcttcccggtttgatattgctcacccggttccggcgccgggagcccgacgctttgagacgggattgccttctttcattagcatttttgccgccaatgcggccttaaagctgctgctggagattggagtcacgaatattcaggcctatatgagtgagttgttggatttttccgttgaatatggacggcgcaaagggttacacatacgtgtaccttacaggggaggcatattaccaagcctgctcgctgttgaagtagccgatgtgtcggctgtggagaggaatttgagaagccaaaatatgatcgtttcagcacgaaaggatgttatccgtgtggctccgcatttttacaatacggctgaggaagtccgacgggtcatagatgaattggcagggagatgttgaacgaacggcaaaagcctcttccgagtgaatgggagtataacatccctttttacacaggagaggctttttggacgtttagaattctaattatacgatccgtttgcgcagccagccggaaatcagatccgtcaaaatgatcaggaccacaatgccgagcaagataacgcctacacggttccagttgcgcatttggagtgcaaacagtagcggagtaccgataccacctgcaccgaccagaccgagcgtggtagcagaacggatattaatttcaaaacggtaaagcgaatacgaaagaaactgtggaatcacctgcggtagcacggcgaagaaaatcacctgccaacggttggcaccgcacgcgatcaaagcctcttgaggcccgtgatcgacactttcgatcgtttccgagaaaagcttcgccagcatgccgatggagtgaatgccgagggcaagcacacccgcaaacgagccggggccaacggctttgataaacaagatggcgacgatcatttctggaaaaacccggatgacactaagcacaaatttcccgctacccgataagggacgtagacgagtcatattgctggacgcccaaaaggcgaacggaaggcagacaaatgcggacacgaaggttccgagtactgaaatgaccagcgtatccagcaacccgcgcagtaaatcctctccctcagggatgtagacgaacgaccagtcgggatgaaggaagccgtccaatatagcgacagagacacttttagccgttccctgtaatccttcaaactgcatcccgcgaaaagcccaaatataaatgatgattagcagaatagctatcgcccataggcgcaggcgggagccaataggtctgcgaagcgtaggatcattcataataatttcctccgtagcaggttactgccgtaatcaatcgcaaggacgatgacgagggtcagtagaataatgatgcttgcccgatcatatcggaacagccccagagaacggtcaagcaacagaccgataccaccagccccgaccaggcccagaacggaagccgcgcgcacattaacctcaaaggtatacagcaagtacgacacaaaataaggaagagcctgcggaaccacaccaaaggcgatgacttgaatgcgactcgcgccaacagcggtcatggcttccagcggcccgggatcaatggcttcaatcgcctcaaaggtcagcttggctatgatgccaaaggagaagaagagcagggcgagcatccctgcaaacggcccgatgccgaacacggccacaaagatcgaggcaaacagcaaatcgggaatcgtccgtaccaggttcaggatcgtgcgcatcggcagcgaaatcagtttgcgcggcatcacattataggcacacagcaacgcgacagggatcgccaatatggctcccagtgtcgtgccgacaatagcgatctggatcgtttccagcatcggtttccagatggtaggcagatagctccagtcgggcggaaacatttcgcccaacaatttgcccatctccggcaagccgacgatcaactggtaaggtgtggcatccgtatgaatggagcaggctaccagcaccacgataaaaatcatccaggtggcataacgtttgtaacgtcctggcaaaggtggacctgcgggcggcttgcttggctgtggcggtccagcatgcgatgacggttgcgtcgaagagagcggctgggcagtagagtcgggcttcatgatcccactcccagcagctcatcatgcttgatggctcggccgtagatctccgcaaaggcctcatccgtagcctcctccggtgtgccgtcaaagaccacttccccggcgcgcaatccgatgatccgcgttgcatattcgcgcgcgagatcaatgaaatgcagattgacgatggtcgtaatctgcatttcacggttgatgcgctggaggtcatccatgacctggcgggtggtcagcgggtccagcgatgcgacaggctcgtccgccagaatgattttagcctcctgcgccagggcgcgggcgatggatacgcgttgctgttggccaccggacagttcatctgcccggctgtaagctttttcgcggatgttcacgcgctccagcgctgttagtgccagttcgatatcctccttcgggaagagaccgagaatggtccgcagcgtcgaatgatagccgacgcggccggaaagtacattgcggagcactgtcgaacgcttaaccagattgaagctttgaaagatcatgccgatatcacggcgaatgcgccgcagctcgctgcttccagcagacgtgacggacctgccacccacgacaatgtcgccggacgtaatgtcatgcagtcggttaatggaacgcagcagggtagacttacctgcaccggataagccgacaatgacgaccatttctccctcctgaatcgtcaaattaatatggttcaaccctttggtgccgttcgggtatgttttcgatacgttacggaattcgatcatatgctcccaactttctcccccgatggggtggaatgaaaacaacaccgccatgaatacatggacggtgctgccctgtcattcgtaaagcctgtttcgtagctgttacttcattacagtaccttgtttgctccgattacttaaccgcttgaccaacggcttcggcgtattcacgcacggagtcgaagtttttatcgtcgcccttttcataacctacatgggtgtaaatttctttaatgatctcgccgcctgcagggtctttggcaatgtcaataaaggcttggctgatcttgtctctccacgcttgatccatatcagaacgtacgctgacggtgtcatttggaattttagctgtgtaatgaatgacgcgagttttttcaaatacatccgggatttccttcttcaccgtgttacgtgcatcctggaaaacagctaccgcatcaacttgaccgttcagcaacgccagaatagcagcatcgtggcctttgattgtcacaccctgcacatccgtgtccgggtccacgccagcttttttcagctctgctgcagggtacacgtagcctgcggaggaggttacattttgccagccaaccttcttgcctttcagatcagctagactttgaattggagaatcctttttcaccacgatcattgctttataaaagtttactttttcagtcgtgtccttgcctgtagcatcttcaatgccgtagcgttgagcttgcaacagcaaatcggctgctttacggttatcgtgggccagtacataagcatttggcggaaggaatcctacatctacctgtttggaagacatggcttccacgattgtattgtagtcaggagatacggttactttcaccgggattccaagcttgtcacccagtagattttcgagcggtttggctttggcttcgagcgtatctgcattttgagaaggaacgaactgtacctttaactccttaggaacataggctgtgctttcgtttttagagccatctgtacccggagtggacgcgctgttgttattgcttgcattggagccacaagcggctaggcccgctgccagtgtgaaggtcatgcacaaggtcagtgcttttttgaacaaaataatttccccctaaacatagtaataacgaaaataaaattaaaaacctgtaaatgctgtgacaaaccaaatcttaacagctagtcccacagctagggttaaaaccactcctgactttggtaaaaatgatgtaaaatttatcgtatggtaaaaaccgttttctggatttatgcgaaatgtttattttaacattctcttaacagtgctctgttagacttgttcaagctctatgaccgaagctgagggagagaacaagattggatattttggatattaacgaaaaggcagaccaagacaatgtaagccttgtgagagtgaaatttcgcattatggttacaaccgatttgcatgtcagtttgtggaattacgattattatacggatcaggagacgttgcattacggtctggcgcaaacggccagtctcattcaaacagcccgggcggaggtacccaaccatatgctgctggataacggagatgtgatccaagggaatccgatgggggattatgctgtacagcgaatccaacaggacccaagcgcggtgcatcccgcctataaagccatgaatctgcttggttatgaggcaggtaatatcgggaatcatgaatttaactacggactggaatacttgcagacttgccttcaaggagcgcaatttccttatgtgaatgcgaacatttatatagcaggagaacaagaacgaaattactttacaccttatctattgctggataagacggtagagtatgaagcaggcggtaagcatctgttgaaggtagggatcatcggctttgttcctccgcaaattatgcaatgggacaaggcgtggctggaggggaaaatcattgtcaaagatatgctggaaacggcaagacggtttattccacaaatgaaggcggcgggagccgatctgatcattgccatgccccatgctggcttcgaagatattcccgaaacaccttatatggaaaatgcggtgctgcatctgagcaggatggaagggattgacgccattgtatttggtcatgcccataaagtattccctggaccttcgtttatggggaaaacaggtgttgatctagagcgaggtaccatccacgatattccagcagtggagccgggcttttggggggatcatctgggtatcattgatctggagctgacctttagtggaggaaagtggcaggtggttgcatctgctgccgaggtacgcccggtgtatgatccgatacgcaaggaggcgctggtacaaccggatactgccattcagctggaggtagcagaagagcacgccggaacattggagtatattcgtgcacctgtaggtcagacgacgatggcggtgaacagcttttttgctcaggtgatggatgatgcttcggttcagctggtgaatgatgcgcaaatgtggtatgtgaagcagcagatgcaagggagcgagtacgaaggattgcccgttctgtcggcagcagctccttttaaaacaggcggcagatacgggccatcgtactataccgatattccggcggggacgttggcgatcaagcatatcgctgatctgtacaattttccgaatacgctgcatgtcgttcgactgaccggtacagaaattcgggaatggctggagtggtccgctggacaattccggcaaatcgatccttcagcagaacaagagcaagagctgattaattctgattttccaagctttaatttcgatatcatcgacggcatcaggtatcaaattgatgtaacacagccaaccagatatgatgctgacgggggcctaaaggacccagatgcacacagaatcattcagatgtcttttgatggcgaaccgatggatatgcagcgaaattatctggttgttacgaataactatcgcgcgttttcctctgcgctggtcaatccgggtggagagcgaattatacttgcttcaccggatgagaaccgtcatgtgctgaccgaatacgtgcggaatatgaagacgttaacgccaaaagctgacggccattggtccctcgccccatggtcaggtcgtccgcatgtgacgttcctgacctcgccgcaagcaacggatgccgctaatgcctattcggagttgctttatgaagggttaacggtagagggatacgctaagtttgccatcgatttcggacgttcacggtagaactgctaactagtttttgtcctataagtccacagcatcaaaataatagaaatagactgtcccgcagaggacggtcttttttcataaaacagttttaaaatcgtacaaaattcgtgtttttatatgtcctgagtcgtgtttaaagttattgacctctcgtataaatagacatatactttgattaaacaaattttggtttaaaaggtaatgaaaaagtcaccatcattcgtttgagggggtgtccctttggaaaaaaacaccacgattcgcgcagaaatagaaaagtatattcaaagtgaaggcatttcaatgcaatgttttgcagatgcttcaaaggtaaatccgggtacacttagcggtatacttaatcggaacccgccacggcctatctcagtcaatcagcttgatctgattacagaggccatgggattggaagaaggatctttgttcgagatgtatgtggatgaatgttttattcattccttaccacactggaggaggttgcgtccgtttctcctgcgttgctcagagttgaataagctggagtgtatacgcagtgtacttggctatttgatggacgatttatcgaatgttcctgctatttttgagaccgcagaagcgatgtttgaggatggcagacatgaagcttccatgcttctgtatgattgtgtcatcgagagtgagaagtatacccactctgaacggttggcgatcagctatttccgtatattccagattcagattaaggataaccaacggaacttgaaggctgctgtacaattccatttgtaccgtagtcgtctaccggaaatttacgcactggaaggcttacatatgctatctcaagtgtttgctttaaaaatgcaatggtccgagatggaaatgtatgcggacgaactaagagagctggcgcaggcattgtatcgcaatcggaaccgttttggagatgagcacctggagctgcttaaaccgctcgtttattactatgctcagggacatctgctcaaggccagctgctatgagtttcagggcagatatgaggaatccaagcaatggattgaaggttatgcagatttgagctggtttgagggtttagacgaagaaggctggaaagtagtcaacctacatcgtgtatatgcacagggcaaccgactttgtattgaaattaaaatgggcaacacttctgcaatctatgaatatattacttacctgcgtgagcatccggatgagacactggaaggactgaacaccttgctcgaatcggcgaaccggttcggttatttcgtggatgccgaactgggactgtttagtcagcaactcaagagcttctgggaacttgcaccggaacgatgggacactcattatcgcaagcactttaatgcatttcgctttgcatccttttgcaaggtgtatgcggaatattatttccgaaaaggcgattaccccgagggagtgggacaaatactgcattgcttgaaactgtctgtcgataatagctataccgaacatatcattggttgtatggctttatttgagcagcatcggaattttgctacaccggaacagcagcagctgtatcagagtctgtgtctgggcgtacgtgcaaatgaaaagaatcatgcctatgatcacagtaccggtggatatttataattccaaatttcattcgaattcttcatataacacgttattgcgaggatgttcctgtttcaaaaggggatgttctcgttttttagctgctgctgtcgcttgtgacttttaacatagaaaggaccgttttgcgcgttgacaagtttcgcaagcgggattaggataaatgcagcacagaaagtgaaggagagcatgtacaaatgacgattcccaaaacattaacgatagccggctccgacacaagcggtggagcgggtattcaggcagacctgaaaacctttcaggagcttggcgtatatggtatgaccgtattgacaaccgtagtagcgatgggtcctaaaacctgggatcatcttgtatatcctgttgcgttggatgtggtagaagcgcagctgcgtactgtattggaaggtatcggttttgatgcgatgaaaaccggtatgcttggttccgttgaaattatcgagctggtagccagccatttgaaaaagcatgatctgaagcggatcgtaattgacccggttatggtctgcaaaggcacggatgaagtgcttcagccggaaaatacagaggcgatgctggaattgttgattcctggcgctgacctggtaacaccgaacttgttcgaggcttcgcaactggcgaagaatggaccgatcacgacactggagcagatgcaggaagcggctgcgattatccatgagcgtggagctaagcatgtactgatcaaggaccgtggcaaaattcgcgcaggtaaagcgatggatctgctatatgacggaatcacttttgactggtttgaagccgatgttgtaaaaacaaactttacccacggtgcaggctgcaccacttcggcagcggtaacggctggtttggctcaagggctgactgtacgtgaagcagtggatcaggccaagagatttattacacaggccattgaaggtagcttcaagctgaatgaattcgtcggtccgaccctgcatgcggcacatcgtttgcaaaatcaataaagcatgaaggtctgcgatcttagaaagacttataaatctccatcaggctgaatatatattagattgttttagatcatgacttttttgatatatagagttagatgaggcttaaaagccgcaatacatagtattgcggcttttaaggttgtatttttttggaattgcagcttccagtttggtctaatcgtactgtataataggcatcagatttattacatttaaggaggaaccgaagcaatgacattattcagccaaatggcttacagtcgaccagagcaacctgaaattgaacagcggtttaaaacgctgttgcagcagtttcgtgaagcagacagcgtagaacgtcaaaacgaagtgattcatgcgattaacaagctgcgcagtaatgtggaaacacaattgcaattggtggaagttcggcactccattaatacggaggatgccttttacaaagcggagcaagagtatgctgatgatttcatgccggttattcaggagtatgtaaccgattactaccgggcattggtggattctccattccgaaccgagttggagagtcaatggggcagccagcttttcagtattgccgaggtagcactcaagtcgttccatccagatattattgaggatttacagcaggaaaataagctgacctcggaatatgctcaattgattgcttcagcgaagatcccgttcgagggagaagaacgcacattgtcgcagctcctgccttttgaaatggctaccaaccgggagacgcgcaaacaggcctccgaggctaaatatcaatttatgagtgagcatgaggacgagctggaccggatttatgatgaactggtgaaggtacgcacgcgcatggcacacaagttgggctatgacaacttcgtagcattgggctatgcccgcttgggacgtacagattacaatgccgaaatggtagccaatttccgcgagcaggtgctgaagcacatcgttcctctggcaaccaagctgaaggagcgccagcgcgaacgaatcggagtagatcagcttcgctattatgacgagggtttcaacttcctgtcaggcaatcctacgcctaaaggtgacccggagtggatcattcgtaatggagcacgtatgtatgaggaactttcagcggaaacacatgaatttttcagctttatgatcgaacgtggactgatggatttgatcagcaaaaaaggcaagcaaagcggaggctattgtacatttttgagtgaatatggcacgccgtttattttctccaattttaatggtacatccggtgatatcgacgtattgacgcatgaagcaggtcatgccttccaggtctatgaaagccgacattttgaaattcctgagtaccattggccaactatggaggcggctgagatccactctatgagcatggagtttttcgcatggccttggatgaatctgttcttcgaggaagatacggacaaatatcactttgaacatctatcctcatcgttgctgtttgtgccttacggcgtagccgtggacgaattccagcatgccgtatacgaacatccagactggaccccagccgaacgtaaaagcgcatggcgctccattgaacgtaagtataaaccgcatctggattatgaaggcaacgagtatctggagcaaggcggattttggcacaaacagggtcatatttttcaatccccgttctactatattgactatacactcgcgcaactgtgcgcgttccaattctggaaacgcatgagtatcgaccggacagctgcgtgggaagattatttgaagctatgccgtgccggaggaagtcgatcttttaccggattggttgagttggctggactcatctcgccgttccaagatggctgtatcgcctctgtaatcggagaaatcgaagcatggctgaacagtgtggatgataaaaagctgtaagcataactaaaaagggcatttcgcttacctgtcaaagctaaaaagcttgcagatagcggaatgcccttttgtgtaaatgaaacttcaattaatgtttggtgttaagcggtttgagattggcttcaatagatgcgcggcgcgattccaaaaatggcggtaacgccagcgattcacccagaaactcgagttcttcatccgtatcaaagccgggtccatcggttgccaattcaaacagaatgccgttcggctcacggaaatacaatgaacggaagtaaaagcgatctacaaagcctgagttggaaatttgcagctgcccaatacggtctacccactgtttgagctcttcctcagtttcaacacggaaggctacgtgatgcacactgccgcgtcctggtcgctcttgtggcagatcgttgcgctcttccagatgaacttcggttcctgtaccgccttcacccgtttcatagataaccacatccggttgtccagcaacaggagaaggataggagccctttttgcggaagcccataacctgttcaagaataagaatggtattctccgctttaggaatggtcagatgaaccggcccaagtcctagaatgccgtattcggcagggacagggcttttctcccaaggcgtgccgccgcgcactccgtgatcatgctcatctgaaacgaggaagaagcgttgtccttcaaaatcctcgaatgaaagtgccaggcgtcccgcttgatctgtaatttcaccatgttttacatccagctgctcgaagcgatttttccagtaatccagtgccttgtcatttggtacccgtagggagagagctgaaatgctgttatttcctgtacgagtttgtcccgcatgtggaatttcaaagaaagtgacttctgtacccgcagttccacgctcatctccgtaaaaaaggtgatatacactaacatcatcttggttcaccgttttcttgatcaaccgaagtcccattacctgagtataaaaatcaacatttttagccgctgccgctgtaatcgccgaaacgtgatgcaatcctaatagtttcatgtcattatcctccttggtttttatatgattaggtttttctaaacaaaataaacagtcgaaaaaacttttctttatatttattatcttgatattaagatatatgttttttgattgtttgtcaacttgaatttgcactggctccaaagacggacaaaaatagaaattcgaaataatgcaaaagcagatacaataaagcccgatatagcccaatatagatagaacgaattttattataaaaggagtgtactcgatgtatacggataaggatttaacgattaggcctgttactgaagaagacctgccggctctttgggcgttaacttttaaggaaggagcaccggaatggaagcagtgggatgcaccctactatgaacataagccactttcttttgatgattatttaaaagagaaggaaaagcgaatcggacaagatgacttttggatcattgaagtggaaggcaagatcattggatcggtgagctactattgggagcatcagccttctcaatggcttgaaatggggataggtatctttgattcacggtattggagcggtggttatggtacgagggcactccgactatggatcactcatttgtttaatacattgcctctagtaagagtaggctttacaacctggtcaggaaaccatcggatgatgaaggttggggagaagctgggcatgaccctagaagccaggcttcgcaagtgcagatattataatggagagtattatgattcgatccgaatggggcttttacgggaagagtggaactgtgattaaaaataaagtatagaagactcgcaagaaggacgcttttttcaaagaatcccatcttgcgagtcaaagtttcaatgatttggatcgattatttaaaatgtgaaaggttactgaggacaatcggcaaaaatagttagcaattcatccgcatttggtccagtatcaacttgttgggcaacgacttttccatctttaatatatgctaatgttggagtagcttgtaaattgatgtgatctctaagaaattgccgaatgactggtttccagtccccaccatccagattgtaataatagatgggttgtgatatacggacagaaaattcttttaaaatgggagagaattcacgacaatcggagcagctaggtctaccaatataaaagtaaaagccttctcccgagttgaatttgtccatggtttcattcgcattaagtctaggtaaatcttttacatcattctcgtattcttcaacagtcggaatatttttattttgttctatagtcgtaaaattcttatgttctgcagcatagttagtatcattagcaatgaaaaagcttgtcaaacacatacagaatataaaagctagtttgaacggtagaaattttcggttttttatcataagaaacctccaaattaattttttgcctgatactaattttacggacatataatattattttgattatcaccttcttaaaatatttatacggagccttaacagactattgagatcaattgcttccagatagcctgtattcttaagctgtagttaatctatgaataaggttactacagttgatctatgtagaaatattactgtaataatcagcgcatattgtgtcatttttcgtcttgctgaatactctagtaactcgtaaatataaatggtcagcattgaaattttaatacatttttatcggaaatttgctttttatagcatgaaattggttgttttatcacttacacattctatatcaaactaaagtgctaatttatatatagcattctataaatttgataggataggtgaagactatgtttaacaacaaacaagtagtcataattgatactggaatggacatgacgaatcgtagtttaagtaaacatgttatagatggagtgagatttcaattttcaggaaacgaaattatcgaggataatgattttcaggatgaccatgggcatggaacatctgtggcagatacgattatgcaagtttttagtgaggctcaattttacatcataaaaatagcaaatgaagaagggaaaacaagtactagactcttgaagatggcattgaagaaatgccttaatctgaatgttaaatatatatgcataagcatttcagttacttcagaaggatatcatcagcaacttagtgaaattacacaccaattagtggaccaaaataaacttatttttgtatctgtaaaaaatggtagtcagagtagctatccggctactctgccaaccgtcattggtgtaaatggacaaatgttttgttcaattgacccatttttgttttcaaaaaataaagagatccaagccgtatttgatgaagctccaatttttgtctatacacttgccgaacgatttgccttttttaaaggtacctctaaagcgaatgctctttgtgtggggagaagtatgcaactgatctcttctgaggtgaagaactctgacatttataataaagatatcacgttttcagaggttaatgatattcttgaacgtagtgctttggaatatgaggtgacagtacctgaatttaaacctatccttgatgctgacatggatagtaacttagtaaaaaaatttggcaagtctatagaaaaagcgatttatgaaaccactaatcttgaaattgacatccatactttatataaagttccctttatttctaagctaacaggaataacctttaataattttgatgatttttggagtagcttagaaaaagagttgaatcataccttaaacaattatcacaatatacatatattaaatgtatgttctctcgctgcattgttgaaatacttggaggagctaggtatttaatcaaattaagctgtttgaaatctatatttttagtatttaaataaaaatataaaaatgtatttatttagaaaaaagagttgattatagaaaacttgaaatggtatactatatatgtaattagtaagcgctatataatgaataaggttaactttgaacctccataataaacccagcaaagaggggattggaattgtgctgggcataaccggaaatcatattgttccttgcaactgagaattaattcatagatgtgaagttcataagttaacttatacacgatactttacaattaagaataattaatgtatgtagggatgtgatcggatgttaaacattgctctgtgtgatgatacaaatgtagaactggctcgggtggagaggtttacgttagaatatccctttactaaagtagaagtagacacttttggaagtgggcaaaagttgctgcaatatgtagctaagaataaaacggaatacaatatttatctgcttgatattgagatggcggatatggatggcattagtttagccaaaaaagtaagagagtttgacaataaagctgtaattatctttgtgaccaattatgacgaatacatgccagatgtatttaaagtacaaacctttgattacatactgaaacctgtgaataaagaaaccctttttgaggttcttcaaagagctgatcactatttacatagttcacatagttattttgagtttagctatgaacgaaataagctcattataaacgaagatgaaattatgtactttgagaaaagtggaagggctgctcatatttatacagagacaaaagagtataggtgtaatcagacaacttcacaaatacttgctcaacttgatccgatggctttcactcagattcatgcttcgtatatcattaacctgaaatacgttgtgggaataaaatgcgaaaatattatgatgaaacggatcgtaaatggcgaaattcaggaaacttatttggaactaccgatcagtagaaagtataaaaaagattttaaacaaaaaatgatgaattatataaggaagagattctaattggaaagagtcatgtttgattttatactaagttcttttgatattttcattataagtagatttctgaataaagttttatttactaaaaagggactttcgacggagaaaatctggttgtttacgattgcattaataggtctgacagtagtcggtatgtactttttgaaaacaacatttgatgttatgctaaatgttgttccagtgttcactgtactttgtttttacccaaaaaatcatataacaacaaaactgtgttggggtacagttgtaattgcaattgaaatcttatctgtaggagtatgttgcgccatcatgaatgcttgttttccaaatgtactccttacatcagataatgtatcttattattacgaagcgggtgctctcctctcagaaatcagtaaatttttcttttttttatgggtccctttactttttaaaatagatgtttatcaaagagaaactactctgcattatttatacatgtgtttgtttgcagttcctatcataactctttgcttgttgtacagtcattttgatttgattttaagatcaggcaagaatccaaatgagtggttaagtgtaatttctatgattggtgttttatcgatcaatatcatcatgttaattatttatgaacagttaagccgaatgtacggcgaaatgatagagcaggaattattaaatttcaatcttaaagcagaaaatattcactatgataatatggaaaaatcgcaaaaagaaattcggagaatcaggcatgatatgagaaatgaattgttaaccttaaagggattgctgaaagaaaataacatagaggcagcagaggggtttatagaagaaattctcttagatattaaatgtactgaaactcagaaatatacaccgaacaatgtacttaattacgtactcaccgagaaaataaatttggccactgaaaaaaacattacagtgagcattgatagttttcttccagaaaaattttctctaaataataatattatagccgttatatttggtaacttgctggataatgcaatagagggttgtgacaaggtaactgaaggtaagaaaacaatggatataaaaataaaatatcatgaaaagcagctttatatagagatttccaatacgtttaatccgctgtttgtaaatagtaattttataagtaataaaaagaatagaaaaaatcacggttttggattgaaaagtgtcaagcagattgtaaaagaaaactcaggaatcctggatataaggaccgtggaagaccggttttgcgtcaatattattttatgggacttagaataggaaccgaattcgtgaaagggcgtagacgcttatgcagctacgtcctgctcctgcattacaacaatatttgttcatatttactccctagttcactatcatgtgtaattaatataatggtatggttgtactttagatcatctaatagatcaataaagttcttttttacaacaccatctaaatttgaagtgggttcatcaaaaattaatacttctttattagtatagatattccgcagtatcgaaattaattgctgttgccctcctgataaagaaaagtttttaccgattatttgatcttttttactttcttcgataaatttcttggtatccaataattcaatatatgaattcagttgcctcatagggatacctggttgccccaaagttatattgttaaagatcgtatctacatacatgacgggttcctggaagcatatccctattttgttgataatatctttacgtttccattctctcatttccttttcgttcactaagatatcacctgtataattacaattaatcttggtgagtaattttaatagtgtgctttttcctgccccgttgcgtcctgaaaggcaaaaaatatgatttccatgaacagagaacgagacatcggatagcgctttttccaaaccgttatagctataacttacatttttaaattctatgtccattttatttcacctcttcagctcttataatcgactcaattctttcgattgatacttttgcctgcttccaagcggccacatagtttgtaacacttttgatcggacttatgatctgatttgaataataaacaaataccgtcagtactcccatacttgtttggcctttcattactaaaattgtacccatccccaaaagcaatacacttccaatagaggtaatgacagaagggacagtggaagctacgataattgtattgcttctctgtctataagcttcaagtgatttttcctctaaaggcatgtactttcccaaaatatagtcttttatatccattccaatagaatatagaagtgatccaagcgtatgcctaatataagaaatagagtcatcataagcattcatgactgcttttgtcttgtgagtaattcttttattaaagaaaatttgactaatcattgttagaagcatgaccaaaaatacaagtgtaaataatttgcagttgaaaaaaagcaatacaatacaaataacaattagaaaaagtaagtttgatattagcatagggataccgtgggatactaatctttcgatgattccaatgtcgttaataaacagggaaaatagcttatcgctgtttgaagtaatggtctcacctggcaaaacaaaaaacttttctaacaacttttttttcatagcataagagattcttttacctaattcggcaaaaatgaattcacaaagtaaactgcataggtgagatagaataaataagcctgttgctattcctataaacttcacaattaaggagaggtctttggatattaatccagagtcaacaattttacttatgtattggggaattatcatgctaagtattgtatctaaagcttgaaaaactaaaataagtacaataaaaagataaaatttatgaacttctttaaaaatccaattatattttctaagcataaatttccattccacccttctgatacaaatatataaaagaagctacttctcattctactattgaatatctagtaattatatttatggtataaatgacctctttaatgtcgtgaaatacatctatgtatacgttttttacggatttagcgcaacctcagatactctaaagaatccattgttatttaactctaattattatcaatttatggcattaaaacattagattatgacataacagtaaatatcagaacaattcatgatctatttaatagaatggaaaatgaatttgggatgtatgagaggagaaaaaatcatggtgtatgttttaaatccttactcacgtgaactatttcataatcatcaagtcattatcgcgaatacaaaatcaggagcttttttgaaaacctctaaatcttattatcttgtgctgaaggatatggttaataaaggggaaattgagtcattgttagatcctaccaaaagttctcaacgtgctgacgttattcataatttaacaagtctcttttatgaattagtaaatatcaaatgtattctaaccgaagaacaattaacaaatattcatggggaggtcttagatgttgtttatctaggattaacaaatagatgtaatttacactgtaaacattgcagcgcttcagcggatgctcattttaccgatgcactaacaactgaaaaagtgaaagaaatcattgatcagatcgtcgtacttaaaccccaagctatcaatgttacaggtggagagcctatgatgcgattagatatcatggagcttttggcgtacataagacaatcgttcaacggagccgttttgctctctaccaatggcctttttataaccccaaaaaatgtggaacaattgattaggtatgtagataatgtttcccttagtctggacggttatgatgaagaaacttgcgatcaaattagaggcaaaggtgtttttagtagagttataaaaagtataaaactaatgcaaagtaaagggctaaaaaaaatcgcattatcaatggttatcacaaaatatacttttgatggaggtgaagataaattcctggatttgtgtggaaagttaggtgttaaacctattgtaagaatcctaacatccgctggaagggcaggagagaatagtgaagagatttttcccgaaaagccatttgtagatgatctgacctctcaagatgttacctgtcgactttgttcaccaggaaaaagagaaatatttattggaggaaatggaaagatttacccttgtggagggttgatggattctgatgattttgttttaggaaatgtatttgataataatttaattgaattaatggctaaaggcaatcaaaaagcagatcacaataaaatcggatgtgtaagaccatgggaatttgaaccctgtaagaactgcaacgttaatttattttgccatcactgcattagcaacatctactatttgcatcaaaaccaagagttgttcgataccatttgtcaaaaacaaaagaaacaacttcaagaactagtttggaacggctaaatctttatataaggagagtaatgccatgaacttcacatattgggtaactgaagattgtaacttgaaatgtaaatattgttatgttagtaaagtaccaaaaatgatgagtagggaaacggctgcgaaagctattgattttacgcaaaaaaagcttgctgcaaatccttccggtcataaagataaaatacgcatagcattacatgggggagaaccattacttaattatccgatcattcgttatctagtagaagagctaaagcaaaaaattcatggcgaaatttcttttagaatgacaacgaatggcaccatttataatcaagaaatacttgattatgtttctgaaaatatccaattaacagttagtttggatgggaagcaagaaagccacgatatcaacagagtatacagaaatgggaaaggaagtttcaatcgagtgattgaaactcttgactacattaatcatcaatcacattttttccgagtgagaatgactgtgacacctaataatgtttcatattttgctgacaattatattttcctttttgaaaaagggtatccgactgtcagctttgcgctagatgaaagtaatccgaattggaataaagaacttatgaaagtttatcaaaagaatcttaacgaaatattttcatatatggtgaataaggatatcaccaaagcacagtattttttatataatttcaaaaacgcatattttcggccaaaagggacgtgtgatggatgtcatagcagctttcatatttctagtgctgggaatatttatccttgtattcttgcagtaggccacgaagaattttccatgggggatgtattttccgatataattgaacagcgtttatccaatttagatgtaatcaaccaaaaagatcaaggggcttgtacaaagtgtgctatgtataataattgtcgcagcaaaatgtgtaaaattattaataaaatccaaactggaaatcattatgaatcatcacccgtattttgtgcaactcaaaggatacactattcaatagtgaaggagtatgaatatatattaaaaaactttgagcttcttctttctaatcactaatttattatgctatttattcgtagcttcataatcgtattttgggtttagagtcactatatttgactctaaagaaattgtattttctaaggagagtcctgcaaaaactttggtttttagtcacagtatgggttctgagttggataaaaggaatctgtgaatcgaaaaaagtagtccatcctcagatgggagcggtgatattatcccctttgggtagagagtgttaaaagagcacatgtatgatgtgatctcgaactatttttcaaaggggggtgtcatgaccttcaaaggacaaaagtttagaatatacacaccagagttcaaattgaaggtggtacgtatgcattttctctgttttctcattattataattaatttcagggaggttaaggaacgagtacaaactatagaggtgagtaactaagaaatgacctagccagaagtttttgctaggtcatttctttacagggatatttattctgctgttcgcagtcgttctacgatagttttcttgttgctcagagaataaatagcgagaggaagacagatcccaagcacgagcagaacaagtagcacgaggatcagcggccagataataaatctataactcataaaccatatttgggcactcaagggtctcacaatcaagatggaaaataggcttcctaataagatggagcataagctggtgccgagcacatagtacatcccctcataaacaagcattgtttttaattgtttgttggtcatgccgatgctttgtagtatagcaaattcttgatggcgggtcagaatgctagttagaagcgtgtttgcaaaattaataatgccaatcaccccaataataatactgagcgtaccgccgatcatcaaaattgttttttgcatacctgaaagctcggcaattgaggtgaatttggatttataatgcatcgtgggctcctttatttcggtatagttctttaagaagctctccatcgttttttctttactatcggatacattaaaggtataactcatcaccacaggcttcttcacaagcgttttatagatatccgccgggagatataagttagtataagtaggaacggctacaccagaattggttgattttacgccaacatgaccaagcactgtgaattcatggctagtatactcctgggcatttgctgtgcccatatagttatgaagagtaaccttttcacctactttgtatacggatagttccatgtcaggattatcgtaattgtctaatatgatcccttccaaaatatactttcccgaagctagcttgtcataatcaagctcaccatcaattaattttagtcggtgaagggggagatcttcaagcccatacactactgtagataagttgccacgagcgtcaggagtgacgatttccccgtacaacttcatcccctctttgttctctttatgctcgacagtgaataaattgctgccactgtacaatcgtccaccttcttcaaaaccgggttgtgtctgtacggtctgaatatagctttctgtcgttgcattgtcagggcctgtgaaatattcttgaaaataatcagcatgtgcaatcagaaagtcagtatcattgttttttgacacaaagttatccatatccagactatgggataatgtaaaagtagtattcagtagcattagacctagagaaaggctaagcagcactaaagtggtccgcttcttattgcgctctaagttggctcgagccatcagcggcattttagcaccgttagttgattttttcagttttttcttaccctttttggtatctccgtctacgtatcttacagcctcgattggagacacagtcgctgcaaccctaataggcttataaatgctgatcataactgtcacgactgcaaacagagctgagccgataaaaatccatgggctgggggatagggttacctcagcatttgcgtgcctataattgttcataagcagcagagggataagcgatttgccgaccccaaaacccccgagcaagccgatgggaaccccgatcaaggaaagaaataatgcctgtctatgaatgagcctacggagttgactactgcttgtgccgatggtttttagaagaccgtagaaacgaatatcacgcatcaccgagatttggaaaatattatagatgatcaaatagccagtaagcatgatcagtaacagaccaccagctaggacaaagatggtttcagggtccgaactgaaagtgttggaaagatacgcccagttcatagaagtttcaatgaagttcggtgcatttttgtcaagggaataaccactttctgtaatcacttgatcaagttttccctggatgttcgagctgttatcgaacatgatacctgcattgatggctccggtcatatcatgatcctgcttatatgtgtagcgtaattcttcggcatgtgcatccacataagctttagaagcataaatttgacctctgtctaacacgacggcggggtcactcttccaccagccggagaggataaattcacgctgtaccattttgccgtgaacctcaagcttcaaggacaatggggcgccctctttcaggggaatacccaggaactgtaaggtgctagagtccgcgataacctcattttctgccaccggtttgtggcctttttctagctcaatcaatcctagcttcagccctacatcgtcataataccagaactccgttttgcgctttaaaaattgctcgtttgttacctttccacttaacaagcggttatatgctatctccttaataagagggtggtctttgacctgattaaattcctcatcgttgatatatttaagtgaagcatgcgcagttcccccggactgccgcatcgttgcctgctggagactttctatcgcgccaatccccatagtaaacagagatgtaaataacaaagtggttaaggaaatagcgataatcgcaataatattgcgggttttattcgctttaaaacttttatctgataaattacgaaccgccttactgttttttactttgatcatctagtcgcaccacctactattttaccgtcctcaatgcggatgatgcgatctgccatctgcgcgatttcttcattatgagtaatcatcaccatcgtttgggcgaactgttggctggataccttgatcaaccctatgacatccagactggtcttactgtccaggttgccagtaggttcgtcggccaaaataatggctggtttcgccgccagtgctctcgcaatggctacccgttgctgctgtcctcccgaaagattacccggtagattatttaatttgttctcaagccccagtgtatttgtaatttgggtcagataggctttatctggttgtttcccatccagttcaatggggagcacgatattctcatagacatttaatactggaactagattataattttgaaacacgaagccaatctttcttcggcggaaaatggtcaattcttcattttttagagaatagatatccttgccgtcaacggttacgtttccgcttgtaggccgatccagcccaccaagcatatgcagaagggtggacttcccgctaccggatgtaccaacgatagcgacaaattcaccgctttccacctccagattcacaccatctaaggcatgaacagcggtatccccgttaccgtaagtttttcttagccctctagtttctaatatcttcatttttttgctttcctcccaataaaaatatctgcatcgtaattgcttacaacacaaattttattataatacctctttctttctacaatctttctgaaatctaacagaattgaaagattatttgagtgagagtagaaagatcagattgtaatgggtgttgggaaatgtaggagggacagactctgtctgaaatatttgttatatcaaaagatatttacatttgcaggatatgaagggatgttaatggtattgatattataaaagcaaaaagagatgagaggatcacagagaaaattgaaactttgacagtccagctctccacatttcttattccagcaaaatttaatgagtatacgattaaaattaagatagagttcatcgatttacaggtcgacatcaattaaaaggatggatgcacaaacaccagcaacacggtgaattcaggctaatggttcagcggatattaatcaggagagctatgtgcagaagctgaaacgggcaagcgacatgctaacaagtgtttggaaatctggatacaggagaaatatgtaacctaattaatgaaataagaattacattggataagatctgaatcagctattaaacagtaatcactctaattgctttacctccaaaatcccgaaacattctcgacggatgttcttacctggaacgacactgaggtgtcatcaaccggcaagtaatatctcgaatctaatagatgaatccggttttggagacggagtagagcgttatcacgaggccaaatgacgattgttttctgtttctgaagttgttcgggcgatttggataacttgaagggggatctcggtctaatccgctaattatgccaaatagcatactgatttttacaatagaaaattcagaggtatttttaatgatattttaatagtgaaaggaggtgaaattaacatggaaaaaatcgagattttagaaaatgtagattttgatatggaagtacaatgtaatcctaatcattgcaattatgattgtctcgaacccaatggacattgtagctctaataccttgcaaggcacttaaagaatgattttgtctagtgccctcgtcttttaagacgagggcactttcttttgcatcatatctgggagagtagagtagtgctctatttttctaggcgattccggtaggacaccctctttcatgttctgtgctgctgccgtcatgagggcttgttccctatcgtttggagtctgcacaattgtcaatagcgaaattcatggagctaattggtatccgtgaagcttcactcaattgtagatggtaaagtagtcgataaggatgattatcagcaaagaaaaaattagcgctatgatcgttctcgtatccataccaggtctgccgaagataggaacagtttacattgtgatacatgataattcgacgagtcttcctcaaggggataagcgttctctccgtaatactttgcagtgcgtctacataggctctggaagtgaatgttttctcttgattttacatactactaagttcccggccaaattataacgaggttggagcgggacgtccaaggcagtataaagttccaactgacgtttcttgatctcgccaaactgtaggtcgtgtccggggcgctggtaacattcaatcacgtccaattcatccagcagcccctgcatggtataacgctgaaataatttcttttcctgcatgactttcttgagatcggatagaaagatcagggcaacaaattcaacaaacaatttcccatctagactccgctcagaggatacctccatgcgacggaattcaagcgatctttcaaattgccaaatgctttttcaatgacatccttgttacggtacaacgccaacgtttggcatacgttttctcatgtgccgggtcgcgtttcccgctttccagttcggttttcagcctggtgagcagacggtttaatttgtaggcgtcctccgtttctttttctttgttgaaatacaggtgcaggtacgctctgcgctcgcttttcagcacatcacctttgtaggaccggtcgctcctggctatatactgccaggcgagcggagtcgtgtaggcgtacaaatgatagtcggcctgaaagttctcccaatggcgaaggtgcgctctggcactttccagttcctgttgcacgtattacagcgtggcgttgataccaatcagaaatttcagatgatgccggtacagcgcgttgatgttcgcttcactgtagaagcctcggtccatgaccagcttgatctttttgtatgcgaaaaagtccatgtccgccatgagcttttgaatcgttgacatgtccgaaatatttccggacagcttgcggtaacgcagaatggagtatattggtgataatatcttgagataagcgcgtacctataggcttttcaggcaaacctcgttataatttcgcgggaatgcaagatactagatgtagttttggatctctttcccgaaacagataggataaaatcaggcctcacaagttcctcgtctatatttgatcaacgggtgatttttacgtggttaaaattctcatcattgatttgtttgagtgcggcatgattttcgtcaccgttccgccgtatgttcgttttccgcatattttctacagcagtaagacctatagtgacagtgctgtaaataataattcagccaaggcagttagaggctatgggctttaccaattttaaagcttttatgttccagattatagtagttttttttcgataggagcacaatatttttcgcagacattcaaggcaggtattagattatgattttagaaaacgaagccgatttttcgcctgtggaagatggtcaatctttgtcttacagtggaatttatccttgccatcaatcgtatgcctccgtttatcgaacggttaagtctgtattgtggcgccctgcaatacagactatccatatcaatccttctacagcctttctgaaatctgaaagtatggaaagaactatttgcccatgggaagaaaaagggagaaggtagagccactgccgcagcgtgactgtaccttgatgtagccaccttgagcagcgatgatttctctagccaaaagtccgatcccgacaccctcctgtgagcttacggtagggtagcgagagaaacgcataaagattttactcagttcgtcttctgcaatccctataccactgtcggtaatatcgatccggcaaaacaaatcatatgcgatcacttttatggtgatgctcccgccggtttctgtatatttcacagcattgtccataatattgtagacggcttcagccgtccatttcagatcaaagcaagtatgaatcgttgtattctccataacaatagagatgcctttggtatctgccttcggcatcatttgctcccgtgcaacgtgcaggagctcttgaacagattcctgccttggcgataccgtgataatacccacttctagtcgcgatgttttcaccaacgtattggtcaggaaattaagtttttctgctcgtgaagccaaagcttttatacaagaagagctatcctcaggtaaatcatgctcactaagcagttgtgcgtagaggaggatgtggcaacaggtgtcttcgtttggtgggagatgtcagaaatgagcttgtttatcttattcttctctaccagcagatttgtggaggagacagagcaaatagaaagaaattgcgcaagcctggtttctacagaggataacacggattcgtcaaaagcatgctccgcaaatttcccattaattgcatcatcaatcattatctcgatggctgtcatggttttatgtgtgttttttacgatatagaagaacaacagccgctgcagcaaaggtagcagcaattcctatatacacatagttaagtattgtaatattacttcaccgcccatgtatatccccgcccataaactgttttaatgtattcgggagaggagggggaatcctccaatttgttccgcagcctttttactgtaaccgccaaggcatttttacctacatactcagctccatcagtcgtccatgtgctgtcaatcaagcgatcgcgagatacagtgttgccttgattatcgattaggatgcgcaacaatttttgctcagttttacttagttcaatgggtgtgccattcttaataaattccatcctctcaaatgaaaaggaaaaatattgtcaagttgaaagggatctgtaagcggatacctagctctttttagctgaacatctactttggccctcagcatcatcaaactaaaaggtttagtgatatagtcgtcagcacccagctcaaaaccagtgacgacatctgtttccatatcattcgcagtcagaacgatgacgggtatagttgttttttttcggatatgggttaaaaggtcgagtccacttccatccggcaaatttacatcaagaatcattaggtcaaaggcagtgacgttcaattattcttttgcagtagctatgtcatatgcttgcgtaaataggttgttaggttctttaagagcaagaacaataccgttactcaaggcgatatcgtcctcgacgattagtatgtaattcatcattctcctccttgtattttggttaaccaagtcattgaatcccgagctctaacaacggctcacaataaaaatgtaaatgagagccggccaattttctaattctattttacaggatatcgctcttatttgctcatggttcagggagcaggtattaatgcactgttgaataaccaagaaatgacccagccagaagttttgaccaggtcattttctttacagggggatttattcttctgttcgcagtcgttctacgatagttttcctgtcgctcagagaataaatagcgagaggaagacatatcccaagagcgagcagaacaggcagcacgaggatcagcggccagataataaatttataactcataaaccatatttgagtactcaagggtctcgcaatcaggacggaaaataggcttcctaataagatggagcatatgctggtgccgagcacatagtacatcccctcataaacaagcattgtttttaattgtttgttggtcatgccgatactttgtagtatagcaaattcttgatggcgggtcagaatactagttagaagcgcgtttgcaaaattaataatgccaatcaccccaataataatactgagcgtaccgccgatcatcaaaattgttttttgcatacctgaaagctcggcaattgaggtgaatttggatttataatgcatcgtgggctcctttatttcggtatagttctttaagaagctctccatcgttttttctttactatcggatacattaaaggcataactcatcaccacaggcttcttcacaagcgttttgtagatatccgccgggagatagaagtcagtataactagcaacggctacaccagaattggatgattttacgccaacatgaccaagcactgtgaattcatggctagtatactcctgggcatttgctgtgtccatatagttatgaagagtaaccttttcacctactttgtatacggatagttccatttcaggatgatcgtaattgtctaacctgattccttccaaaatatactttcctgaagctagcttgccataatcaagctcaccatcaattaattgtagtcggtgaagggggagatcttcaagcccatacactggtgcagataagttgccgcgagcgtcaggagtgacgatttccccgtacagcttcttcccctctttgttctctttatactcgacagtgaataaattgccgccactgtacaatcgtccaccttcttcaaaaccgggttgtgcctggacggcctgaatatagctttctgtcgttgcattgtcagggcccgtgaaatgttcttgaaaataatcagcatgtgcaatcagaaagtcagtgtcatgacttttagacacatacttattcatatccagactttgggataatgtaaaagtagtattcagtagcactagacctagagaaaggctaagcagcaccaaaatagtccgcttcttattgcggcctaagttggttcgagccatcagcggcattttagcaccgttagtagatttttttagttttttcttatcctttttggtagttccgtctacgtatcttactgcctcgatcggagacacagtcgccgcaattctactaggcttatatgcactgatcataactgtcatgactgcaaacaaagcggagccgataaaaatccatgggctgggggatatagttacctcagcatttgcgtgcatagaagtgttcataagcagcagagggataagcgatctgccgactaaaaaacctgcgagcaagccgataggaaccccgatcaaggaaagaaataatgcctgtctgcggataattctgctgatttgcctgctggttgtgccaatggtttttagaagaccgtagaaacgaatatcacgcatcaccgagatttggaaaatattatagatgatcaagtagccagtaagcatgatcagtaacagaccagtggctagggggaagacggcttcagggttcgaactgaaagtgttggaaagatacgcccagttcacagaacttgcaatgtagttcggtgcatttttgtcaagggaataaccgctttctgtaatcactttattaagattttcccgcatattcgagctgttaccgaacatgatagttgcattgatggttccggtcatatcatgatcctgcttatatgtgtagcgtaattcttcggcatgtgcatccacataagctttagaagcataaatttgacctctgtctatcatggcggcggggtcactcttccaccagccggagaggataaattcacgctgtaccattttgccgtgaacctcaagcttcaaggacaatgtggcgccctctttcaggggagtacccagtaactgtagggtcttcgagtccgcgataacctcattttccgccactggcttgtggcctttttctagctcaatcaatcctagcttcagccctacatcgtcatgataccagaactccgcatggcgctttaaaaattgctcgttcgtcaccttttcacttaacacgcggctatacgctatctctttaataagagggtggtctttgatgtgattaaattcctcatcgttgatatatttgagataaccctgccctgccccaccagcctgtcgcatcgttgcctgttggaagctatccatcgtgccaagccccatagtaaatagagatgtaaataacaaagtggttaaggaaatagcgataatcgcaataatattgcggattttattggctttaaaacttttatctgataaattacgaaccgccttactgttttttattttgatcatcgggtcgcaccacctactattttaccgtcctcaatgcggatgatgcggtctgccatttgcgcaatttcctcgttatgagtaatcattaccatcgtttggcgaaactgctggctggatactttgatcagtcccatcacatccagactcgttttactgtccagatttccggtgggttcatctgccaagataatggcgggcttggctgccagtgctctggcaatagctacacgttgctgttgtccaccagaaagattgtttggcagattattcattttgtggtcaaggcccaaggtatgtactattttatctatgtgggctttgtctggttctttaccgtccagttcaataggaagcacaatattttcgtagacattcaagacaggtaccaggttgtaattttgaaacacgaagccaatctttcgtctgcgaaaaatggtcaattcttcgtctttcagtgaagaaatatctttgccgtcaatcgtaacgtttccgctggttggacgatcaagtccacccagcatatggagaagggtagatttgccgctcccggacgtaccaacaatagcgacaaattctccactttccacctccagattcacgccgtctaaggcatgaacagcagtatctccgttcccgtaatgcttccttaatgcctgagttttcaatagagccatattacgttctcctccacaaaaaaatgtctggatcgtagtcatctacagtacagacattaacacactgatctttctacaatctttctgaaatctaacggtattgaaagaattaagtatccatagaaagaaaaatagagaaggtagaaccacggccgtagcgtgattgtaccttgatgtaacccccctctgcagcgatgatttctctagctaaaaacagtccaatacctacaccctcctgcgagttaacagtaggggagcgataaaagcgggtaaagattttaccttgttcttcttctgcaatgcctatgccgctatcggtaatatcaattcgacaaaacaattcgtatgccatcacttttatatccatgtttccgcctgtctctgtatattttatagcgttatccataatgttatagacagcttcactggtccactttaggtcaaaataagcatgaataacggtgtcctccctaataactgaaatccctttggcatctgcttttggcgttatttgctccagtgcagcatcaaggagcttatgaacagattctcgtcttggcgctaccgtgataatccccgtttcaagccgcgatgttttcaacaatgcctggattaggaagttaagcttttcggcctgtgttgatagagctttcacacaagtggaggtatcctgtgatagttcgtattcgctaagtagttgggaataaagcaggatgttggccaatggtgttttcgtttggtgtgaaatatcggaaatcagctcatttattttattcttttcagcaagcagatttttggaggaaacggaacaaatggaaagaaatctcacaaaattagcttctattgaagaaagaacggattcatcaaagacatcctctgagaagctgccatttatcgcggcatccagcatgttctcaatggttttcattgttttatggatgctcttgcgataaagcataatagcacttacagcggtgcatacagcaacaacggtaattccaatacatatatataggagtgttgtcatttcaacgcccatgtgtagcccagcccataaaccgttttaatatattgtggggaagaaggataatcctcgagcttgtcacgtagcctttttatcgtaactgacaaggcattttcacctacatattcagccccgtcagtccagatgctgtctatcaaatgatcacgcgaaacggtatttcctcgattgttgattaggatgcgcaacaatttttgctccgttttacttagttcaatgggcgtaccatttttaataaattccattctctcgaatgaaaaggaaaaattgtcgagatgaatggagtctgcaagcgagtatctggatttctttagctgaacaccaactcttgctctcagtaccataagactgaaaggtttggtgatatagtcgtcagcacccagctcaaaaccagtgacgacatctgtttccatatcattcgcagtcagaacaatgactggtaaagcttttgttttacgtatatgggttaaaaggtcgagtccacttccatccggcaaatttacatcaagaatcactaggtcaaaggcagtaacattcaattgttcttttgcagtagctatgtcatatgtttgtgtaaatacgttgttaggttctttaagagcaagaacaataccgttactcaaggcgatatcgtcctcgacgattagtatgtgattcatcattttcctcctgtttttttgattcatcaagttaatgaatcccgaattccaagaactgcttacagtaaaaatagaaaaagagggccccaaaatcttccgcctctattttacaggatattgctcttatttgctcatttgctctttagactattcaggttttgctaacacttttttgacatggtttattcattgcaaaaaatttgacagatacaatatcactgctataatttatgctagttgatttttgataatgattatcattattggaggggaggacagggccgaagcttggtacaggttattggacaggctcccttagttagagatgaaattgcgttatttaatactggtttttctgatactggctttcgcctcggtgtttattggtgttcatgatgtaactccacttgatttgttccacttaaccaacgatcaggcgcaggtactcctgattagcagattcccacgtttgatcagtatcattatcgcaggggcgagtatgagtatctgtggattgatcatgcagcagcttacccgaaaccgatttgtatcgcccaccaccgcagggacgatggatgcggcacgattgggtgtgctgatggctattatggtgtttggagcggcgggattctggacgaagatgctgacggctttcggatttgctctagggggaacactgattttcatgaaaatactggataaaatccgtttcaaggacccggtatttatcccgcttgtcggtttgatgtttggaggcattttaaattcggtaacgaccttttttgcttacaaatacaatctgatccagggcatttcttcgtggatgcagggcgatttttctctaatcatgagtggtcgctacgagatgctatatcttagtgttcctttggttgcgttggcgtacatatatgcgaatcgttttacaattgcaggcatgggtgaggattttgcggccaacttgggtgtacattacaagcgcaccgtcaatgtcggtttggtgatcgtggctttggtttcctctgttgtcatcttaacggtcgggacgattccctttttggggctggttgtacccaatctggtcagcatgtatatgggggataatctgaaaaaaagcctggcccatacagcgatcctgggcgccgtttttgtgctgttttgcgacattttggggcgggtgatcatttatccgtatgaaatttctgtagggcttacggttggtgtgatcgggagcgcgttgttcttgtatttgctgctgaggagaagggcttatgaatcctaaattaaaaatcggaatattagccgctgccgcgcttgtgttgattgctgctttcgtgtttatagatcttccgcatacctggcattacgcgctgccacgacgattaaaaaagatcgcagccttcattctgacaggtggctccattgcctttgcaaccgttattttccagacggttacgaataataagattttgactccgggtattatcggactggattcactgtatatgctgattcagacgacgattatttttgcatttggttccgttcctttcatttcgaccagcaaagaattgaactttttgctgtcagtggggctgatggtgctgttcgcaggactgctatacaaattaattttccgcaaagatggacgcgggatttatgtacttttgctgattggtctggtgttcggcacactattcaacagtttatctacctttatggaggtactgattgatccgaacgaatttgcgaaaattcaggacaagagctttgccagctttagtaatgtaaacaccgaactgttatggctttctgtattcattcttgtgctcgtattcgcttatgcgtggagattcatcaagtatctggacgtgctgtcgctgggacgggagcatgcgattaacctgggtcttccttatggttttatcattaaaaggctgctggtaatcgtagcgattctcatttccatttctacagcgcttgtcgggccgattacatttctcggattaattgtggccaatgtggcttatcaggtgataaaaacctatcagcatcgttatattattccggcctctatttgtgtaagtgtcattgcgttggcaggatgccaactgctggcagaaagagtattcgacttatcgacaacggtcagtgtcattattaactttatcgggggggtgtacttcctgtatcttttgctgcgggagaataagtcatggtagaagtcagaaacgtatccaaacgctacgggaataaaaatgtggtggatcaggtatccgtcactgtacctaaaggcaccattacctcctttattggccctaacggcgctggaaaaagcactttgttgtcgatgatcagtcgcctgactgacagtgatgagggagaaatcctcatagacggacagaccgtgagcctgacgaaaagtgaggagctagcccggaagatatctattttaaaacagaccaatgatgtcaatattcgcttaaccgtgaaggagctggtcagcttcggccgttttccgtattccaaaggcagattgaacagcgaggatcgcaaaatggtggagcagtctatggcctacatgggactggaggatatgaaagataagcatattgatttgcttagtgggggacagcgacagcgggcttttattgccatgattctggctcaggacaccgaatacatcctgctggatgagccgctgaacaatctggatatgaagcattcggttcagattatgaaaacgttgcgcggtttggtggatgatctcggcaaaacgattctggtcgtgttgcacgacattaattttgcctcctgctattcagactatattgtagggatgaaggatggcaggttgctaaaacaaggaacggctgacgagatgattgatagtcaggtattaaagaatttgtacgatatggatattccgattcaacagatcggtgaccataaaatttgcgtttatttcacttagggggaatgttaaatgaagaaaaatatgatgtttttaacgctaatgcttgcattggtactgattgtgtcggcctgtggcacaacagctccggcaacaccggaagcgactggaaacggctcttctactgcaacaacggaatccaaaaccatctcggtcaaacacgcactggatgaaaacccggtacaagtcaaagttaatcccaaaaatgtcgttgtctttgatttcggttcattggatacgctggataagctgggcgttgacgttgcggcagtagcgcagcaggatcttcctacgtatttgagcaaatttaaagattccaaatatgcaagtgcaggcacgctgtttgaaccggactacgagaaaatcagtgatctgtctcctgagctgatcatcatcggtggcagacaagctgatgcatataaagagttgagtaaaattgcaccgaccatttcgatggctgtagacaccaaggattatatcaattcctttaagaaaaacgttgaaacactaggccaaatcttcgacaaagaggatgctgccaagcaggaactggctgcgattgatagctccatcaaagccgtacatgacaaggctgtagcgagcaaagctaaaggactgatcgtgctgacgaatgaaggaagcctgagcgcatatggctcacaatctcgcttcggtatcattcatgatgcttttggcgtaactcctgtagatcctggcattaaagtatccacgcatggacaaaaggtttcttttgaatatgtacagcaaaaaaatccagattatatttttgtcgttgaccgtggagctgtggtggtcgaagaaggcaaggaacaggttacaggcaaacaaaccatggagaatgaactggtgaagaaaaccaatgcatttaaaaacggtcatattgtataccttgatcctaactactggtacctgtcaggtaatggtctggaatccgtatctgaaatgatcaaggaaatggatgctgcactgtaatgaatacattcacatcatggaggattgtgtaggatgaaaggtcatatagatgaaattccattagatgggtaccttgtacacatctatacacctcccgtctccgtgaatcataatgagctgtatcctgtgctgtatgtgcaggatggcagctctttatttctaagcgggttggatgagctggaaagaggtttttctaggggagagctgccccgtgtggtgctggtagggattcagcccgtaaatcgactggatgattatacgccttggaaggcagcggctttagtagaaggaagacctgcttttggcggtggcggagatgcctatctggcgtttgtggttacaaaagtaatgtcgtatgtcgaggggagatatccggtacaaaccggaccggagcatacgggcatcatcggcgcctcgttgggcggattaatttccatgtatgccgtgttcaagtataaggatgtattcggacgcatcggttcgatctcaggctcgtattggtatccgggtatgatcgattatatgcaatctgcatcatgtgcaactgtgatggatgggacacatcgcttgtatatatctgtcgggacccgtgaaggtgaagggaagacgaatgtacaaaaagatatggttccactgactctccaggcacacgaggtgctgctggcacagggacttgacgcaaaagatgtgcttcttgagctggatcagaatgcggtgcatcgtgtggattgttttcagcgtcaatttcctaaggccgtccaatggctgttcggatagcatgaatggaatacggatctcatacaacagcctcaaaggattggagagcgtggagtctctatgtctttggggttgttttttttgtatgtttttttcgtataatagagaaatattaaaatttaaagttatacgttgttggaagtgaggggagcataaatgaaaaaaaaccgcctgggatcatcggatttgctggtaggtgagattggtttgggatgtatgtcggtcggtacggaggagcagcaaggtgtttacttgattcatgaagcgctagacaggggcgtaaacctgttggatacggcggatttgtaccagcacggacgcaatgaagaaattgtgggtgcagcgatccgtggacgacgacaggatgtcatcctggcgaccaaggtcggcaatcggcgtctaccggggcaggagagctggggatgggacccatccatgaaatatattctgtctgctgttaaagagagcctgcgtcgccttggaacggactacatcgacctgtatcagctgcacggagggacgattgacgatccgatggacgaaaccatagaggcttttgagcaactccagcgggagggcgttattcgttactatggtatttcctccattcgccctcatgtcatccgtgaatatgtcgaacgttcgaatatcgttagtgttatgaatcagtatagtttactggatcggcgtgcagaggaagaggtactgtctttgcttcaggagcggggaattagcgtgattgcacgtgggccagtggccagtggtgtattggctgacgaaggggaagggaagatagctaagggatatctggactacaatgaagcagagctgctggatgtgcgtaagcaattaaaggcatttgcagggtcggaccgtagtatgggtcagacagcgattcgttatagcctttcacatccgactgtcgctgctgtgatcccgggtgcaagctctttgggacaattggagcataatatttctgctgcggatattgcaccgctaactcaacaagagcggcagacgctacagcaaatcagccgagccaatcgttatgatgcgcaatatcgctgacaagggcaatgatggtacaagtgttaaacttgtacccatcccagttgcaatttataaaagaaccattacaatataagaataagcttcggtttattattcatatgtgaatatggagacgttataaatacactctaggagggaccaacgaatggaacgcatcgaatctcagcagcaatatcaggatttaattaacggtgacggtctgaccgtcgtgaaatttgatacaacctggtgtccggattgcaagacactggataaatttatggacggcattattgaggaaaacgcggataagcgtttctttgcgcttgatgcagagaaatttcagccaattgccgaagaaaatcaagtgcgcggcattccgagtctgctcgtgttccgtaatggcgaaaaaattgctcatttgcacagtaaatacgctaaaacgccagctcaaatttcggaatatttgactacgttagaatccaaacaataatcagaacgcatgatagggatagttcaatacgatctatcctttctgcaaaatagtaaaagggatatccaaggctgatcgttcagacgctatggatatccctttttagttattggttattggttattggcaccaaacaatggcttataaaataatgaaaaagaacacagccgccagcacgaaacggtaaatggcgaacgtagtcagactcaagcgtttgagcagaccgaggaatgttttgatcgccagcatcccgacgataaaggcggtaataaagccggccgcgaacactggaaaatcactcatagacagatgatccatacttttgatcatatcaatacccgatgcacccagcatgatcggaacagatacgaggaatgtaaattccgcggctgccgtatggcttacacgtgcgaataggcccccagacatggttgagcctgaacgggagaagcctggccacagagctaggacttggaacacaccgatggtaaatgcttgtttgtacgtgatctcatccagcgtatgtgatctaataggcggatggaatttttcagctgcgatcatgagcaggcccccgatcaccaaactgtataaaaccgtttcaggaccaaacaggtattgcttaattacatcacggaacagtacgccaatcaggcccgcagggatcatggctaaaataatatgtaacaggtttagacgtggctgacttgagattttgcgtctgaaatcaaacagactcaggaatctgcgccagtataatacgacgaccgccagcacagcacctaattgcacgataacctcaaacgttttgaccgtatcattctctgtgtttaatcctagaagattagccgtgaggatcatgtgacccgtcgaagagaccggcaaaaactctgtcagtccttcaataattcccataataatagaagataaaatatccactttactagctcctccttacacgcgtgcagggcaaacgacctaagtcgtctgccctgggaatatgtcatttcagtaggagtgaacgcaagtgtcacaagtgcaaagataaacgctcaggtcacacggttcactcccgggaagaagtgtccgattctgcttccaattcagatgcgggggatgtgtggtgtaaaataatctccacccgacgaatacgatttttacccatttcacgaatgataaatttcacatcatcttctatgaattccttgccctgtctaggttccggaacccggctatacacccaccctccgacagtatccacgtcttcattgtccaatgtcaagccagtcagatcactcagatcggaaagcatcactttaccatccatcaaataactgttctccgtcagtttctcgatttccttccgttcatccttatcaaattcgtcccgaatttcgccaacaatctcctccaaaatgtcctcaatggtaatgaggccggaggttccaccgtattcatcgaccaagagagcaatatgaacctgctccttctgcatacgtttcagcagcgtgttgacggggataacttctggaacggtcaagatcggttgaatcaggctgtcgaaaacaagctcgggattgcgatcatactcaaggaatagctgtttggtattaatcataccaatgatctgatccttgctatctgtcgccaccggaaaacgggtatactgctcttcgtgaatagtcagcatgttttcttgtagcgagcgattcgtaaacaagcataccatatctgtacgtggcaccataatttctttggcaacggtctcgtcaaaagcaaagatacgatttacgtagccatattcggtgttattgatcttaccactttccacgctttcggacaaaatgatctgaatttcttcctgagagtgtgcttcttcatgctcactagccggctgaagaccaaacagacgaaccagacgattggccgagccgttaaggagccaaataaacggatacataatccggttaaaccacacgataactggagaggttaacagactgacagcttccgccttgcggattgccaatgttttgggagccaattcaccgatcaccacgtgcaggtaagttacaatgacgaatgaaataataaaggccaggatatgtgaaaaatccccattgatgttgagctgttgaaagagaggctccagcaatttgactacggtcggttcaccgagccagccgagtcccaacgctgtaatcgtaataccaagctgacaggcggacaggtagccgtctagattattgacgactttttgtagcgccagtgcgtttttacggttctccacgaccagctgatcgacccggctggaacggattttaataatcgcaaactcggtagccacgaagaaagcactaaataaaatcaacaccgcaaacaaaaatagactgacacctatacccatataattttcactcatccctttttcgttcaattttttaaggaactccattttaagttcacttgaacttattttaagaacttaaaagaaaatatacaaggttcatatggaatcgtagcaggtcacctacctccaatttacacggaaaataaggcataatagaacccgcacggctcattgcttcgctttacaagcctagtttgagggcgtatgatgagttcatatgaacttgaaatgtaagaaagggaggaaagcagatggagtcttttacccttactcgtcgtgatatggcccatttgctgctggccatggaaggtcgccgcgaattgcagcctttggccgttcttcaggacgcctggaggcgcactcatagccatcttgcccgctccgggagcacgatgccgacatttttatacaccgacgtgacacctgtgctagataaaattatcaagggtaagcacagcgcagccttttcgctgcaggagattgtttccctgggtcaactagtcgaatacagccatgtctcactggcctctatgcaaaattgggtcaaacgcgacttcaaggaatttctcggcgctccgaagatcggcaaaaaatactcggtcaaccaggcagctatattgctcattgtagaagatttaaaatcatgtcttgattttgaatccattcgtcagctatttcatatcctgttccaacaacccgaagatgatacggacgatctgattcagccggtcgatttgtacgccgcctattcaactttgtttgaggagctggatgcgaacggagaccaactgcttgatgtggcagcagcaggctttgcaaaagacaacggaatttccgttacaggacagcagcgtcaggaaggtgccacagaggaactgctggttcaggcggctgatcaatataccagtcgtttacagcatttgacccctaaccagtgtgaagcagtgcgtaatactttgctggtggcagcagtagcggtgcaaaatagttattttttgtccatggcacgtcggtatgtgaatgcgacgttgtttctggacttccaagggtaaatcaggattggcactagaagccaatcctattttttttctctctttagaggattgtctacccttttggagactgaaaaagtatacaaaagaggtatatacactaaaacgctgtcaaagatacaataaacatatataatccagcaattggaaaaactttgaatatctcttccaaagcatctggatacacacacaggaggtaatggcatgtccgatgtctccatcatcatttgtacccgcaaccggatcgaagacctgacacgctgtatacaatctattgcagtacagcagcaattggagcatacggctgtagaactgctaattgttgatgacggcgatatttccgaccaacagatcgagcagtaccgtcacatggtatccggattgcctcaaagcgttttgaaatattataaaaaaagtcgtcccggcgtttggttatcccgctatgaggccttgtcccttgtgcggtatgatattgtgctgtattttgacgatgatgcagaactggacgataaactctatatccggcgcctgctcgatacctatgatcaggatgaaacgattgtgggtgttggagggattgcaaagggattacattcgagccgggcaggaaagctgctgggcgttttgacatttcagatgtctccatccctcggcaagctctcgcctagtagtctggcaggttctttgctgcgttggggcgaagcaacggaggttttcgatacagaatttttccatggctgcaatatgtcatttcggagggatgcacttcgggacatgaagccgtatccgtggatgaccagttatgccgtggctgacgatttgtacatgtgccagttagcgagccgttacggcaaattggttatcaatcctgacttaaccatcattcatcatgaatctccaagctcgcgcgataaggcggggaaagtagccaaggcaacagcgattaaccactattattttcttgccttgaaaaaggctggagtgattcagtatggagcccttttatggaccttatcctacttgatgctcaaagaaacgctgcgtcgcaattttaatgccgcagatggatacaagcagggggtgttgttcattctgaacccgcgcaagcaaaaatataacgaatatttaggcccggcggttcagtaatccgttttatacacattgacaggataaagggggagtatgatgttaagcttgtccattgctctgtgcacccgaaatcgggttgatgatctgacccgatgcatcaattcaattgccattgggggagcaccggaggcatgtgaaaccgagctatggattattgacgacggagaactgccgaagcatgtgctggaacgttatgagcgtcagttgggcagagcgggaattacctatcgatatcatcgcaaggagcagccgggattatggttatctcgtgtaaagacagctgaacttgcgcagggtgacatcattttgttccttgacgatgacgttgagctgccgagcaactacttgaatgagttgatgcgtacctatgaggcttacccgcaggccgctggtgtcggcggtattgcacagggaatgagtaacagtttcatgggaacgattcgatgcttgctgtcattccagcagtctttgtccaaaggaaggctgtccctcagcggtcagtccggctcgatgtacaactggcataaggccaagaagacgtttaggacccagtttttccatggctgtaatatgtcatttcgccgtgaggcgattcgtagtctggagcctgtaccttggttgcaaagctacagcgtaggcgaggacttattactttcgcgcatcgcaatgaaaagcggtccgttatacattaatccggcgcttacgctgcttcatcacgaatcgccgtcgtcgcgtgacaatatggagcaggttacttatatgcgggtgatgaatcatattcatttgctgcgtgacgagggatctggaccgattggttatgcagcactatattggacgacgttgtatcagattttgagagaaaagcccaagaaaaatcatactgccattcaaggctatagaagagcgctgaaagcgatcttttcaagcccgaaggagcctgttggcgggggacagttgcctgaacgtaattccaaaaaaacggtaggctgatggaggtgcgtcataagacgcgattgagcatagagacgagaggcttaataaggaacaggagttggacgtaacatgagcacatggacagcagcaaggaaagtattcacgggtgacagtctcgctaaaacgatcatgcgcacgagctttaacaatttttttgtgctaatcgtcacgaccctgacttccatcctgaccgcacgtatgctcggagtagaggggaaaggagaactggcggcagttctgttctggcctacgctgatcggcagtgtgttgagcttcggattaccaacgtcgttaatttacaacatcaagaagaaaacaggcacgacggaagaactgctggcgttgtcgctctggattcagttgcctgccagcttgttggcgggagcggtggcctggatatgcatgccgctgtggctgaatggttatggtgcggacatcatccaactgtcccagctttattgtgcggcagccataccactggcagtgcttacagcgctgaccacagcattgtcgcaaggactggatcggtttagcgtatataatggtctgttgttttactacccgttactgaatttcatcggtctggtgacactgtggctgatgggcttgctcaatgtgcagctggctggggcagtgaattttgccgcgagtttccttgcactagtgtgggcgttcctccgtttgcgcaagtatatgaatgtgcgtgctttccgcccatttaccagccgccatgtgcttcgtccttattatagctatggagcgagagtttacgggatggaactgatggggacactgtccacacaaacggacaaaatcgttattgtggcgctgctatcacccaaagcgttcggcctgtactctgtcgtctacgccttgtctcgtgtgttcaatgtggtgcaaaatgccgtcactaacgttacctttccaaaagtgacggggatggagcacagcaagattgtcgaaacggtaggacgtgcttttcgcatctctatggctgcgatgctaatcgtcattgtgcctgctctcttcattggacgatacatgctgggtttgctgtacggtcccgctttcctggaagcatcgctaacgttctacctgctgtcactggaatgtatcattggtggcggctcatggattctggcttcggcctttaacgcgctgggacgtccgggactggtattgttccggcaaattgtagcctatgcgatcaccgtcggtctattttttatttgtacaccgatctttggtctggacggcattgcgattgctttgcttgtaggcgcttgtgtacgattggcgttctcactgttctcattcccgatgtttttcaatgttccgctatcacggatcatttttgataaaagtgatattacatttgtcattcagactatacaaaagaagcgcaggaagggagaactgaaagatgccgaatttgcatcccatggctaaactgaaaaataagctgagcgtcattctcgacgtagtcccccaaggttcgaatatcatttatgtcgattatcccgtctataataacggtggggatgtactcatcatgaaaggcaccgaggcgttcttcaaggataatggcatccgtgtccgtgcccgttatagcgctatggatattcccgatcgacttcaaattccgggtgactggattatcgtgtgccacggcggcggcaacttcggcgatctctattcaaatcaccaaaatttgcgagaacgcatcgttcgcgatttccctaaccaccgaattgtgattatgccgcagacgatccactttcaatctgaacagaaggctaatgaagtcgctgccttgttcaatgctcatccggatctacatatgtttgtgcgggatacacgctcttatcagtgggctaaggacaagctgaaccagtgcagtatcacactatgtcctgatatggcacaccagctctggccattgaagccgactacggaaaccgtgaaggatgtattgtatttcctgcgcacagatattgaaacggtgggtggacaaaagaagttcgatgacgaggcagatgccgctcaccggctggactgggatactttgttcactccgctggaagtgaagggaattgtctatttccagaagttttatcgactggataagaaaattggtggtccgttgcctacgcgtacattctggtacaagtatacagaccatctcatgaacaaagcggttacgctgttcagctcttaccgagaggttcgcacttcacggctgcacggtcacattctggcctgtctgcttgatatgccgcatgttgtcattgacaactcctatggcaagaactcgcaatattataatacctggacacagccgaatccaaaggcgcagctgtttagtgaagctccaagtgcgttggagcagccatcttaatagtaagaaaagatacgtagattaatttcaaaggtatgataacggcaaaaaatctcctgaccatttcattggtataggagatttttgcttgtgttaaattaataagaatagttaagagttaagcttgtgaactattaaggctattcatatttaatgggatgatcgctcgttctttcttggcttctattgattattgacagttacctcatattttgatgcgttccagtttacctttgcacccaaggtttgagaaatgaatctgatcggtaccaaaatgctcccgtttatatattttggaggagcagcgagacttactttttttccattaaccaatgcgaaattttggtttacaactagttctatagtcagtttaccttttgtgatggtgacatgatccctttggctattattccaaatgactttagctcctgatttttcaaatattcctctgaaaggaacatagactgagccgttcagtaatttgggagtggtagtcagatccatggtagagccatctacggtcaattgaataggcttcactacaatagtcggttgctttacatttttcaatgtcgagtcaattccaagttgaccgttaacgttgctcccccaactccataatttattgttttccgttcttacgattgtaaagtcgtttccagagtttacttccgatatattagcaagcccctttactttctctggattggaattaccagcagaaatccagacatcgccagtagttgttacaaatgaaacagtgtggtcgaactgagcagagatatcttttaacttctgtggaattttaaactgtttggttttgctctctagcggattatatgtccacccgttgccattcatatcaattgcacttatagcaaaatctccacttttaatcattttaatttttttaagttgtttaagcagctgtggttctttaatattcgcatcttcattgtcgccgccccaatagagcaatgttccatccttggaaagtgcaaaggaaccctgattcgtagctgctatacccacaatattcatgggtagatcttttattaaagttggttcattgatgaaagatgactgaaagttggctaattggccccgagaattatcaccccagccccaaacctgcccgctttgatctaatgctaaaaagtgatctcctccggcagcaattttaacaacattttttaggcttgagaaggttttaggggcaatactacgaccttgattttttttactttgccaactaacaacggtaccatctgtttttatggctagagaactaaagcgacccgtggtgacctgtttaaaagtatcagatgacatagaaaccacaggagaaggtacggaacgatttatgccgtcttctgagcctaattccccatcttcattgcgcccccatgcaagtagctttccttgcttgtcaatagcgtaagtatgttcaccactgcttgaaaattgaactatatctggagatggttttacatattcgtttgaatatgcttcttttgaaactaagcaagaggagaaaattagtaaaataactgataaagctatgaaacattgctttgaattttgatttttcaaaatatgctctctcctttttttaaataacttctaatatcatataaccataaacaagaaagaaattgcaaataaatccagtgagtatgcatttatttccataaaaaatgtagacaaatgaataatgaaatactattatatgttttgggtgaaaatttttacaattagggaaggagtatagcaaaaatttttctcaaaaattaggatgaggtgagagtgaatgaaaaaggtaaagttctcaataattatctttctgttattctcttcaattggtgttactgcttcggctaataacgaagatattacggaaaaagttagcgattcagtaacgcaatcaacttatggattagaacattctaaaaatgttacagtaaaaaatgatgctgaggttagccaggaaaagataaacaactttattattcaagccaaaaaagttgttagagaagaaaaagcaaatagtcaatcatttaatgcatctattgaatcttctacatatgaaactattgactactgttatttggacgatactaacctctttttttatgaggattcttcaattaaagatccagagttgattattttaccagttgaaaatggtagagaggaaacacacgttattaaaccacaagcaatacaaggaggatttggaggaagggtattggtcaatagtacgacaggtaactacattgagactagggccactactacatcaagtaactctactttgctggctacaaatggaaccccatatatgtatacagggtttacagcaagaggattggaagttgatgcaggattggcttatagtaaaggagatgctccgggagtttggcagccttatcttaaaataggtggggacgatccactgtcaacttcatatctacttgatggttataatcaggtacaatataaaaatgggtatattactggacagccagttcagatagacttatggaggaactatactagtggtgttgaacataacgctgtaagattaaaacttgcggggactgctatatgtgcagatcttggatgttcaagacatggtgatactaagctgaccactatcttttctaaatcaaatattggagtgaacagtgtagttaattataagttgttagcaactattgctggttccggagcaagcgggcagatgaattctactctaagtgaaatatcaattgacgggatagccaaaacaccagttaaagatgaagtagccaatactcaagtcacaattagtggaaatagtgcatcttttaagctttcaaaatagtatattagtatagtttataaaaccgttctaaggagcggttttatttttttattaaaagccatattgtttgcttacactccactaccgcttcattttgacaattcatttcatgaatagatataatttatgggataaaacttgtaggaatattgggaactccctaacttttgcagaataacatgaaagtatatttatttaaatgaatcgaggctgacgaatgagtaatcaatcgatggacatgcttctcacgaaggatatcgtgcgtgaaggggaaccgattttgcgcacaaaggttgagccggtatgcctgccgctgtctgaagaggacctgcaacagatgcaatggatgctagattatctgaaaaatagccaaaatgaagagctggccactcgctatgatctacgtccgggtgtggggctatccgccaaccaggttggtttgaacaaaagaatgtgcgctatttattatgaagatggggacaaaacggtagagtatgcattgtttaatccgaagctggtcagtcactccacgtccatgatttatttggaacagggagaggggtgcttgtctgtagatcggtacgtagccggatatgtaccgcgttacgaaaaaattcgtattaaggccactttaccagacggaacacaggagctattgactttcaaaggttatgcagcggttgtcgtgcagcatgaaatggaccatttggacggcattatgttctatgaccgtatcaacccgaaagatccgcataagctgccgcagggagtgcatatcgaaccttttgtacgtaaatagtttaggaatcgtaaagtgtggtgactccgttcgccacatttttaaattttacaaaaatatagatatagaggttacgaagctttaaactggaaacgtgtagattgtgatagagaatgtgaaaatacataaaaatgtaagcgcttatcttatgggagggatggcatgaatcgtggagtacggcttttgatgaataatatgcgtatgcggaataagctgctgttctcctacgtactgattgtcatgatcccggtgctggtggtgggcggctgcgttactttttatttgcgagagcaggcattgaatagtgcaattgcccagacggtaaacaatgtggaaaagatcaagagccagacggcaaatttactgcgtgtgccaacggatatttcaaatgggctcatgttcgataaaaggctgagggagatggcgaaccgacggtatccgggtatggtagagctgatgaatgcgtatcatcaatacaaggattttaatgagtatacccagcaatatagagaagttgctaccatccggttctattcgtacaatccgacgcttgtcaataatctggagtttattccagtggactctaacattgagcggcagcagtggttccagacggctttgaaggggacggcgattaactggttttacattcaggataaggaagataacccggttaatcgcctgagcctagtacggcaaattccatttcctgaatacaataccaagggagttctgatgatatcgctgagccagaccgagttgaatcatatgctgagcaaggagccttttgaaacattgattacggatcgtaacgggattgtggtcgcagctactcatccacagtcggtgggccaaacgttgagcgatttacatttgggctttgacgtccagcgtgcgggtaaggggatatatgaagcgaaaatcaacggagtgccctccaacatcatcgtggatgagctgctgcccgcctccagtgtgagcggatttacgattatttcagtgttttcgacggagcatattgtacagggagccaaccgaatcagcctgattggtgctttatgtgttcttgcagtgctggttatggcactgattctaatcaccatcatttcctggctgattaccaaacgactacagcggttgagctatgagctgggtaaggtagccgcgggcgattttcatgtggtatcgagtgtggagggaaaggatgagatcggggatttatcccgccgtttcaactatatggtgagtagtattcgccaactcatggcgcaggtctatgagacgagtgagcacaacaacaggctggaattggcacaaaaggatatcaagctaaaaatgatggccagccagattaatccgcactttctgtttaatgcgttagagtccattcgaatgaaagcacatctgaatggggaagcggaaattgcaacgacggtgcgtttgcttggcaggctgatgcgccggaatctggagattggcagtggtaaaacgacggtactacaggagctggatatggtgcgatcctatttgcaaattcagcagttcagatttggaaatcgtttgatctatgaagtgaatttggaagaaagcgcgacggacatgtcgattcctcccttaatcatacaaccgctggtggaaaatgcagtcattcatggcctggaaaataaggaagagccagttaccgtgaaggtagatattacaatagaacaaagagagctgaaaattaaagtagaagatgacgggatcggcatggaagctgggcaactgagccgtctgctagatcggatcaggggggcggatgagccggaagggagcagtattggcctgcgtaatgtacatcaacgtctgacattgatgtacggcgaacgttatggactgcatattgaaagcgcattacaagtaggaacaaccgtatacttttccataccaagggaggaagagtcaaatgtataaagcaatgattgtagatgatgagcctgcgattcgtgaaggattgtcctctattattgactgggggaattgtggcttccgcattgtcgatacggcagggaacggacgcgaggctctggataagttcggagagcatcggccggagttggtcattgtagatattcgtatgcccgggatgagtggactggaggtcatacgaagcatacgtgaaaagaacggagagccgtttcattttctcatattaagcggatatgcagactttgattatgcacggcaagccttgggcttcggggtagatggctatctactgaagccagttgatgaggaagaaatgacgacagagttgaaacgggtatggcaaaacattgaggacgagaaagaagacggcaaatggggaagtacgccttcccatgagcgtaattggatcgaagcattattgtttccggttcatcgagagcatgctcgtaatgccgtagaaagcagcgattctctgcacaaagcatccgagcaagctgaacatcaaagcggtaacggaaaacatggacaacagcccgcgttaccagcgttggactggagtagctatcaggttattctgctggatttacgtattcctgactgggatcggcaagctcggcagtcggcagcaaagcagcggctaacagaattgtgccatgagcagggcagaggtatcgtgtttgaggctggaatatatatgggtcttttgcttcccgccacgttaaaaacggagaaagatgctgttcagttactggctgcttggcgacaggagctaaagccgtgggcaacggaaatttatgtggctgccggtgatcctgtatccattcttaacgaaattcccagatcttttgagcaggcactacgattgttagaacgtacgtttttgttccgggcagaaagagtcatgctttccggagacctatacgaatcggagacagttgagactgaaatgagtggagcgtctgatcgtgctacaaatgatcccctacgttatgcagaaaagctgtactatgcgctagatatggctaatagtgaagctgcaacccgtgtcattaaggaaatggaagaccaatttccacggatttattgcacagaatctgcaatcaaggcggcgttcgcccaaacattcacactggcgttgaacaagtatgcagccggacaggatcacagcagaaccgtgctggaggagcactccagctttataaccgatgtatatgcttattccacattgggcgagctggtggatcactcgctggagcatgtgttgcaatggattggccagactgaatctggtggcaagggcatcatcatgaaacaaatgattgactttatacatagtcattatgatgaaaatttgcgactggagttactggcagatatgttcaattacaatagtggctatttgggcaaactgttcaaaagtcatactggcgaggcctttaatgcctacctggataaggtgaggattgagcgagcaagggaattgcttgcacaaggaattaaggtacaccaggtggcggaacgcgtgggatatgcgaatgcagattattttcatagtaaatttaaaaagtatgctggaatgtcaccttcctcctaccgtaatagggttcaaaagaacggaggaacagatggctgttgatagattcctaggtttaacggtatgaagtctctcttgcagatgtcggaggtataaccttcgaacgaagagaggctcttttttatggtgaaaaaatggatagatcaatcgaaaatgtcacatttattatggagtttagggagttttcatcaaatcgacaccattatgacacagcttcgacacgatgttcacattttcgattctatttcatttaaatttattctatataatggggataatctgaagccggatcatgacagccatggtgaaggtacggagtgagtcattttctaaaaagtgaccgctgcatatgtaagaatgtgaatactatcacaaatggagaagacttcagattataaatactataaatcattgttaagagaagtgcagggggaggagcaacatcatggacgtattggatttggcacggttgcagtttgcaaccacaacgattcttcactttgtttatgtgccgatctctattggattgtcgttattggtggcaattatggagactatgtatgttatcaagaaaaatgacttgtacaaaaaaatggctcaattctggggaacgtttctgctgattaactttgcactgggcgtcgtcaccgggattttgcaagaattccagttcgggatgaactggtcggacttttcccgttttgtcggtgatgtattcggtacgccgctggcgattgaagcattgcttgcatttttcctggaatcgacctttatcggattatgggttttcggttgggaaagattgtccaaaacggtccatttaatctgtatgtggttggtatctatcggtacgatgttatcggcattgtggattctagctgctaattcattcatgcaacgtcccgtaggatatgagattcaaaatggacgtgcagaaatgaaagattttgccgctctgctaacgaacgaacaactgctatgggagtttccgcatacgctgtttgctgcttttgcgacaggagcatttctgatcgcgggtatcagtgcatggaagctgatgcaaaaaaagaatatggacttttttaaaccttctttcaaattgagcattattgttgccttaatcagcgccatagctattcctttgtttggtcatggtcaggctcaatatttagtgaaaacacaaccgatgaagatggctgccagtgagggcttatgggagaacagcggtgaccccgctccttggacagttatcgcatggattgatcctggaaaaaaggaaaatacctttgagattaaagttccttttgctttgagttttctatcctatagtaaatttaccggctctgtgcctggtatgaatgagcttcaggcagaatatgagaaaacctatggtccgggagattatatcccgccagtaagaaccacgttctggagcttccgcattatgattgcggcgggatgtggcatgattgcactcgctttatacggagcttatctgacgttccgtaaaaagttggaaggttcacatcgctggttcttccgtcttatgatatgggggatatcccttccattcattgggaatacttcaggttggatcatgactgaaataggtcgccaaccgtggactgtatttggtttacttcaaacgaaagattctgtttcgcctactgttgtggctggagaagtgttgttctcgttcatctcatttaccacattgtatttaattttaacaggtgtgctggcgtttctgttttaccgtacggctcgcaaaggtccagatattgagccgcatcaacaaacggtaattcatgatccttttgctcaagggggtgacaccattgtcgctaaatgatttatggttcctattgattgctgtgctgtttactggcttcttttttctggaaggctttgattttggcgtaggaatggccacaggattggtgccgcgtaatgaccaacaaaaacgtttgatgatcaatacgattggtccattctgggatgccaacgaagtgtggctgattacagcagcaggtgcgatgtttgccgctttcccacatttttatgcaaccatgttcagcggatattatctggtatttgtctttattttgctaggtttgatcttgcgtggagtttcttttgagttccgcggcaaggctgaagggaaatggtggacaggaacgtgggatgcctgcattctgattggcagctttctaccgccgatgctgttcggtatggcttttgcggctttggtgaaaggtgtacctattcagcaaaacatggatttgaaagctggattttccgatgtattcaatggatacaccgtatggattggactgacagtggtcggaatgtgtctaatgcacggactgacgtttatttccctgcggacgattggagaagtacgggatcgcgcgcgtgtgatcgcgtccaagtttcttccggtattgggcattttactcgcgggcatggtggtatggacttattttgcaacggatttattcgcacgtcgcggtccctttatgtatgctgcggttgcggtgggaattgtcgcctatgtgctgacatggtacttcctgaagcagcgccgtgaaggatgggccttcgggatgacaggtgcagtgattttactgaccttcgtatcgttattcgtcggtttgttcccaagatttatggtgagctcgattaacagtgcttttgatttaacgatttataatgcaagctccagtcattacacactgaaagccatgacgattgttgcagcaacgcttttaccctttgtgttggcttatcaggcatggagctattttgttttccataagcgtctcagtgagaaggaacatttggaatactaatggataaggcatggtttgaattaaagggcattcggccagtgatgctgctactggctgccctttccctgctccagggggccgcagtgattgcacaagcagtcttcttggcaaaggctattacgattttatttgataaaaatccgctgctgatggcttggccttcgctggcgttgtttttcgcagcttttgcaacgaggcatacggcgatctggctgcaacgccggacagcaggccgttttgctgaagcttcaggcgcttccttacgggagcgtctgcttgcacgtttgttcgaacgggggccgggttttgcagcgcgggaaggtagcggcaagttggtgacgctagcgctggacggcatggatcgttttcgcacgtatttggaactgtccattcctcgtatgattgacatgatggctgtaactatacttgtgcttgtgtatgttttcacattggatgtcatttcaggtgtgattttgacgactacgatgccgatcctggtgggcttctttattttgcttggcttggcggcgcggaagcaggcagacaagcagtggcgttcctatcgtctgttatctcatcatttcacggattcgctgcgtggacttcagacactaaggtttttgggtcgtagccaagagcatggggaaacggttgggaaggtcagcgaccaataccgcacggcaacgatgcgcacgctacgggtagcgtttctttcctcatttgcccttgatttttttagtatgctatcggtcgcttttgtcgcggtaggcttgggtttgcgcctgattagtggctcggtgggtttggaggcagcgcttgcggtgcttattttggcgccagaatattttatgcctatacgccagttgggatcagactatcatgcttcactggatggtaaggaggcttggggagcaatacgctccattctcagtacagaagatgatgcgaccaagccgaataaacaggcagctaacgataaaggattggacatcacgggacaggacattcttgagctgtctgatgtgtgcctcctgaatgaagacggttcggctcggcttgaacatgtgtctgcacatgttgaaccgcacatgaacatgatcggcatcgttggagctagcggtgcaggtaaaacgacgctgcttagcctgcttggcggctttgctgatccgacttcaggcgagctactcctgaatggatgcggattgggtggggaagccaaaactgaatggcagcgtcatattgcctatattccacagcatccatacctgtttagcgcatctttggcagataatatccgcttttatgaacctgaggcatccaaccagcaggtagagtgggcgattgacgcggttggactgcgtgaactggtagacggtcttccgggtggaatgaatgagcccattggtgaagcaggtaggacactgagcggagggcaggcgcagcggattgcattggcgcgggcattgctcagtaaccgtccggtcattttattggatgagcctacggcgcatctggatattgagacagagtgggagctaaaacagacgattttatcggttttgaaacacaaaagagtgtttcttgccacccaccggctacattggatgccagatatggactgtgtctggatgatgaatcaaggtcgtctggaagaagtaggttcccatcaacaattgattgcctgtaagggggcatattaccgattgctgacggggatgtcggaaggagggaacggacgatatgagagtaacggacaatagcagacaaggctggtttgtgacgtatctgagacaatatttttgggcctttctggtagctgctcttttgggtgcattggccattggatgtgcgggcgcgttgctctttacgtccggtcatctgattacccgttcggccttaaaaccggaaaatatattaatggtgtacgttccaattgtgcttgtgcgaacatttggctttagtaaagcggttattcagtacctggagcgcttggtaggacatgatgccgcactgcgccttgtgtcccgtatgcgggtacgcttatatcgggcagtggaaccgcaggcgctgatgattcgcagcaaattccgtacaggggacctcttgggactgctggcagaggatattgagcagcttcaaaacatctatttgaagctagttttgcctgcgctatcggctttgctaatttatgcagcaggcatctgggcgcttggacggatggacggaacctttgccttgctcatggcgttatatggcggatttttgctttttattgccccagctatctcactatggacctcactcgccaaacggcgagtgttcaagcaggaacggagtaaagcctatcaggaactgacggatgctctgttcggcatgagtgatctggtgctgagcggacggactgggcatttcctgagcacctttacacaacgacacaatagggctaccgtaatggaaaattcacttcgccggagcgagtggcgttctcattggatcgcacaatgcgttgtaggtggcggggttgtgattatgactgtgtgggccggaggactggtagcacagaatcgtatagaagccacatggctggcatcctttgcccttgtggcttttccattgctggatgccttcgttcgcgctggagaagcggtggttcatgcgccggagtatcaggattcacttcgacggttaaaggattcggagaaagacacacctacacctggagcaggtggaacagcagacactctagaggaacaggctaccgctatgcgattgggccacggaggaggcctgctgctgaacaacgtaagctaccgctatgcgacaacgcaggaatggagcgtacgtaatatctccctgcacgtaccgcaggggggcaaggttgcattgcttggccgcagtggtgcgggcaagtccacgctactgaacctgattcagggagcattgcagcctgatgaaggtagcgtcactgtcgaagggattcccgtatatacaggtggagcatactccagtctatttgcagtgctaaaccaacagccgtatttattcgatacaacggtagcgaacaatattcggctgggacgacccgatgctacgctggatgaggttcgtgcagtaacagagcaggtagggcttggagccctgattgattctttgccggagggctacgatacccgaatgcaggagacgggtcttcgtttttccggtggagaaaaacagcgaattgcactggcgcggattttgctgcaaaatcacccgattgttttactggatgagccgacagtggggcttgacccgctgacagagcatgagctcatgcagacgatgtttcgtgtgctggagggtaaaacgctcatctggatcacgcatcatctcacaggaatggagcatatggacgaggtgatctttatggaaaaaggggtcatttccatgcgaggaagccatgaacagctgtggcaggagcagtcccgataccgcaacctgtatgagctggatcatccgatcctgtgaaacgaggtatttaaaattttgattaacttttatatactggttagagtggatgcgtcacatgtagacattcaactggaggggctgatataaatgaaagcacttatctctaagcattggcatttgatgctgattggttttgtagccctgagcatgggcgggtttgtcttgttttattttcaggggagcgtgtcgtcgtttccggccagtcaacctaaacaagctcaggaagagccagacaagaccaaatatgagattgttacagtgggtgtaaaaggggacggtttctatcctaaaaatattgaagtgaaagctggcgttccaaccaaaatcaatttcaagaaaatgacatcctttacttgcattgatgaagtgcagtcgttgaagatcggaatggacgtttacctggatcacgaaaataattattttaccgtcaaggacttgaagccgggggtatatgagtataattgtggcatgtacatgtactacgggacgatcacggtaaaataaatcaaaatagctttctagcacgtggatgctagaaagctatttttttcctttaatcaattaggttaattgcgacagtctgtatatataccatcatccacctgtggtgcaatatgcattatcctttatcctttacctctgatcagcttacattgctgatcttttgttttttacaagacttctctcagaaaatttacatgagaacggagcaggcggaatggtgctggacaagcgaagcggtcgcctttgtccccggatttctacctttggttgcttattcaagaaatccggggacaacagcgagggaagcaccatctgcatgcgtagtggcacgaatgtaatttttttcatcccatatatctaattttgaactgatttttcccctaattcgtcgggtacccgcttccgagccagcaaagtatgataatagtatctagagatgaggaggagcttgttatggaatcttcaactgaaaccgcttccaacaatggtgctgtgattcctgaatccaaccggggaagaccgcgcaaggctcgcggcccaaagcctgaacttggtagaaaaggcttgtgggacagtgtgaagcagcaaaagtatctttattttatgtctattcctttcgtcatatgggtgtttgttttcagctatcttccgctctggggctggacgatggcgtttcaaaattataagccagctaaatctttttcggaccagaaatgggtagggctgaataactttattgagctatttcaggatgaacgattttatctggtattacgcaatacgctagcgatgagcctaatggggattatatttggttttgtcgtaccgatcttctttgcaattctgttaaatgagctgggtggtatgctgttcaaacggtttgtgcagacaatatcctaccttccgcattttgtatcctgggtagttgtagccggtttggtcaccaagatgctgtccattgacggaggcattgtcaacgatatattggtagcgcttcatattgtggatgaaccgattcagttcatggcaaaggggagctggttctggtacattgtaaccgcttccgacatctggaaagagacgggctggaatacgattatttatttagctgcaatcaccggaattgatcaagaacagtatgaagcatcgcgcgtggatggagcgggccgctggagacagatgtggcatataacactgccgggtatccgctcgacgattgccgttctgttcattatggcgattggacatctggtgagcaacggttttgaaaaacagttcttgcttggcaatagtctcgtgacggattattccgaggtgctggatctgtacgcgctcaattatgggattaatttgggtcgcttctcttatgggacggcaattggtattttcaactcgctggttagcattctgctgttgtttacggcgaacggtatattcaaaaaactaactaaagaaagcattatgtagggagggagaggcgaaatgacgaataaggcatttaatgctacccgatctgagaagctgtttgatctgttcaactatatcctcatggctctgatcgtggtgttgacgctgtacccgtttctgaacgtacttgcgatttccctgaacaattcaacggacacggttcgcggtggtatttatatatggccccgccaatttacgctcgaaaattacaaaacgattttccagtacgatggccttcttcaggggctgcaaatatctattcttcgtactttggtcgggacggtactcggtttgatctgcgcgtctatgcttgcttttacattgagtcgggtcgagtttcgcgctcgtaagtttatttctacgtttttagcgttgacgatgtatttttctggcgggatggtgcccgtgtttattttgatgcgtgatctgcatctgctgggttcgttttgggtgtacatttttccaggcttaattagcgcatttaatgtgtttgttattcgttcctttatggacggtttgccgtatgcgctgcaggagtcagccaaactcgatggggcgaatgattttacgatttactggagaattattttgccgctgtgcaaaccagtattggcaacgattgctctttttctggcagtaggtcagtggaatgcttggtttgatacgtatttgtataatggtggggcgcctcaatggacgacgctacagtatgagctgatgaagatactgcaaagtacgcagcaaggcggctccagtatgacgaatagtaacgatatggctaagcaaatggctcaaatttcaccagagtcgattaaaatggcaatcacgattacggttacgctccccatcctgatggtgtatccgttcttgcaaaaatattttgtaggcggtatgacgctgggggcagtgaaatcataaaaatcgggataccggtagtgaaatagaagttatttgcaggagaagtcatcataggaatataggaggatttatacatgaacaaacactggtccagatttgcactgattcccttgctcgcggtgtctcttaccgcactcgcaggttgtggaggaagcgataaagcagcgaaggaaggcacgtccagcggcacagacccgattacatttagcttcttcggagcagatacaagcccgcaatggaatggaatgaaggatgaaataggcaaggaaatcaccaagaaaacaggtgtaaccttgaatgcggaatttgatgtcagcggcggaggtggagatgaccgaattgctttgatggcagcaagtggagaatacccggacttggtttctcctaaagcaaatattaacaagcttgtggatgcgggggccatgattgatctgacagatctgatcaacgatcacgcacccaacctcaaaaagctatatggaccctatatggatcgtttgaaatacagtaataaagatcaatccatctatgtccttcctacgtatgcaggcgtgggacaggagagttttgacgcgacgggcggatttgaaattcagcataaggtgctcaaggagttaggttatccaaaggtaagaacgctacaggattatgaaaacgtactcaaaacctatacagccaagcatccaacgatcaatggcaaaaaaacgatcccactcacgctggatgcagacgactggagaattatgattaccgtaacgaatcctgccttccagacgaccggagcgccagatgatggtgaatattttattgatcccacaacatttgaagcgaagcttcattacaaacgtcctgaagaaaaggaatatttccgttggttgaaccacatgtacaatgaagggctgctcgataaagattcgtttgtgcaaaaaagtgatcaatacaaatccaaaattgccagcggccgtgtcctcggtctgattgatcaggagtgggggtatcaggatgccgaaaatgcgttaaaagcttcaggcaaggccgattccagctacgcgcattttccagttacactttcggagaaatacaaggatagctcctttcaggatacgggctttgcgtccggttatggtgtagggattacggaaaattgcaaggacccggtgcgggctattaaattccttgattatttagcttctgatgaaggacaagtgctagtgaactgggggatcgagggcaagcattatgagatcaaagacggcaaacgcgtcattcctgccgatgtactggagcaaaaaacgaacaatgcaaccaacttcaataaatccacgggtatagatttgtacacgctcatcagtggacactatggtgacggcgtgaaggacccaacgggtaactactatactgccaaattcccggagcaaattatcgcagcttattcggagccggagaaagaatcacttaaagcgtatggcgtaaaaacgtggaaagatctgttcccggacaagaaagaatttgatgtaaagccttggggcgcagcctataacctgacaacagacaatgaatccaactataacgttacatttaaaaaaacaacagacattatccgcaaacgtatacccgaagcgattttagcaccagcttccaattttgatacggtatacgacaacatgattaaagaactggatgccgccggagctgtccaaatggaacagcaatacacgcaactggtgaaggacagagtggagttatggagcggtaaggcttctaaatagctgattaacgaaattttgaatgcgggaatgacagagcgcttgtccttatggtccatacgggattagcgctctgtttcatcttgatgggggagggcttgatgtgacgaaaggcaaaagaccacagtccctgcgtttatggtatcgccaacctgctgaggtatgggaggaagcattgccagtcggcaatggaagactgggagccatggtatttggcggaatcagagaggagcatttgcaattaaacgaggatacgctctggtccgggtttcccagagacggcgttcagtatgatgctttgcgatatttgcagcctgtcagaaaactgattgcagatggaaaatacaaggaagcggaacaactgattaatgcgaatatgctaggtcgcgatacggaagcctatcagcctttgggagatttgtggattacgcaggagggcctaggggaaattgtgcattatgaacgggaactggatttgctgactggaacggcagcggtcacttttcaaagtgatggagtccgctatactcgtgaagttatcgctagtgcgccagatggaatcatgatggtgtcactgactgcgaataagcttgggaagatccatgcatctgtgcgcatcacttccccccatccttgtgaagacgaggttggagaggatgcacattttggtgattcatccaaatgggatagcgataatggcgatccatccgatgagccgatctgggactttattacgttgactgggcgagcgcccagtcatgtggaatctaattatcacggcaatcatccacagtctgtcgtttatgaaaatgatttggggatggcttttgcagttcaggcgagggttattcctgagggaggaaccttgacgaagggtgctgatggagcactgatcatctcgggcgccgataaaatcacggtgtatttagcagcagctaccggatttcagggattccacgttatgccgaatagtgatgcaacggaatcagtagaagcatgtcaagtcattttagacggagcaatttcgctgggaagtgagcaggtgcggcaacgccatgaacaggaacatcgaaagctgtttgaccgcgttgcattagaactgggaggtgatactctaaccgacgagtccgttctaccgaccgatctgcgattagaacgttatcagaaaggccaggccgacctggggctggaggtgctgttatttcagtatggccgttatttgctcatgggcagctcgcgtccggggagtcagcccgccaatcttcagggcatctggaatgaccgggtgcagccgccgtggaacagtaattatacaaccaatatcaatacgcagatgaactattggcccgcagaggtatgcaatcttgccgagtgccatgaaccattgctgcacatgattggagaagtggctcgtacgggacggagggtagcctccatccattatggtgctcaagggtgggcagctcatcacaatgtagatgtgtggagatacgccggaccttcagggggccatgccagttgggcgttttggccgcttgggggtgtatggctcactgctcacctatgggagcgctatctgtttaccctggatacagcctatctggcagaacaagcttatcccctcatgaagggggcggcagccttttgcatggactggctcgtggaaggcccggagggtcggcttgtgacatccccatccacatcacctgaaaataaattcaaaacgccggatggcgaggaatgcagtatatctatgggctccaccatggatatgacgctgattcgggagctgttggataactgcattcaagctgcggacctgttggaattagacgatgagttccgcaaccgctgtgaggagacacgggcacggttaatgccctatcaaatcggacgtcacggccagttacaggaatggtttgtcgattttgaggaagcggagcctgggcatcgacatgtttcgcatctatatgggttatatcccggtcgacaaattcacatccgtgataccccggagctggctgaggcagcccgtatatcgctgcgtcgacggcttgatcacggtggtgggcataccggatggagctgtgcctggttgattaacctgtacgctcggctggaagatggcgacgccgcacatcggtatgttcgcacgttgctgtcgcgatcgatctatcctaatttattcgatgctcacccgccttttcagatcgacggtaattttggtgcgacagcggggattgcagaaatgctgctacaaagccgtccgggagagctgacgttactgcctgccttgccaacggcatggtcggagggaagggtcagtggattgaaggggcgtggcgggatgacggtcggcatggaatggtctggttccaggctcgtccgtgctgaattgaccgcgtctgtccagacgggaagctgcacaattcgctattcacatccgtttagcgcagatgctcgtcaggctctgcctgatcctgagcatggaggatttattttgtcatggatttttaccaaagagcaggaaataacgaaccaacatacgattataattgaaggagaggaagagataatatgaccatttttcaatttccgcaggactttatgtgggggaccgcgacggcagcttatcaaatcgagggagcttatgaggaggatgggagaggtttgtcgatctgggatacctttgcccatacgcctggcaaagtattcaacggtgataacggcaatgtagcttgtgacagctatcatcgctacgaggaagatatccgcctaatgaaggagctgggcattcgtacataccgtttttcagtgtcctggccgcgtatatttcccaatggtgacggtgaagtcaatcaagaaggattggactattatcatcgcgtagtcgatttgttgaacgaaaatgggattgaaccgttttgtacactgtaccattgggatctgcctcaagcgcttcaggatgctggaggatgggagaatcgtcgcacgattcaagcgtttgtccggtttgcagaaaccatgttccgcgagtttcacggtaaaatacaccattggctaacattcaatgaaccatggtgcatcgcctttttatccaatatgctgggtgttcatgccccgggtctgacaaatcttcagacagccattgatgtaggacatcatttgctagttgcgcatggtctttctgtgcgccgtttccgcgagctgggcaccagtggccagatcggtatcgctcccaatgtctcctgggctgttccttacagcacatctgaggaagataaagccgcttgtgcgcgcaccatttccctgcacagtgactggtttcttcaacctatttatcaaggctcgtatcctcagtttttggtagactggtttgcggagcagggagccagcgtgcctattcaggatggggatatggatattatcggcgagcctattgatatgatcggtatcaattactatgctatgtcagttaatcgttttaatcctgaagccgggtttcttcaatctgaagaaatcaatatggggctacctgtaacggatatcggttggccagtggagtcgcgtgggctgtacgaggtactgcattatttgcaaaaaaacggtaacctcgatatttatatcacagagaatggggcttgtatcaacgatgatgtcgtgaatggcaaggttcaggatgaccgtcgcatttcgtatatgcagcagcatttggtgcaggtacaccgggctattcatgacggtcttcatgtcaaaggatatatggcatggtcacttatggacaattttgagtgggcagagggatataatatgagatttggcatgattcatgttgatttccgcacacaggtccgcaccccgaaggaaagttactattggtatcgaaatgtagtaagtaataactggttggagaccagacgttaaacgataaacgaagagatgttttgaaaataaggcagatttaggcctgtctctgctcccttttgtttgaacactgggtcttccggggtaataatagtcaagatatgcagagggttgtttcaggtatgtagagaccaagggaataaagaagcaagatatgtgcatactgacaaaaataccggacgagggcgctaaaaattattttagaccgaagggagtggagggtatggctgcaaattttaggaaatcaggatcaactgacgggcaaatgagccggacggtatctgttatcgcttggatcgcctgtattgcaggtattatccttattttgcttgatataggtaatttaactgatcggaatatatatttaatgacaggcattggctgcgttgttgccgggatttttatttttctagttgggaaatcatttgtcattgcacgcaagaaggaagaccaggaaaacggccgcagttaatacaatttaaaaatgatttaaagcaaagatatgccgaaaacaacaatgtggggcttcgagcagtgtaggatgataactgtaaggagtcccgcttttttctttaatataacttctttaagatacacaaataacgtttttattatgtcatctttgtattaaaaagaaattttgaatttgcaagagaaattttatttttagagatgtttttcacaaaaaacggacaaataatcgacaattctgttaacaataaaaaaagtggccacttttctgctatcttatataggggcaacattacaggagttcgtaaagttttgagtaatttattatttaaggagaggggaacaacatgaacaaaaaaccaaaagcgattattgcgttggttttgaccgtgctcacggtagcattgctcatttggacgtgtttttatgctggcggaaaatacgttgttttcgatccgaaaggacccgttgggcaagcacaaaaagagctgatcattcttacaacggcattgtctgcgctaataattgtaccggtcatgattttgactttcttcatcatttggcggtatcgtgatacaccgacaaacaaggtgaagtatcaaccccactgggatgacagtaaaaagctggagaccacatggtgggctattccaattatcgttatctgtattattgcggtcattactgcaagatatacctacttgctggagccttccaagccgttggcaagtacgcaaaagccagtaaccattcaagtgacttcactggactggaaatggctctttatgtacccagaggaaggtatagctacagttaaccaagttcacattcctaaaggtgttccagtccgttttgaactgactgctgacgccccgatgaactcattctggattccgcaattgggcggacaaatctacaccatgtcaggcatggctatgaaactgcatttgcaggccgatcacgaaggaacttactttggttcgggtgcaaactttagcggtgagcattttggacaaatgcgttttgatgtagaagtccagtcggatgaagagtataaaaactgggtcgctgacatcaaaaagcagtctaagccgctgacgaaagacggctatttggcgcttgcaaaaccaggtttgtcccagcctgatgagtattcttcgattccagatggcttgttcaaagacattgttaacaagtatgtagtggaaggtgcttctaacccacatgctggacatggtgaagctacatccacagaaggttcttctcagtccggcacagaagatcatgcggcaatggacatgagtcatatgaatatgagcggacacaattaaatgattatagggaaggaggcccccaatgcttgacaaaataaaagagtttgcatccactttcttcgttactggagatccgatgatctatggagcggacgtctccatcgcattagcaacgatcgggatcgtgtttgtgctcacttatttcaaaaaatggggctggctttggaaaaactggttgactactgttgaccataaaaaagtcggtattatgtatattcttgcggccatcttgatgttattccgcggaggcgtggatgcattattgatgcgtgttcaactggctacaccggatgttacactactgcatcctgagcattacaaccagattttcacaacacatggcacgatcatgatcctgtttatggcgatgccgttgatgtttggtttgtttaacattgccgtaccacttcaaattggtgcgcgcgacgttgcgttccctttcctgaacgcattgagcttctggcttttctttatgggagcgatgttgttcaacctgtccttcgttatcggtggttcgccagacgcaggttggttgagttatccaccgctttcagaactgcaatttagtcctggcgtcggtcagaacttctatatctggggtattcagatttcgggtataggttcattggctacgggtatcaactttattgtgaccattattaaaatgcgtgcacctggtatgacttggatgaaaatgcctgtctttacgtggtccgtattttcgtcatgtgttattatcattttcgcattcccgattctgacggttactttggcattgctgttccttgaccgcttcggaggaggacacttctttacgcttgatttcggcggtaacccgatgatgtatatcaacttgatttggatgtggggtcaccctgaggtatacattgtagttttgcctgccttcggtatttattccgaggttatcagcgtattctccaaaaagaaattgtttggatacaagtccatggtttacgccatgttcattattgcgatcttgtccttcttcacctgggcgcatcacttcttcacgatgggatcaggcgcagatgttaatgcattctttgcgatttcgacgatggttatcgcaataccgacaggggttaaagtatttaactggctgttcacgatgtatcggggtaagattacattcaagactcctatgatgtggtcaattgcttttattccgaacttcttgattgctggtttgacgggcgtcatgttgtctgtagcgcctgctgacttccagttccataacagttacttcctgatcgctcactttcactccgctctgattggtggtgtagtgttcggttacttggcaggtctgtactattggtggcctaaaatgttcggtttcacattgcctgaaacgcctggtaaatgggctttctggttctggaacatcggtttctatgtatgttttattccacaatattctctcggtctgatgggtatgacgcgtcgtctgagcacttacggctgggataccggctggcagccgcttaacctcgtttcgaccgttggggcattcttgatggggattggtttcttgttccaggttcttcaaattcttctgggcatcaagaattaccgtaagctgaaggatacaacaggcgatccttggggtggccatacgttggaatggtcgattccttcacctgcaccggagtacaattttgctaccattccacaagtagaagaacgtgatgactggtgggcagaaaaagatcaacgtgcaaaaggtattttcagaaagcaaccgccaattgaagcgattcatatgccgaagaactcggcgattccattcattatgtcggtattctttttcattgcaggtttcgggttcgtattcggatggtcgttcttctatattccaggactgatcggtgtggcaatttgtatgatttgccgttcgttcttctcctatgatggcgactactatatccctgcggatgaagtaaaacgcacggaagcggcaataagggggtctgtataatggcacaagctgcagcacaccaaagccatgatcatgaccacgggcatcacgatccgcaagaattgaagatgcttggtttttggatcttcctcgtaacggacgtaatcctgttcagtaccttgttcgcaaccttcgtcgtccttcggaacaacacagccggaggaccgggtggcgcagagctgtttaacatgacgggcgttattattgaaacgttcctcttgctcacgagcagcttcacaagtggtctggctgtgttggccatgaacaaaggaagcatgaagggattaattaactggttaatcgtgacggcgatcctgggtcttggttttatcggttttgaggtttacgagtttgttgagttggtacacgaaggagccaattttggaaccagtgcgttcttatcggcattcttcactttagtcggaacgcacggacttcacgtttcgttaggtctggtttggatgattggactcatgttccagttgaaaaaacgcgggcttacaccagagacgaagggaaaagtttcggcattgagcttgtactggcactttttggacgctgtctggatcttcttgctgacagtcgtctatttgatgggggtgatgtagatggcacagcatcaaacaggagcgggttcgcatggtcatgatgattctcacggttcagtgaaatcctatgttatcgggtttattctgtccatcgtactgaccatcattcctctcggtgtggttatgaatcatatgttgagccgcacttcgaccatggttgttattttagccgcggcagtgctgcaatttctggttcagcttttcttcttcatgcacattcgtgaaagcaatggaccacgctggaatgtcatgactttgattttcggggtagttatcctgttgaccgttgttggtggttctgtatggattatggaatacaacatggtagcacactaataagtaggatttttcaaaatcactcaagtataagcgaattaggaaagagaagaagcggacttagagccgcttcttctttttttgtgtagcttattaaaataaaaactgtggcttcttgaactcaagtttacatatgtgtaaaatggaattgtataacagtagagtgaaaacgataatactagtggagagcggaggaaaaagtaatgaacacagaattactgtttaaaccttttaagttaggtaatttatctcttcccaatcggattgttatggcgccaatgacacggaatttttctcctcaaggtattccagggcctgacgtggccgcgtattatcgtcgccgtgccgaaaatgcagtaggattgattattacagagggaactgctattaatcatcccgcagctgtggagcacacaagcattcctaatttttatggtgagggattaaaggggtgggccaaggtagttgaggaggttcatgcggtaggtggcaagattataccgcagctctggcatgtgggtacggcccgtaaaataggtgcagataatcaaccgaatcccgaggcattgcctgtcggtccatccggtatctctcccgccggcgaaaaggtggttgagccattgacggaggctgagattgcggatattatttcagcttatgcacaggccgctgccgatgcccagcgagtgggttttgacggcattgagcttcatggagcacatggctatttaatcgatcaatttttctgggacaaaaccaataagcgcaccgaccaatacggaggcaacttggtccagcgtactcggtttgcggtggaggtcattgaggcttgtcgtcgtgcagtagggccgaatttcccaattgtattgcgattctcccagtggaagatgtaccattatgaagaaaagctggcccaaacaccacaggaacttgaacagtttctcactccattagtgaaggccggggtggatgtattccattgctcaagccgccgtttttgggaaccggaatttgaagggtctgatctaaatttggcagcttggaccaaaaagataacaggcaagccagtgattactgtgggctcgattggtttagagaaggcctttttgagtgattttgaaaataataatcgtcaaaccgatcaatccagtaatgtagagacaagattagaacaactcgtggggcaagtagaacgagaggaagctgatctggttgcggttgggcgtgctttgctggttgatccagcgtttgcggtgaagttacgtgatcaacaaatagatgaaattattccttacagtgatgaagtattaaaaacgttgaattaagctttattaggctctaagtattgtaaagctatagtgttaggcaaacattgtgacttggaagttttctgttacagggcaagctgtaatataagctattcgtaaactctacgaatttgctataataggagcatcaagtcgaaatacacggggtgaaaaggatgaattctgaaacggaagctttggattgcgagccggcttgtcacggttcagatcaggaaattgagcgcataaaatcttcccttgttgaggattccatcgcatacaaaatgtcggagctgttcaaagcactgggtgacccgacacgaatcaagctgatttatgccctggcacaaaaagaactgtgtgttcatgatctgacccaggtgttgaacatgggacaatctgcggtatcccaccagcttcgttatttgcgcaacctgcgtattgtcaaacgacgcaaagaaggcaagacggtgttttattcactggatgataatcatgtggagcagatctttttgcaaacccatcagcacatatcacatcaataattttgggataaaacaacagagggcgccaagcgattggcgctcttttggcgttcgtccgttgaagtcgatttttttgttaaaaagggctagagtcattgacttttgaccctgatcctgaatataatggccttaacaaataatatatgaacagttgctcatatatagttaattggaggccaatgactatggatgctctaaaaagaacggaacggcatgaatggattttggaaggtttggattgcgccaactgtgctctcaagattgaaaatggtgtcagtaaaatagaaggggtcatggattgctcggtcaattttgttacgaaaacgttgacgatgaccacaagttcggatcaaaaggaagaggtttttcgccagactgaacggaaggttcacagacttgagccacatgttcggatggtggtaaaaagtgctcgtggacgcctgcgtgaagacagtcgaagcaatgctggtgcagtacagtcggattgcacagaggattgtgcatgcggtcatgagcataatggtgaaggtgaagggcatacacacgaggttgggcaacatgcttctcacagccacgctggtcatcatcatgaagcacatgataagcaagcccgcacgcacgatggacacgaccacggcgatcatgcacacgagcatcacaaccaccatgcagagcacgaacatggtgaagccacccagactcattcacattcgcatggagatgatagccacgctgggcatacgcatgatcacggtacggacggtatgcgccgcatgattacgcgtttagctattggtgcggtcgttgcggctgttgcctggtggttacctgtcgaaggtgtaggcaagctggccctatttttactggcatatatcatcgttggtggtgatgttgtcttgcaggctgcacgcagtttggtacgtggaatggcctttgacgagtacttcctgatgacgctggctacagttggtgcatttgcgattggggaatacccggaaggcgtagctgtcatgttcttttatcaaatcggggagctgtttcaaggcattgcagttaaccgttcacgtaaatccatcagtgatctgatggatattagaccggactatgccaacctgaagacggctgagtccgtacggagagtgtccccagaagacgttcgcattggggatttgattgtaattaagccgggcgagaagatcccgctggatggtaaagttatagatggtaaatcgcatgtggatacctctgcgttgactggtgaatccgtgcctcgtaccgtagagccgggaagcaacgtgttgagtggatttatcaatacgaacggacttctaacggtagaggttagcaaagaatttagtgaatcggcggtctcgaaaattttggaattagtgcaaaatgcgagtgccaaaaaagcgccgactgaaaagtttatcacgaaattttccagatactatactccagtagtggttattgtagcgctgttgttggcggttgttccaccgcttgttgtgccagatgcacaatttgcagattgggtataccgtgcgcttgttttcctcgttatttcttgtccttgtgcgctggtagtatccattccactaggcttctttgggggaattggggcagcctcccgttcaggtgtcctgatcaagggcgggaactatcttgaagctctgaatcatgtgaaatacgctgtttttgataaaacaggcacactcaccaaaggtgttttccgtgtaacagggatttatcctgccggagattttacaaacgaaaccctgctcgaaaccgccgctttggccgagctgcattccacacatcctattgctgcgtctctgcgtgaatcctacggtaaagaactcagagcagaacgggttcagcaatatagtgaaatatccggtcacgggattcaggcacaaattgatggtcgtctggtatcagccgggaacgccaagctgatggaacgggagcatgtggcttttaacgtggcgcagcaagcagggacgctggatgaaggaacggtcgtacatgtggctgtagacggaacgtatgccgggtgcattctgatttcagatgaggttaaggaagacgcagcccaaacggttgcttcactgaaaaagttgggtgtggtgaaaaccatcatgctgacgggtgacaatcggacagttgccgaggccgtaggacgacagctgggtttggatgaagtacgggcagagctgttacctcagcacaaagccgaagccatcgagcagttgtctgtaagtaaaaaaacgagcgacaaaattttgttcgtaggcgatgggattaatgatacacccgtactggcgctggcagatgtcggtgtagcgatgggcggtttgggatcggatgctgcgattgaggcggcagatatcgtaatcatgaacgacgagccttcaaggctggttacggcgatccatatcgccaagcgcacacgtcgtatcgtatggcaaaacattatatttgcgctaggtgtcaaagctgtgtttcttacgctgggagcattcggtattgctacgatgtgggaggctgtattttccgatgtaggtgtaacattgctagctgtattgaatgtgatgcgtgtattgaaggttcgttcttacgagtaaaaaaataaacacccccgggttaacatcggatgtaggtgaagtgcaccccttagaatggacattggaataaacccctggtttatccgatgaaatctagggggtgcattttttatgccagcgaaaaaaggaacaaagtttaacgaatatacgtttgaaaccaaggtagaggccatacggctccatatcaaagaaggttggacatatcgtaggctcatggagaagtttgggatcgcagatcgacatcgattaaaagaatggatgcgcaaatacaagcagctcggtgaattcggactgatggaccagcgaggacggcgtaaggagtatatcgaccaggataggtatatacagaagctaaaacgagaaaacgacatgctaaaaaagtgtttggaaatctggatacaggagatgaagcacacaaatacgtaaccattgagaaagctgcgaaagactaccctattagcaaactgtgtacgcttttcaaagtctccagaagtggatattacgccttcttaaaacggagaggaactgatcgggatcaggacgcgaaagctcttgtgaagaaagtgtatgagcagtataacggagtctacggctatcgccaaattcaactatttttgcagcacgatcatggagtctggatgaaccataaaaaggtactccggctcatgcaggtcttggggatccgctcacaaattcgccggaagcatcgctgtaactatgcttcttctacagaaggtcgtgtggcgaaaaatctgctaaaacaggatttcaaggcggccaaacctaaccaaaaatgggtcacagatatcacgcaatatcgtgtgggggattgctggctatatctgtctgcgattaaagacttgttcaataacgaaattatcgcgtaccagatgagccatagaaatgataacgaactggttttacagacatttcgacaagcctggaaacagcaaaaagacgtgactggcctcatcgttcacagcgaccagggattccagtacacgtcccatgcgtaccacgacatgctgccaaaggttggcgcccgaatcagcatgtctcgccgaggcaattgttatgataatgcctcgatggagagcttcttctcgcatctcaaaacggaagggctctacccatatgatatccgaaatatggacgaggcacaaaggagaataaaagaatatatccaattttacaaccagtgtcgaccacaacgaaagttaaataagctgcctccgaatgagtatcggaagcagcttatagcctagggtcttttttcagtgtctataaaatggggtcttgaccataggcatcctgtgaagaccgggggtgtttattttataggttcctttttcgagtggtcttgtaccagcaggatagagatttattttgggatgtagggtagttgtgccgaaatgtataaatgtgtggcgtgcctaatacgttaaggtaggggctttacaagtaaggcccatgtaagattcggttgctccattatgggtaagcattttctttgtttggaggggtactcgaattcgtgtgtgccaacttgctgacggaagaaaggatggattaatagcatggaggctaaactgatgcatgtattcgcagagctgttgggtggcaaaaatagccgggatctcaaagttccagagccgggtatggaggctgctgcacagaggttggctatggagacgctaaaggcaggcagccatgaagtatctgctacgcaggaggaagatccgttgggctggctggttggtttagctgagcagggcgtaatcagtcgagcggaggctttgatggctgcgaatctggaattacttggggaaacgatgatgaataacggcaacgatattgggcaagcaatgggcacactcctaaaatggagcgatgaatacaggcgcacctccatacggatttatgccgatgctcctgcaagtttgagtcgtataagcacagagacagcatcagaaataggcagttatgacggttatagtcttctgcatggtcccttgtcacaggcatctggccgtgtagggaaactatgctatgcctatctggacgtagcagagtctggacagacgattcatgcccctgacagggagcctgatcccatccttattcccggttcacgtgcatctgacacgtacaaaacctttaaccaggcatctggcctgcctggattgtgtgagcatttgtcccgtcgaattatcagtttgctggaaacacaatatgaaagcttattcgagtctttgaacggatcaccactcactatagccctaattgagcagaacaatgcggtgggtattggaagcttgcaagatatgcagctggaggcattactgcgtgcggcgttgcggagcgtgcggcaggggggagaacccaagctggagattatagtgcgcaatccggctgacgtggacgaattccgggcagcgcgagactggattgacggcgttgcagagcagactttatgcgggcgtcttcggtgcattccatatcgggtaggcgtgcttttgacagttgaaccgtctttggtgcctaacgtaagccaaacagggaacaggcaagccgcacggtcgggggagtcagcccattccaataacatgtccgaagtgagcgcacggcagatcaagcaggtggctcaagctgcagatctggcacgttttgccgatacggtcattttagaagtcataccaactccatccgatgacattagggctgaggagcagttgattccatccggtgtcgatggtcatgagaataatagtgatacgataaaatgcataatggaagcggttcgacgtgtaaagcctgagcttcctttatgggtagcaatagatgaaattaaccattctctggataggatttcgatctgggagaatgagctgacgggggtcgtttgcccggacacagcggttcccactgcacgccttgcggctgcgcgtctgggactgcaacagcccgcagatcgtcagcacacttcaggaactgcacacaatcatgcgtggaagtttcctttagcctgaagataaccggaattcttgtaatagaggattttgcaaaaatccaataagcgactttcaatgaacaatatatagatcgaaatggtctagttcgtctatatattgcactttggagcgactggaatcgaattttgcaaatcctgaataggatgctttaaatatggaggatacctgcggtgtttgcgcgggtatctttttttatttagggcattgctggtttacaagtggaaaagaaaaggtatataataaaacaaaagtttctataatccaaaataattgtatagatgcaaaaatgattatcattctcattgtcaaacatgctgcttcggacttcccgaagcagcatgtgctattttagggcacttaacaatggatatcattctcaatgaaatgctagtacaaggacaaaatatggaaaggaacgtgacatgatgcaagctgctcaacgattacaagatacattgtctccctctaaccgaaccctttcaaaaaacagtggcagcggacgacccggtccgaatcgcaagccgcaatttcagcttaaaagcatgctgaaaaataaggagatgcaagctgctctaggtagtggattgctgatgctgatggcatggggagtctcccattggtggcaatggctatcggtcattctgtatgtagtgtcctatgcccttgggggctggtccaaagccagagaaggggtcgaaacactgatccgagaacatgatctggatgttaatctgctcatgatcgctgcctccctaggagctgcggccattggctattggaatgaaggagccatgctgatctttatttttgcactcagcggtgcgctggagagctataccaccgagcgtagtagtaaggatatttctgagcttatggcgttgaagccggaaacggctttacgcttgtctcgcgaggggacggaaacagtcggcattgaacagctgttgccaggcgacctgctgctggtgaagccgggcgaactgattccggcggacggccgaatctccaagggcgtttcggcagtgaatcaggcatcgattaccggggagtctgttccggtaaataaggtggaaggtgacgaagtatatgcgggcaccattaatggagaaggcgtgctatatgtagaggttagtcagtcctcggaggacactttattttcaaaaatcattcgtatggtggaagaggctcagaccgaagttcctgattcccagcggtttattaaaacgttcgaatcggtgtacgctcgaattgttgttgctgtcacgctgatggtcattgtcggtgcacccatcgcattaggctggacgtgggcagcagcgttctacaaggctatggtgttcctcgtcgtggcctcaccctgtgcgctcgtgtcatccattatgccagtgatgctatcggccatttccaaccgtgctcgacggggcatcctgttcaaaggtggagcacatgtggagaatatggcattgacttctgttgttgcttttgacaaaacaggcacgttaacgatggggtcacctgtcgtcacggattggattaccgccgcagaatacgatgccgatgagctattgcagattgttgccacaattgaaagttattctttgcatccgctggcgcgagcgattgtagccaaagctcaagctgaatggggacagagagatcctctcccaaccgagcaagtacaggcactcactggatgggggatggaaggcatcataggcggggtgaaatggaaaatcggtcgcacagatgtgctggatggacctagtcctctggcagagccagagtggatggagagtcgggcccggctggaagctgagggcaaaaccgtatccatcatcctcgcggatgatcggattgctggaatgctggcactacgcgatgagttgcgtccgcaggctcaagagtccgtgaaacgcctgcaagcgcagggtatccgggttgtcatgctaaccggagaccgtccagaaacggccgctgtgatcgcggagcaggccggagtcgacgctgtatatgctggcttaatgccggaggacaaagtcagccatattcgcatgctgcgggagcagtacgggcatgtcgtcatggtcggcgacggtgtgaacgacgctcctgcgttgacagcagcaaccgtagggctaggcatggggatgcatggcagcggagcagcgctagaggtcgcagacgtggtactgatgaacgatggaatcgaggagatcgctccgacgatagcactggcgcgcaaggcgcagcgggtggtcaaacaaaatatgatcttcgcggtaagtgttattttcctgcttgtgatcagcaactttgtgcaggatatagccttgccatttggggttattgggcatgaaggcagcacaatactggtcattttgaatggcctgcgcttattgcggtcataggactaataattacaagacgacaaacaggaaggagcattcatacctcttaaaatccaagggggtgaatgctccttcttttgcagcctcgcaacgctgtacgtctatcttcggcgcggcgtagatcgtcgtaaaaacagggaaaacaatagccccgccagcgcaatccctgtagcaatgatgaaggcatcattaatgccatggatcgtcgattctgtaacggcacttcggtacacctgttgtagcgccaacgatgaaccactttctgttgaaatgcccgccgtttgcgcgagggtttgtcccaactgtgctaccccttcggttaaaggaacattggcggtggtagcgacattcgcataatccgctacatgaattgtcgttcggctgctcattacagtaatgagccaagcggtaccgatagacccggcgatttgccgtactgtattggacatggctgtaccgtggctaccgagatgggcaggtaattggtttagcccttccgtctggacggacatcatcagcaatgacattccgaagctgcgaatcgtatagatgatcataatatgtccataggtggtggcatcggtcagcagactgaattcccaggttgtgactgctgtaataatcagtccaatgatcgccaacggccttgcgcctacacggtcaaatactgcccctgatatcggtgacatcacacccatcagcagtgcacccggcaacagcagcagaccggattgcagcggtgtaaagccgcgtatattttgcaaatagatcggtagcagcagcatcccgccaaacatcgtcatattgacggtagccccaactaaggtcgatacggtaaaaatatcatatttaaacacacggaactccagcatcggctgtaccatattcagctcgcgcacgataaacaatacaataaacacaaccccggcagcgagtgtaagtattaccgtattgctgtcccagcccttgtctccagctgaactaaagccatacagcaggaagccaaagcccaatgtggaaaagatggttcccaacaggtcaaagttcggtttcgttagcttggatacatttttgagccagcgtatggcaaacagaatatcaatgattgccaacggaatcaccagcaaaaatagcagtctccaactatagtgctccacaatccaaccggataaagtcggtccaaccgccggggcaaacatcatggcaatccccatggtccccatagcagcgcctcgtttttcggggggaaacacagtcaggaacacgttcatgaccacaggcatgataatgcccgctccgctggcctgaataacgcgtccaaccagcataggcgcaaagccggtactggcagcacagacgacagacccggccgtaaataaccccatcgcggagatgaatagcgcacgtgttccgaatgactcaatcagaaaagcagtgataggaatcaaaatcccgttagttagcatatatccggtggatagccattgaacggtcgtggcagacacattgaagtcattcatcaaatgtggaatggccacgttgagcagcgtttgattcaaaatcgaaatgaaggcgcctagcagcagcacggacagaatacgtccgacggacattttttgatccatgacagcctcctacttgtgaactctgatggtcgcactcattcccgggataatacccagccctttgtaaccttgaatggaaatattgacaggcacgacctgtgtcaccttggtatagttggcagtggtgttagaagtgggcagtagtgaaaaagttgatgcggtcgccaggccgatcttttcgagtttaccgctcagggacgtatccgggtatgcatcaatatatacatctaccgtctgtcctacttgaagatcctgtacagccgtttcgtcaatattggcggtaatccataaattatttagatcaaaagccttcgctaagggtgtgcctgccccaacaatcgagttgttgactgcagattgctgtacgatggtaccatcggttggaatcgtaacgctaattcggcttcctcccccttctacattaccaagcgtgcttccagcggtgtaggtcttaccaacttcagcattccagcctgtgagtttgccagcgcctggagaggcaacggtaactgcttgtccgctcacttgggcattatcggtttttatgtagttggcggattgattgtagtaataggcggcggctccaccacctgccagaataatgataataactagcaggttgactaatatggcgcgtgaattcatgtttacatgcctccctagtttttggattttcaaagtatgcgtcaaatgattcataatattcagatgggttttgggcaaggttaagagcgcatgcgaaaaagatgattttgctgacaaaggatgatgcgcataatgacgaccagaatcatgattgtatatgacagtgaaaatgggcataccgaacgtctcgctcgctcgatcgcagaaggagcacaccttgagcatacggaagtgttgttaaagcatgtgaatgaggccgatgtgaatgagctagtgagtgtggatgccattatatggggttgtccgggccattttggtaccatcagcagcggtctgaaaagctggattgataagctggggtatctgtgggcacagggcaagctggtggataaaatcggcgctgtgttttgcacaacagctaccgttcatggtggattggaatctacgcttctgaatttgattactccgatgcttcatcaaggcatgattattgtaggactgcccgctaatattacggaaaatgcattatacggctcctattacggcgtaggggtaacatgtccagtggagacagaccccaatggtccgcctaatcttccaacgggtgatgatcttgcactaggtcgttctttgggcaaacgggtcgctgagatagcgggacggtaccgtagcgctgaaagagaataggaggctaccgatgaccattgcttttatcgtagtagctgcggttgcctttatttttttgctggtatttaatacaaagatgacgcgcaaatcctctcccaaaactcgccccacggaagaggagtcacgtcaaagaagcaaacgtccttatcctgtacaggtggaacccgaggcacgtgaaaggatagattctacgcgagagatgccgcataaggatatcgacgtcgaagaacgtcatgcggaggaacaacacaaggtgcctgatatccagacggataagaaggtagaaaaggatcgcgagaacatcaaggatgcttacggagatcaggattatcgtgcggctttacgtggttttgccaggaaggacgaagaaaaggatggacgttcccaaatatccaagggagagaaggagactcacaaaagtgaggacgagcagtatcgtgaagcactgcgctccatgaaccaaaaaaaatgaggtatctccatgtgaacatactaaaaaggctgcttatctgtctggtttacaggcagacggcagcctttttgtgttgctcggctatagccactcggttagcccaatcatcgtaattaagccgagaataaaagagaatgtggcgatccgctggttgccatccccgtgactctcgggaatcaattccttgtagacaataaacatcatggctccggcggcaaaagcaaggccgtaaggtaccagtccgttcacccagctgctcaaataaaacccgatcagactcgtaatgatttccacggctccggtgagggtagcaatgcccaaggccttgaaacggccgatattttgattcacaaggaacaacgctacgataaagccttccggggcattttgcaggccgatagagaaggcgatcagattgccgagattttgagtttcacttgcatagctgaccccaacagagagtccttctggcaaattgtgcaatgtaatagctgcgataatgagaaaagatttggactccagttgaaaggtcttggagtctgggtcctccaaatccgcatggggaatgtacatttccatcaccagtaatacgagacagccgagcaggattcccgcagtcagcacgaaccaattggaatgctggattgcttcgggaatgaggttatacacggatgcagaggtcataattcctgcggcataagccaacagaacatcgcgaagtcgatgcgtgatattgcgcataaacagtatgggcacggcgccgagtccagtggacagggcagaaataaagctacctaaaaaaacgtcattcataatcgggataatccctccatacctgatttatctttatacttcgcttcatgaaaacttcatttgactgtttacagctatttccgcataatgaaattaggatttagaatcagtctaagtcataagaggctacaaaacaagtgattcgtttttgcaatatccgggtgtccacattttgggataagcttctggtggaattacttttagagtatatgcagctgcccagcgcccggtgccgaaaactcgttatataatacttatgatattttaggaggaaccaagatatgtacaagtccattattataggtaccggccctgccggtttgaccgctgcaatttatctggcacgcgctaacatgagcccactggtgatcgaaggaccacagccaggcggacaattaactacgactacggaagtcgaaaatttcccaggttttcctgaaggaatcatgggacccgatttgatggataatatgcgtaagcaagcggagcgttttggcgctgaattccgcacaggctgggtaaacaaagtagacacaacggctcgtccatttacattggatgtagaaggtttgggtgaactggttactgatacgctgattatttccacaggggcgactgccaaatatctgggtattcccggtgaacaggataatatcggacgtggcgtaagcacttgcgcaacatgcgacggcttctttttccgtggcaaagaaattgttgtcatcggcggtggagactctgcattggaagaagccaatttcctgactcgttttgcttccaaagtaacgttggtgcatcgtcgtgaagaaatgcgcgcctccaaaattatgcaggatcgtgctcgtgcgaacaacaaaattgaatgggcgcttaatcgtactcctgtagaagtgattgcggacgagaatggagtcactggcttgaaagtactgaataatgcaacaggtgaagaggaaatcattacagttagcggcgtattcgtggcgattggtcatcatccgaatacgggcttccttgagggacaaattacaacggatgcgaacggttatatcgtcgtaaatccgggtacttccgaaacaaacgtgcctggcgtattcgcttgtggtgacgtacaggatactcgctacagacaagcgattaccgcagcaggtagtggctgcatggctgctatggacagcgagaagtacatcgaaagcctggagcacagcgcactggccctgtaatgatccttggaaatatgaataaatatgttgtaacaaaataaatgatgaggtgatattcatggaaaaagcaatagtatacacatctacaaactgcccgcattgccgtcaagtaaaaagctatttgagtgaaaaaggtgtagagtacgaagaacgcaacattgaaaccaatgaagcttttgcacaagaggtttgggatatgggcattcgtgccgttccattgactttgatcggagaagaacgtatttccggtatgaacaaaaccaagtttgaaaaagtattgaacgcttaatccaacctaagagcagacgacggtcctgtggatcgttatagggtatagataaggcctccatcgcagttacatactgcggagggggcctttttatagtccctaatcttttttataggattttgcaaaattccgagaaaagtgggcgtacaggaacctaagtgttcccgtacgatttttcttctataaagacacgcgtactcgccccagaaaaggagctgttgctgcataggcggcacctagcatcgtcgaacggctgccaagcgtggagaaacgaatctgtagttgccgacggtgatagggcagggcacgttcgtcaatcacatcacgcatgctttgctccaaccaaggtctggcttccgccagtggaccgccgatgataagcattccggggttgaggctgttcacaatgttggtaatacccacacccaaatatcgcccaatatcatcaaggacgcttaatgtacttgcttcaccttgctgagcaaatggcagtaattccgctgtattctgtgcaggcagtttcaatgtggatgctacatacgccttctctgaagcatagagttcccagcagccgcgactaccgcaggagcagagtcgtccgttccaatcaatggtcatatgacccgtctctccggcgtacccccaagctccttgatacggtttgccatcaatgataatcccggccccgatcccggaccccgcactgatgtaaaccagatcccgcacctgctgtcggtgatcgccgtccatcccatagtacaactcgccctgtgcgccgacgttagcttcgttatccactacgacgggcagacctagctcggtctcaagttgctgccgcagcggaacctcttcccagcccagattgggtgcgaacaaaacggttccggtttcatccaccatacccggcacccccagcccaatgccgacaataccgtgaggggagggaggagtggcctgcatgagctcctgaacgagctttcgaatctgttccataacaaaggcgggatcatgctgagtaagggaaagggtaagctcagtttcaatggtacctgccagatcagtcagagcgcccttgatgtactgtacgctcacctcaataccgagtacaaagcctgcacggctgttgaacagcagcattaaaggcttacgcccgccgctggattcccctaatcccgtctcatatacaagtccatcggtgatgagctctgccaccagattggaaacggtagccttgtttaatccagtttgactggataactgtgcccgggatagcggagcatgaaggcgaatacgctccagcacaatggatttatttagctttttgacaagcgcctgatcgccagtgacattcatggttaattcacttcctgttggtgtaattcctgatattatatcataaaaacaaacttagtttaagcaatagacaaagtctttcggctatgctagaatcgtttttgtaaacgtttactacaaaggaggaacttataatggcttatttcgaacaggtatctaaaattaactttgagggcaagcaatccgacaatccttttgcgttcaaattttataatccacaggaaattgtagcgggaaaaacgatggaggagcatttgcgttttagcatggcctattggcatacactggttgcaggcggctccgatccttttggtgtagaaacagcggaacgtccatggtccaagtttaccgggctggatttggcaaaggcacgtgtggaggctgcctttgagctgctggataagctgaatttaccttattttgcttttcatgatgtagatattgcaccagaaggcgcgtcattgaaggaattttacagcaatctggataccatcgtggatctaattgaggaacatatgaaagctacagggaaaaaactgctgtggaacacggcaaacatgtttagccatccacgttatttgcatggggctgcgtcgacttgcaatgcagatgtatacgcacacgcagctgctcagattaaaaaaggactggaagtgggcaaacgtctgggcgcagataactatgttttctggggaggccgtgaaggctacgaaacactgctgaacacggatttgaagctggagcaggacaatttgggacgtatgttccatatggccgtagactatgcgcgtgaaatcggctttgacgctcagttcctgattgagccaaaaccgaaggagccaacgaagcatcagtatgattttgatgcggcgacgacgattgccttcctgcaaaaatatgacctggatcagcatttcaagcttaatctggaagctaatcatgcaactttggcgggtcatacttttgatcatgaagtacgtgtagcacggattaacggcatgctgggatcactggatgcaaatcagggagatttgctgctgggctgggatacggacgaattcccggttgatctgtatgatgccacactaaccatgtatgaagtgctgcaaaatgaaggcttgggccgtggcggtatcaactttgatgccaaggtgcgcagagcatcatttgagccggaagacttgttccttgcgcacatcgcaggtatggatacgtatgcgaaggggttgaaggtagctgccaaactgatcgaggatcgtgtgtttgaagactttattgagaagcgctacagcagctttaaggaaggtattggagcagacatcgtatctggaaaagcaacgcttgcttctctggctgaatatgctttggcgaacgaagcaccacgtaaaaacgtatccggtcgtcaggaatatctgaaagcaacattaaatcaatacattttggctgactaataccaggacttatatatgaaacaacggctgcacgatcacaaggaaggaggaactccaatgcaggagaagctaaatcaggagcaggaacgctatgtcattggcgtagatttgggtaccagtgcggtcaaaacggtgctggttaaccgcaaagggcaggtggcctatgaaacctcccagtcttatccgctccatcagccgaaggcagggcatagcgaacagcaccctgaggactgggtcagtggcacgttagcatcactgaaacagcttgtggagaaggctggaatcggcggcacagatgccgtggacggtattagcttttcgggacagatgcacgggcttgtgctgactgacaaggaaggccaagtgcttcgtccggctattctctggaatgacacgcgtacaacagcacaatgccgtcgtattgaagaaaagctcgggtcggagctgctgaacatcgcacgtaatcgcgcgctggaaggcttcacgctgcccaagctgctgtgggtacaggagcatgagccagacgtgctggcccgtgcggcacattttatgctgcccaaggattatgtgcgctactgtctgacaggagagctggcgacggagtattcggatgcggcgggcacgctgctgctggatattgcgaacaagcagtggagcgaagagatcgctgccgcgtttgacctaccgttgtcgctgttcccgccgctggtggaatcctttgatcagacgggtacgctactgccggagattgcggagcagagcgggctttcgcctgaaacgaaggtctttgcaggtggtgccgacaacgcatgtggcgcgattggcgctggcattttgagcgaaggccgcaccctgtgcagcatcggcacctcaggggttgtactttcctatgaggagcgcaaggatattgatgtgcagggacgggcacatttttttaatcatagtgagcaggatgcttattatattatgggggttacgctcgcggccggatacagcttgacttggtttaaggatacctttgcaccagagcattcttttgatgcactgttggcagatgtgaactctattgaaccaggcagccgagggctgctgttcacgccttatatcgtcggcgagcgtacacctcatccagatgcaaccattcgaggtagctttatcgggatggatgcggggcataagcttgcgcattttacacgggcagtactggagggaattacgttttcgctcaaggaatccattgatattctcagaggaacgggcaaaatggtgaatgaagtgatttccatcggcggcggtgcgcgtaatgaggcatggctgcaaatgcaggcagatatttttaacgcggatatcattaagctggaaagcgaacagggacctgccttgggagcggccatgctggctgcttatggtagcggctggtttgaatctctgcaagcgtgcgctgaagcttttctgcgtgaagcagcgagatattccccgaacccagaacgtgtggcacagtatgaaggcctatacgagctgtaccgtgaagtttacttgcacacgcgagagctaagtgagcatttggcagtatatcggtgaatacggtgagctttaagcgtaaataagaagcggcttcgggtgtaagaaacccccggagccgctttttcatgtgatgatgagcatgaattaaatacttttcttgattttcgcatgatcttcattcatagaacttacggcacagccaggacatgacttgctcgacgaacaccccgcacaggcgccttgacggctttttcgcaaaaatcgtaccagcacccacgcactataaccgaggatcgccaataaaatgatgatattgatcatggaattcacttccttttatttactattgggcctgacttaaccccaacctaataatctgccacattgatagatcaagacggcgatgatatatgcgacggtcaaaggatagatcacagaaaatgcggtccaacgccacgaaagggtttctttacgaatgacggctaccgtagccagacacggaacatacaacagaatgaacaccataaagctaaaggaggcaagcggtgtaaaggcctgtctgacttgtagttccagtccctgcatatcaggaacgtggtaaataatattcatcgttgatacgacgacttccttggccataaagcctgtgagcagggaagcacctgcttgccaggtgccaaaaccgagaggggccagtaatggagcgaaccaacctccaacggtggcaagcagactgtcattcatttctgccccgaagccctgcggaccgaaattggacaagagccagatgccaacggaacctgcaagaataatggttccggctttacggacgaagcctttgaccttctcccatgtgctgcggaatagtgtaagagcctgcggcactcgatagggaggaagttccacgatgaagagggagggctcacccgacaaaatggatactttggaaaaaattttggcaagtataagtgaaacgatgattcctaacacatacatcagcatgatgatgcttgccgcatgtgttggaaaaaacacacccgcaaacaacgcatataccggcaggcgggctgaacacgacataaagggcaccagcaacgtggtaatgagacgttctctgggctgttcaatggtgcgtgccgccataatcgcagggacattgcagccaaatccgatgatgaagggaatgaagcttttcccgttcaagccaacggcttgcatcaggcgatccatgagtatcgtgacccgtgccatataaccagagtcttcaatcacagaaattatcagaaataaaatagcaatttgaggcagaaaaacaagcacacccccgactccagccacgatgccatccacgactaggctttgcgtaaaagcggacgcattcaagtgaacgagtaattcagaaatccaagtgctgagtgtccctgaaaaaaatccatccagcatatctgaaaggatcgtacccgcccaatcgaaggtgaacttgaaggtagcgtacattagcagcaaaaagatcggaatccccagataccggtgagttaatagtgcatccagtctatccgtcaggctgtgcggtctgagtttggaggtgtcgagtgccttggtacacagatcagcaatccatgctgttcgtacagaacgaatatgctgagcaggcgtgatggcatagccttcactgagcaggtcttcttcgcaacggcgaatacgcgcagttacttgttcacgctgcacctcatccgtcatccattccatgacgacagggttgttttccagacattgcagtgcggcccatcggagttgcggtacagatgcatccggcagtgagttgcaaatatcatgaatagccgcttcgactgctgggccgtaatccagttgaaaagtattggatgcatgtcttacttctcgaagagatgcgagcatttgcttacttccactacctgtgcgcgccaccataggaatgatgggaacgttcaattgatcagctaacaattccttgtttacacgaagacccgtggcatcagctacgtcagtcatgtttaagccaagtacaagcggacggccatactccagtagttgtacggtcagatagagattacgctggagctgggaggcatccacaatgttgatcagggccgtaggaggttcttccagcaaatatcgagttgcgacaccttcatccagcgaaagagggagtaaagagtaggcgcccggcaaatccaccaatacggcagacttgtcacgcaggatgcctgttttcttttccactgtgacgccggaccagtttcctacttctgcatacgtacgagtcagcttgttaaataatgaggtttttcctgtgttgggattaccgaatagagcgatcatgtccatgttggaacaacctccagttgtttcacctgattttggcgaaggccgaccagctggccgttgcattcaatgacaataggaccgcccaataaactgattttttttaaccgtatgatggaaccttcgttaatgcccatgtctgttaagcggcggcgcaatgagggatgaagaggggcgagagattgcaaacgcacagtctgacccagtggcgtacgaaggagtgagatacattctggcatggtgctcagcctttctgatctagaatgagaatcaatatcatttacttccgatgccagtaccatatcatgaggaaatctagattgctgtgataaaactctctacgaacgacatgtttgctcattatccgatctgttatatagccgagtatgatgtcacaacctgtcttgaactgcacccttactcgtctgcaaccgacaaaactagagcgtttggggcaactgtttttatggtaagatatagctgtttacaactatgctaagaagggcaggaacgctctgtatgaacagaaaaatcggggttaggcttgtaaaatgtctggttgcgggtgcagcgctggctgtgttgctgccgcaggctgtggagtggggcagcaatgtgtatgcgacgtcggttaagccggctccatccgtatcatcgcagcagcttcagaacaagcttttacaggcaatggctacgcggagtgaaacgctgacctttacatatcaagggcgagtgaacggtctcaagcagcaattacagacggccatccaacaggccatggagagcgatccgtatgtgaattatacgatcaaaagctacgcattcagctatacaggcacaacgacctccgctcaggttacgattcgtctaagctaccgggagacgaaggaacagacagcatatgtggatagcacagttaaagcggtgctgggggatattatgacgaagggaatgacggatcatgagaaggtaaaggccattcatgattggatcgtcgttcgcctgaagtatgatgaagcacagcaaaagtacacagcctatgatggcctgaaaacgggaagcacggtctgtcagggttattcactgctggcctataaaatgctggaacgtgcaggcattacgaaccggattgtggaaggaagagcagggggccagctgcatgcatggaatctggttttattagatggtcgatggtatcacatggatacgacatgggatgatccaaccccggatcgcgcgaacgaggtaagcacttcatattatctgctgacggataccgaaatgcggcgggatcactcatgggttaagccgtatcctcaagcgaatacatcgtatcgggaaaccttatcagcactggtaactgccggaggatcaaaggctgctgtgtatcaaaaactgtacaataccctcgaatatccgctgcaagacggcaagggtctggttaaatcatccgccgacattaaggaacaggtacgtaagattgtaaataagggagggacgacacttacctttgcctatcagggaacggagcgaagtctcaaggaggatttacaatccttatatcaactcggtttgaaatccatttcctatcagattacggatctaggaagtaccggcaatcttcgtgtaaccctgaaatggacctaatcatcttgctgtaaaaagctacattaacaaaggagtattttatttatatgcacaagcgttcctttacctatttgcttggcacgcagaccatgtctaatgcggccgacattctttacattatggcacttgtgtctctggtttttcatgaaacggactccatcttctcttcggtgctcgttccgttgctgcgaatgggagcacagatgatcagcggctttttagcaccgctcattttggcccgattccagcttccttttattttattcgtttctcagttcggacaactggttttcttcgctattctgctgggccacttgtggtcagcgggtacggagccgatatgggtgattgtgtttacgttggtggcagccatgtcctttctggacggctggaccacgcctgcacgtaatgcgctgattccccgccttgcgtccggggaaggactcatgcgggcaaacagtctggtgtcggtcagcgatcagacggtgcaattagcggggtgggggcttagtggtgtgctcgtagccatgctaggctcggaaaaaacactgctagtggctggcggactctatatggtagcaatgatcttcactagcttgattcgagatccactagagggcaaagcccattatttgctgcaacctggaacaagggtgcgaggtggagatgtttcggtttccgaaactggtactgagcccgggcaaggacatcatgacttgcctcctgcacagttggaagatacactgtatggcccggaatcagagagccctgcactacctcccaaacgtaaaaaggaaatactccgtgaaggctggagccttatcggagccagtcgcagactgaaagctcttatttttatggatatgattgaccttctagggggttcggtttgggtaggcgcgttcacgcttgctttcgcccagcaggttttgcacaagagcgaggcatggtggggatacatcaatgcagcgtattttgcaggagcgattggcggcggcatcgttgtcctcgcctgcgtcaagcatttgcagcgcaggctgctgcccgccatgttggcggggatggcaggctacgggctgctgacagcatggtatgcactgaacacattaccgccactgacgctgcttatcgtgttgttgatgggactacctgcggaaatgtctgtcgtatcccgccgcacgatgatgcagatgagtgtgtctgtacatgatttgcccaaggtgctgtctgcccaggccacactgacaagtttgaccttttgtatttcgctcctgttaatgggctggattgcagatcatctaggcatcgttaatttgtacttgttttctgcagtgctgacgctgattgctgttatatacggtgtttttagtcgtcgtgccttatccatgtctttgtcagcttcattggaaccttcctccaaataaacagaaaaagcccgtctccgggcatatacaggtgaaaatgcggataaacggtcttggaccaggcttaccagcgtgttttccctgatatgtggagacgggctttttttactgttttctattatttatccgaagaagcatctggactcaaatcacattcttttaacggaacgattttagtacgtttgatccatttgtagccgagccacagcagaaggaacagcggcacactcatatacgtagcgatcatcgttttccagtcaatctcctgtccggtgaaggcatccgccccttgcccgataatgacaatgatacacagagcgaaggcaaacaacggcccaaacgggaaccagcgggctttgtatggaagctcactcagactgtggccctgtgcagtaaaggcacggcggaaacgataatggctgactgcaatcccgacccacgtaataaacccacacattccagaagcattcagcagccagttatagactacaccgtctccatacagggaggcgagaaaggctagcataccgacagcggtcgtgatcagcagcgcgttcataggaatgccgcgtctattgatacgtccgaggaaacgcggggctttaccttcccgtgccaaagcgtatagtacccgagttgccgcgtacatacccgagttacctgccgacaatacggaagtcaaaataacggcgttcataacagaagcagcaatcgcaagccctgctttttcaaatacgagcgtgaacgggctgaccccgatgtcactgatatctccccgcagcagatttggattggtgtatggaatgatcaacccaatcacgagaatcgcgagaatataaaagaacaggatgcgccaaaagatttgacggatggcgcgcggcacattttcacgtggattttcgctctctccagcggctaccccaatcagctccgttccctgaaaggaaaagcccgctgccatgaatacgcccaatacagcaaagaatccgccatggaacggggcgtctcctaccgtgaagttggcaaagccaaccgcagggccacccataataccgaagatcatcagcacacctacggtcaaaaagatgaccacggtcacaattttaatcatggcgaaccagtattcagactcaccgtagcctttgactgtcaatgcgttcaacgcgaagattacggctaggaataacagactccaccaggcagagtggctttccgggaaccaatatttgatgagcacggtcgctgctgctaattcggcagcaatcgtcaccgcccagttgtaccagaagttccagcccatggcgaaaccaaaagccggatcgacgaagcgacctgcataggtgttaaaagagccggattcaggcataaatgtagccaactcaccgaggctggtcataaggaagtagaccatgaggccaactgctgcataagccagcagcgcaccgccgggtccagcttcggcaaccgcgcctccactggcgaggaacaggcccgtaccgatagagccgccgagggcgatcatcgtcatatggcgggctttgagacttttacgcaaggttgcgtcaggtgttgctttgtgttgcacgttcaaacactccttcatgaaattgtatttcatgtcagggcaagagccagaaggagggggagtatataaatcaaaaaaccgcagggaatacgcctgcggttttgtctatgcattccgcaccataccttcttccataacaagatagctcaacacacgtgtctgtgttaggacagcgtgtgacagttctgctcctttcggttagcagccccagcattcggagtatttacaaagagtcagctccgcatacttcggcgggtgtacctttccactggaatctcagacggctcttatcgtctcctccggtgtactgattacatccgcgacctctacctcatcataaaacagggttgatgaggtgtatgacatgatattttattgtatagcgaactacagtatatcgtacctgtacatcttctgacaatcgacaattttttgaaaatcactcgtagaatcttaaattaagagttccgcttggccatctgctgccaaactgtgcccgcggcttgttcgcctgattcgatgcgttccagcgccattttagcctgcagactaacctcgaattcgggatcatcgaccgccttctccagcgcatcacgtgcatcctcggttccaacctcgtataaaaaacgtgccgctcgccagcgcaccaacttgctgctatccgacagggctccgatcattgcgctggtagcgaccgggtcgccgatgtctgacaacgtgtcgcctgcggtgcggcgtactgccgctgaaggatcgcgcagcgcctcggctagcagatccatcgcctctggtgagcgaatatcgcccagatagacgacgcccagccgccgtagctgcattttgtcgtcatgcagcgcttcccggataagcggcaaatgctcaggcgtcggctccaaccgatccagcgcagcgtagcgtgtgcgccaatcctcgtgctgcagggcttgctccagctcggcatcgctccattcgcggcgttcctccacgaattcgctgttgtttgcgccgtgggcaatcgcctgttggataatctgctccagccgctcttgcggaaaggctgcctccaattcctgctcgacctcgcgtgcaatgtccggcagttcaccgtagcggacgccgtaatcactcagcttgcgttccttgatcagcgttgcactcgctacacgggtaacggcctgcacgaagcggtcggacaaggaaattcgttcctcctgctgccccgccttgactcggatttgcattggaatgccacgaaaaaattgcacaaagacctgtgcctcgccaaatgcttctccagaggtttcctctggcaaatcccaattggcgtcagcgccttcctcgcctagctgatcccggacttgacccagaatggtggaccaatctgcattccctttgcggtcaagggctacgaagtcagtcgtgtgaaacacgcttttgaccccttcaatgcccagcatgcgccggataaatgggggagcggaacgctcattgtcccgtgtatatgttctgcggatacccgcttccagtcgctcatccagatgcagcatcatggtgttcggactgggagtaggctcgatagatgttattttcatagctcagtacagcctcctgttcaaaagttctccatatatagcttatctgtattgtaactcattctgcgaatgtctccaaagataagttcgcgtatacaggaaaaacacaatgacatatctcacactaattcaggtaaacactaaaaagaaatactgctacattcaatgcagaagcagggttaaaactcgatagaatgaaccaaactgtgaataggttaccaaaatgcgccaatagataagtgaaggaggcgttcctatgttccgcaagcaggaaagaacgctcattattgtatgtatagtaattgcggccattatgctatacgccgtaattaaaagcatagctcgcttgactccttagttggtaatccagagtgaactgcgatgtttaaaatgtgaaatgaaggagtgaaacccatttgtcttcactggaccctgtattgctaagccggatgctgaccggaattaccctgtttgttcatatcgtatttgcatccatcggcgtcggcgtacccttaatgattgcactagcagaatggcgcgggctgcgaactggtgatccgcattatacactgctggcccgacggtgggcgcgagggtttgtcattaccgttgccgtgggtgtcgttacaggcacctcgattggtctgcaactcagcttgctttggcccacctttatgcgtgtggctggacaagcgattgcgctgcccttatttttggagacgtttgcttttttcatcgaagctatattcctgggcatctacttgtatacctgggatcggtttaaaagcaaatattttcacctgatgctgctcatcccggtagcgattgcctcgtctgcctcagcggtttttattacaactgtgaactcgttcatgaaccaacctcaaggctttacactcaaaaatggagtcatgacaaatattcatcccatcgaggctatgctaaatccggctacgccaaccaaagtgtcccatgtattggcttcctcgtatacattgagcgctggtgtgctgatggggctggctgcttacagcatgctgcgagggcgtaatcacccttattttaaaaaggcgctgaagctgactgctacctgtaccattgtgtttgccatcagcaccgtgatgattggagacgcatccggtaaatttctggccaaatatcagccggagaagctggccgccgccgaatggcattttgatacgatgacacacgcgcccttcgtatatggcggatacatggataagaacggtgaaatcaagtatgcgctgaaagtgccttatgcacttagtgtgttggctggtaatttgcccagtacggaggttaagggattaaatgactatccggtggaggagcgtccgccgctgtctattcattatatgtttgacctcaagatcaccacaggagtgctgattctcgtcatcccactgctgtatctgatccgcaagcgtttgccaggtcgcaaaccgtaccccagatggctgctgttggcgctcattctggtcgggccgatggcgatggtagctattgagctcggatggatgtttgcggaggttggcagacagccgtggattttacgcggatatatgaaggtgtccgaagcagcaaccacttctacgagtgtcgggtggatgctggtgttgtttgttattttgtatctagtgttgtgtttctcggccattaaggtactcagcaagctattccgcaataaggatgcggtggaagagataaggcagctgggcctggaaggggctgaaggcaagtgagctatgaaattgtaggtatcgccattttgtggacgttcctgttcggatatttgcttgtggcatccattgattttggtgcaggttttttcagcttttacagtgtgttaacaggccaccagaacaaaatccacaatatcattcaacggtatctgtccccggtgtgggaggtaacaaatgtatttctcatcttttttgtggtgggattaaacgggttcttcccggatgcggcatattactatggtacggcgttactcgttcccggcagtattgcgattgtgcttcttgccatccggggagtgtattatgcatacaatacgtatgggcattccggtaaaaataatatcgtctacatggcgttgtacggtgcgacagggttgctgattccggcggcactatccacagttctcgctatttcggagggcggcattattatagaaaacagtacaggtgtacacctgcaatggggtcagctattaagtaatccctacacgtgggcggttattattctggcgctggtgagcgtgctgtatatctcggcgatgtttttggcctattatgccaaaagggcgggagacaaggtcgcttttgaaatcgtacggggatatgcgctgctttggagcggtccaacgattgttgcgagtctgctcgcattttttcagattaacaaacaaaatccagatcattttaccaatatgctgaacatagcctggatgtttgttgcatccttcatatgctttgcgggagcagtttatctggtatggcagcggcggcatctgggggtttcattcatattggtgatgctgcaatttgcatttgcctggtatggctacggccgctcgcatctcccgtatgttctgtatccctacattaatgtctacgacagctttacaaattctacgatggcgtatgcgttgattacggcgtttgttgcgggtctgctggtgctgatcccttcgctgatcctgatattaagattgtttctgttcgatgcaaaatatgtgcgcggacatgaagggaagaaagggtgagttagagtggctgctttcgagcattttacgattatgtacgagtcacctatcattattgtcgtggcgattgtgtttttgtttgtttattcggcacgctttaaaaatccacaggactgacaactacaggtggaacaggccttcctgattgatacgggaggtctgtttttgctgtattatcgcagaatttcctttacagacgtgattgaattatactttacatatatcaggatgttgcatcatttcatgttcacactcgagtgacaatatatagttaaatggaaccgctgtgttttttggagaacgggttcatcagggagggagctgcatcatgcccaaagtacgttttaacaatatggatcatgtaaataccgataaaacaatcaagcaattcagacaatggcggcaggagcgacgcagcaaaataaaggattatacgttcgttgtgccaaaccatcccccggagctggaatttctgcatagcaatcgggagatggcgacagccacctgggtgggacattccacctttttcatccagtatcttgggctgaatatcgtcaccgatccggtatgggcagagcgtatggcttttgataaaaggttggctccacccggcattcgtattcaggatgtaccaccactggacatcattctgctgtctcattcccattatgatcatttacatttagaatcgttgcggaaattatatcgtgcagatacgttgatgctcgtaccctcggggttaaaggcgaaaatgatccgcaaaggttttcgtaactgccatgagctgcaatggtgggagcattttacggtaggaggggtacgcttcacatttgttccagcccagcattggacacgacgcacgccgtttgataccaatacttcgcattggggtggatacgttctgcaaagtgaacagcaggtgattggctctgccacgtccgtcacggaatcccatcctcattcgaatacagattcagagcatacaccgacgttgtattttgtaggagacaccggatattttcgtgggtttaaggagattggcgagcgctttgccattgacctgacctttatgccgattggtgcgtatgaaccggaatggttcatgacctcgcagcacgtgacaccggaggaggcattgcaagggtttctagattgcggcgcagatcagatgattccgatgcactacggagccttcaagctggcggatgatacgccaagagaggcgctggaccggctcgaagcggagcgtgagcgtagggggattgcgaaggaacgcattcatgttctggggcacggagagaccctgaaaattggacgtcgctgctcaactacaatttgaggaattcgacataatccttatacaaaaagcggctcggcggacaattaattttgcctgccgagccgctttttttggtttttagctataatgcaggattaaactgcttcggaatcacttgccaaagaggaatcgctgttggcgatgggatgacgtacgattttaacttcatagaacgtgattttattttcaataatatagtccggaatttgacgatggctatgggattcgcggaatgcttcgcttttcgtccagccttggaagttctctttttctttccagcgtgtactgatggttacttcctcataatctttcgtgttgtcagtcagcagtacttctagaccgagaaagccctccattttttcaacttttccttctttgttaaatctttcgatgagtaaatgtgcattgcccggtgtgattttagatgtatttgtaacgataaccatattaaattcctcctgaatgatgtggtatggtcggtataataaccggatagccatcctcaaatttgatggtagcgttcaattcataaatgtcgcgaagaaaagcagacgtcaaaatctcacggggttcgccggcaacggcgattcgtccctttttaagtgcaatcatatgatgacaataggccgcagcttgctgcaaatcatgcagtaccataacaatcgtcaagccggactcgtgattgatacgccgcagcatatccataacttcaaattggtgggcgatatccagaaaagtggtcggttcatcgagcaaaagaatacctgtttgttgggccaaagccattgcaattcgcgctttttgttgttcacctcctgatagagtatggaacattcgatctgcatagggctggatgcccgtgatcttcatgacatggtccacgatttgctggtcttgtccagtatggcgtaccctcaagcctttggcatgaggagatctcccgtaagcgaccagctcgcggaccgtcaataacggcagcatatccttcatttgcggtagcattgtaatcgactgggcaaaatcacgccgcttgtattcctgcacgggtttgcccagcacagaaacctgaccctgatcctgcttgagcaaccgggtcataatccgcaaaagcgtggacttgcctgaaccgttcggtccgacgatcgctgtgagctgaccagcgggcaaggtgatattcacatcgtccagcttgaaatacccacgttgtaaggagatatgctccccctgaatggctgtcatccgaaactcccccgtttcttgagcaggattaagaagaacggtgccccgatgacggccaacaaaatacctacaggcagttcaatcgggtcaaaccaggatcgtgccaccgtatctgccaggacaaccagcgttccaccgcctacaatggaaatggggaggaggaaacgataatcttccccgattagcagccgtatgacatggggaacgaccagccctacaaagccgattagtccggctacactgaccgctgtaccggcgagcagggcagacagcaggataatgagcatacgttgaagctctactcgctgaccaagcagctgtgctgaatcgtcgcccagcagcagtaaattagcaggtttaattgcaaagaaagaggcgattaatccaatgatggcgtaaggcgccataaactctagatgatgccagcttcttccgtttaatccgccggatagccaaggaagaacggcctgtacgcggtcgctgtacatgaccattacgccgttggtgagtgcgcccagcagcgcgttgatcgcaacgccagcgagcacaattttgacaggcgatgcccctcggtcccaagccagcagataaatgacgattgcgctcagaaaggctcccaaaaaggcggttatcggaagaaggtagctgagctgtggaagcatcaccatcgtaatgacggcggcaagtccacctccagccgatacaccaataatgccagggtcagccaatggatttttcatcacaccttgaagaagtgctccggaagctgcaagacaagctcccaccagtaaacctactaatactctaggtagacggagatccatcaggatcgtgcgataggtagattcatcattatgtagcaaaacatgatagatttcttgaagtggaatcgacaccgaaccgtaggccagaccgtacacagagacggccagcagtagaatcggaagggtaatccaggcgatggtgcgtcttctggcgcgctgtagtttgttcatctccatcgcctatttcgccggatacagcttttgatgtatcaaatccagcgctttagtgacacgtgtgcccggattcgtaccgaacagatctgaaggtaaaacctcgacctgattgtttttgactgctcggattccgttccaggctgcattttcctgcatttcctttataaatgcggccttaacatcttccgtattgccatgggtcatgatgaagatgtagtcagggtcagcctgtatgatgcgttctgtgttcagctgcgcatattgcgggaaattttgcaggcccggaaaatcagcggcgatgttcgagccacccgcagcttccagaatgtttccacttagtgaatttggcagtgccgccatatacgtagccggggctccgtagaccagcaacaccttcggtttagaggcagaagcggtttccttttgcagcttagctacttgttggtcaatttgctgatttagcttcacggcctgagcctgcttttgcattaattgtccgaacagcgtaatttgcgactgaatatcgtgaactgaattggctcccgtcagcagcagctgtgaaccgactccttcaatggctgggatgtctttttcattcataggatagttgcctagtacgacatccggtttgagcatcgtaattttctccagatctacttcatgagtggagcctatttgctgaacgttttcagcagcaggtacgacggaaggtccattggagttgggtctgcccacggctgtcccgcctaatgcgtaaataatatccagatcgccattgctgagcgcaacgatatgttgagggaccttttgaaaggccaacgtccgttttgagaaatcagtaacttgaatcgtcgcgccacttgtcgtgcttgaagcggtagatacggaagcactggctggtttgtgatctgcggtcgaggtaccattactgcatccggtaactgccaataaaagcgctgcggatgaccacaacacataagatttcatgttattcctcctgcaattttcaagttaaacaataatgataatcattttcatttatgtataagagaatgataatgaatatcactgaggattgtcaattgaaaaaagaaaatttttaaataaattttgaactaaaaataaaagagagtaattcgaattatagaagaaggaactacaaatttttattaaaaaatagcatatatcaagggattacgtacacacaaatacatattgacattttcgaaaagtgtaagatatattggtgatgggtttacttgattttgcgaaattatggaatagagaggtggggagacaagctcgaaaagagctattttttttaaattatcaattgagaatgataatcaattagtttattctcgtggggagggactgctgtcaaaatgaagaaggggtattctgcaattattgctgtgtttctgctggtgagtgtgctgagcttttggccaacttcgtcatctgtaggagccgctgcggcttctccaaaattggcggatggtacatacacgctcaaatacaatatcctcaaggcagaaaatgattcggtgtccatggctaatgattattttgaaaaaccagctaagttgtatgtaaaaaaaggtcaaatgaccatgcaaattaagctgaatcatagcgaatggacaactgggtttaaagtagattacaaaggcaaaatcatcgatacaaaggttatccataaggatgccaaaaccgatacccgcaccgtacaatttccagttacgagtgtgaacagcccgttaatctctaaaatccatgttactgtccctgcgtataactacgatcatgactatacgatccgcttcgcttttgattccaaaagcctcaaaaaaatagcagccgtccagtcagcgaaatcaactaaatcttccaagaagtaaattcaagccatctttatcgttcataaaatcaacacaaatggaagcataaaaaatggaggagtgtgtgtagatatgaatatggtaatgaatcgctttgagcaattttcttttaagaaggtatttgtagcattgatcatgacagctcttgtttttgcactcgttgctccattctcagctaaagcggcagcagccgacggcacgtataacgtagactataccgttctgaaggatcaaaccaatgaaacttctcgattggatagctacctgacgaagcctgctcaggttacggtagctaatggcaaaaatgtcgttcgtctgactgtgaaaagcagcaatctgattacaacgttcaaagtagagcaaaatggcgtattgcaagatgcgactgtggtaagcacagatactgcgaacaacactcgtgtagtggaattcgaagttgctgatctgaatgcaaaagtgaatgcttacgctgaaatcacaattccagtaatcggctacacaggcaagtacgatgtacaactgcaattcgacgaaatctaatccaaaataaaactaaaaggagattaagaacatgaacatgattatgaatcgtatggaaaaattgtctttgaaaaaagtaatgcttactgtactgatggcagcgcttgtttttgtggtactagctccattttcttccaataaagcaaacgcagctttgcctaatggaacgtatcaattgccttataccgtttataaagatggaacgactcagccatcttacatggatacaaatggttatgtgaaaaaaccagccacactgattgttacgaatggtcaatataaagtgagagtagctattaccaaaagtgcttgggttactgaattcaaaactcaacaaaacggtcagtatgtgaatgcgactgtagtaagcacatcaggggatacaagaatagtcgaattccctgtaactagcccgtctcaaaaattgaacgttaaactgcatgtaagtgtgcctgcagaatacacgggtggtattccgtacgatcacgactatgttgttcaattccaattcgacgacagcgatatctaagacttctttttgaaaatataattttaaattgaatactcatttggagcttagtttcaaagctccaaatgagtatattttaagtagggggatacatcatcttgaaaagccgatttaacaaatttataacgacatttgctgctattctaatgttgttttctttattttcaccatatgtaggagcaacacctgagggtgagtccacttcgtcgaatttgcccgatttaagcactacagtcactagtgctacttatgctacttatgagattccggtagaagtgcccagcacatatgctgagcctaccaatgctgtgaccactactgatgcgacctatgcagatggagaatacctgatcgattacaaacctttaagaaagacagtcagcggtagcactagggattcaagcttcaaaacaaactatacctatcctggagatttgatcattaagaatggaaaataccatttttcatttaagtttgcggaatctcaaggtctttcgaaatttttagttgaacaaaacggggaaacagttcccgcaaaaatagaggtggattctgggaaaacttccgggactgtaagcttcgatgtttatgatttccatcaaaatgtaaatacggagtttggatttaatagcagttctccatggtatgtagatactgatccagaccgttcagtgaaggaatggattgagtttgatccttccagtttgagacttaaaaactcaacggagaatccaacggttccacctgtaacaccaccggtaacgcctcctaatacaggagagaaactcgctgatttggactttacccttttgaaagatgaaagcaatgaaaagtcaatgatggatgggtatacggagaaaccaggctctctaattgagcgtggtggtaaacgatatgtccaatttatattaaagaacagtaagcagattgatggtttcaaggtagagcaaaatggagtgttaaccgacacctctgttgtaagtgaagatcaaactgcgaatacacgaatgatcgagtttgaagtaaaagaactgcctgccaagctgaacgcatgggtaagcatcaactggcctgagctgggctacgtgaatacttataatgtagatcttcagttggcctctgtacccgtaccatcagatttggcggatggaacgtactcgattaactttaacgcgctgcatgccacaaaagatcaagcgtcagccatggcacaatatctgttgtctccagcgactttgacggtatcgaaagggcaaaaagaagtctcctttaccattaaagatagcaccacagtaacggagttcaaaacagaacaaaacggaacgttaacggatgcggatattgtaagtgaggacaaggccgccaatacgcgtgttgtgaaatttaaagtagcggatttggacgcgattttaaatgcacaagtacatgtgagcacgacctatccaggtggggtttatgagatggatcataagcttcgtctgcaatttgataagaatagtattacaggaaatggaacctctcctgaaacaagttccaatctggatttcacccttttaaaggatggaaccaatgaaaagtcaatgatggatggttatacagagaaaccaggcgctttgattgaacgtaatggcaagaagtatgtacgttttacattgaaaaacagtaagcaaattgatggctttaaagtagaacaaaacgaagttttgaccaatacggccgtagtaagcgaaaatcaaacggcgaatacacgtgttatcgaatttgaggttaaagaagtgcctgccaagctgaacgcatgggtaagcatcaactggcctgagttaaattatgtggaaacatataatgtcgatctccaattaggaacggcaacatccccggttgatcctgggacgccaggtacgccaggaaaggttttagctgatggaacgtattcaatccatttcgatgcattgcacgcaacaaaggatcaaaaatcggcaatggcgcaatatttattatctccagcgacactgacggcattgaaaggcaagtatgaagtctcctttaccatcaaagacagcgccacagtgacggagttcaaaacagaacaaaacggaacgttgacagatgcagatatcgtaagtgaggacaagaatgctaatacacgtgttgtgaaattcaaagtagcggatttggacgcgattttaaatgcacaagtacacgtgagcacgacctacccgggtggagtttatgagatggatcataagcttcgtctgcaatttgaccgcagcagcattgcgataaaaggaacagacggcggcacaactcccgtgactgaaaacggcagatacagcattgatttctccgtcctcaaaaatggaagcaatgaaatatctgtgatggatggctatatgcaaaaaccagccacgctgctaagacagtccggtaaaaatgtgattcagatcaaaatggacaagagcagctggatcaaaacctttaaagtaaatggtgcagaagctccggtggttgagcaatcgacctccgcagatacaagaacagtacagtttgaagtgccaaatctctcggataaagtgacagtgaatacgcatgtgatcgtacctggattggatttgggcggcatcccatatgatcacgtatatgatgtgcaatttcaattcgagcctgctactattcgcagctttgtcgagccttcctctacaggagctacagatcctatcgtaaaattggattttgacaagcttgtcaatgggaaatatgccttgaaattcagcattctgttgtcggatggttccacaggagtggattctccagctcaacgctttatcactaatgaaccagcgcaattggtcgtggaaggcgacaaacggtttgtaggtctgaagctgcaaaacagtaatgaagtgaaggcgttgcgcatttgggacaacgcaagcggggactaccgagacgcagaagtgacccaggaagatgcagcaagcaatacgaagcacgttcgttttagcgtaaatgactttaaaaacaatgtaaaaggccaactagttgtctatgaagcccctaaagtggcaagtgccactccgatggtctttaagactgaggatcgggtagagaaggtatacgattttgaatttaaattcgataccagtaatgtatcttatcacaacgaaaccaaagcagacgaagtagaacaggggaaaaataacttagccgatggagagtacactgcgaacttccgtgtgcttgcaaacggaacggataaggattctttggtggctccatttgtacagagtctggcgaagttgattgtaaaaaatggtaaggtccaggcccatgtaaccgtaacggacaatcaggctttgaaattattccaaacggactttgaaggccgctatgctaatccaacgattgtggcttccgacacaaaaggtgacacgcacactattgcgttcgaagtgcctgatctggataaaaagttgagtgtgtacacacaggtatatctgcctgagaaatacattctaaatgagaaattcggcggacagattcaatttgaccgtgcatcgcttaaaggtgagggagtcaatgcagctacaactgcaaccgcaactgaaccaacagcagcttctacggacaaggcagcagaaacaactgcatctgtggctgaaacaaaaccagtagttgagcaaccggttcaaacggcttccgagaagcaatacacgattaattacaacgtatttaaagataaaacgagtgaagcttccgttatggacggttatctcgacaagccagctacactgattgaaaagggagacaagcgctatattcaaattactttgaaaaatagctcatggatgccagctctccaagtagagcaaaacggtaccctgaaagatgtggaagtaatctcgacatccggcgatacacgtgtcgttcaattcgaggtaggggacttgtctcagaaaatgggtgcttacacacacgtcattgtgcctggtttggtccttggcggagtgccgtatgatcactggtatacagttcagttccaatttgatgaagaaagcctaaaagcgaagtagcctcaggttgtgataatcaatgaagtctgaataacagcaaagtttgtatgcgagcaagtcttggtgccccggcatcaagacttgtcagcatttacatacccgaaaagttggggctcctactgactgtttttctacattttgaattgaggtgactggattttcatgaaacggtatatagcattggctcaaggaaaaacatttggtttgtatatgttaatcggcatcgtgatcttgttgctggctggatgttcgggaggggcacaggccgggcagaaccagagcgatggttcgaaatcagcggcaacatctaatgcaaccggaaagtcgtctgacggtaaagctcaagctcctcgtattgtggcgactacggtagccattgcggaaatcacggatgcactgggcctggatttggcaggcaagccgacaagcacgaaagtgctgcctgaccgttacaaggatgtgcctgatgtgggtaatccgatgagtcctgatatggaaaaagtgatgtcattgaagccgacggacgtactgtcggtgacgacactgaaatatgatctggagcctaaatttaaagatttgaaaatcaatgccgaatttttaaattttgaaagtctcgcgaatatgcaaaaagaaatccaaaaactgggagacacgtttgacaaagccgataaggccaaagagattaatggagctttggatgcgaaagtagccgagattcaacaaaagatcaaagggaagaaatcccctaaagtattgattttgctgggagtaccgggaagctatctggtggctacagagcattcctatattggggatctggttaaaattgcaggcggaaccaatgtggttcagggcgagaaagtggagttcattgcccacaataccgaagccttgcagcaatccaaccccgatatcattttgcgcgctgcacacgggatgccggatgaagtagtgaaaatgttcgatgaagagttcaaaactaacgatatctggaagcatttcaacgctgtgaaaaatgggcatgtctatgatctgcctgaaccgttgtttggcacaacagggaatttagcggcaaactcggcgctggatgagctgatgaaaatgctgtatccttcgaattaaaggaagctgatgacatgtccaaaaaaggttggagccttattgttgtaattgtcttactcgttggcgtcatgctgtattcagcgatgacaggcagtctcaaggtggatttgagtcagttggtgaccggattgtggacaggtacagatgatcaggtgaatgtggtcaaggacctgagactaccgagaattttcgtttccgtaatggcaggtgcagcccttgcagtagcgggtgttttgctgcaagccgtcatgaaaaatccgctggcggatgctggggttatcggcatttcttcgggagcggcattgatctcgctgattgcggtgacggtctttccggcgctttatttctggatgccgttcttttcatttattggcggcgcgttagcctgtctaatggtttatgggttttcgtggaaatctggcttgcatccgattcgtctcattctgatcggggtagctgtgaacgctattttttccggtctaggtcagtcgtttaactatcgaggcagttatgcggtcaccagcattaaccaggttactacatcaaccttgtctatgaaaaaatgggtggatgtcgaggttattgtgacctatggcgggattgggctaattttagccatgctcgtgttctcttggtgcaatttcttgtctcttcaagataaaacagctaaaaatctaggattcaatgtaacgcgcgcacgacttttgatttctgtgattgcagtgctgcttgcagcaacggctacagccatcgcaggagtaattgcctttatcggcctgctcgttccgcattgtgcccgctacctagttggctcggatcataagtggctgattccattttccgcattatgcggcggcttgctgttgctgctcgcggatacactggggcggacagtgcttgctcccaatgaaattccggcttctattattatggccgtcattggcgggccgttcctgatattcctgatcagaaaggcggatcgcacctatggacattaaggatataaccttctcatatgatcggaaaacggatcgtctgcacgctattaatgctgttattgagtcgggacggattacgaccataattggtcccaacggatgcggcaaatcgacgctgctcagcgtgatgtccaacaatgctgttccccgcttgggccaggtgattctggacggcaaggagatagcccactacaagcccaaggagctggcccgtcaactggcggtagtccatcagcagaacgaggcaccttccgacttgactgtagaaaaactcgtcagcttcggcaggttgccgcataagaatatgttcacagcgagacgtgatgaggatgaggaagcgatcgagtgggcgatagcctgtactaatctgaacacgcgtagaactcgcacgttagatcagctctcaggaggagaacggcagcgtgtatggattgcaatggccttggcacagcggacgccaattttatttttggatgagccgaccacctatttggatatgtactaccagcttgaaattttagagctcattcggcagttaaaccaagaacatggactgaccatcgtgatggtgctgcatgatatcaatcaggctattcggtatagcgatgtgatgattgccatgaaggaaggacgtattatagcgaacggcccaccttcagaggtcgttacatctgagctgatccaggctgtctatgacgtggaggtcgtaatcaaacaggatgatgaagcgggcatgtacctcattccgataggtgtcggggtttcctgacgtttacgacgcacagaacaatcaatgctgcgactgaataacgcgtctgtcctcacggcatctcaacgaatttaaaacatgaaaatggttctggtccatgtgtttgtcaggtgacaatcgtggagacagaagcattttttattttatttataagatattggatgagattcaggggcagttatgcttatactacggttcgaatccgatcttttgtgtgttatactattgccgtcggtaattttgtgtttagcactttactaatgataaggatggtatgcttatatgatcagtacaagcggcgtaacgcttcgttatggtaaacgcccactttttgaagacgtaaatatcaaatttactcctgggaactgctacggcctgattggggcgaatggcgcgggtaaatccacctttttgaaaattctttctggtgaaatcgaagccaattctggtgaggttcacatgacaccgggcgaacggatggcagtcctcaagcagaaccattatgaatacgatgaattcccggttctggaaaccgttattatgggtcacacgcgtctgtatgaaatcatgaaggaaaaggatgcgttgtacgctaaaacggagttttccgaagcagatggtttgcgtgccggtgaactggaaggcgaatttgcagagctgaacggttgggatgccgagccggatgcagctgcattgctgatcggtcttggtattccgcgtgacctgcatgataaaaatatgtctgagatgagcgggaacgacaaggtacgcgttctcttggctcaagcgttgtttggtcgtcccaacaatttgctgcttgatgagcctaccaaccatttggatctcgaatccattcaatggctggaaaatttcttgatggactatgaaggcaccgtcatcgttgtatcccatgaccgtcacttcctgaacaaggtatgtacgcatattgcggatatcgactttggtaaaatccagatgtacgtcggcaactatgacttctggtacgagtccagccagcttgcgcttgcattgactcgtgatgcgaacaagaagaaggaagaaaagatcaaggaactgcaagcctttattcagcgcttttccgcgaatgcttccaaatccaaacaggcaacttcacgtaaaaaacaactggataaaattacgctggacgatatccgtccttcaaaccgtaaatatccgttcattaacttcaagcctgagcgtgaagcgggcaaacaactgctgaccgtagacagtctcagtaaaaccgttgaaggcgagcaagtgttgaacgagttcagtctggtagtgaacaagggcgataaaatcgcgtttgtgggtccgaacggtttgcctaaatcgacgctcttccaggtgttgatgaacgagattgaagcagacagcggagaattttcttgggggattacaactagccaggcttatttcccgaaagataattccacctatttcgaaggtgtggacatgaatcttgtggaatggctccgtcaatattccaaggatcaggacgaaacgttcctgcgcggcttcttgggacgtatgcttttctctggagaagaagcgcttaagaaagcaagtgtgctgtccgggggcgaaaaggttcgctgtatgctggcgaaaatgatgctgaacggtgccaatgtgttgctgctggaagaaccgaccaaccacttggatctggagtccatcacagcgctgaacaatggtctgattgattttgatggtactatattgttcacatcgcatgaccaccagtttattcaaacgatcgcgaatcgcatcgtggaaattacaccaaacggcgtaatcgaccgtacgatgagctatgatgagtacttggaaaatgaagaaatcacaaagttgcgtgaacgtatgtatccggtggaaattggctaaacttcaaaccggctaacttcaaataactagataaacgaaagaggagctccttgaggccattaagatggcagggagactcctcttttttcgtttttgtaccatgcccatagcttacttggttctggcagtgaggtacgccagacctttgataccctattaaggctatgaggtggattatgatccgcctgtacgacggcgttggttgttcggcttcttcgtattttggcttttcagtgttttggtggaaccgccttgaaagccgccctgctgtgaagcgccggactgctgttttttttgtgccagcttttcccgaatggcatctgcgagattaactttacgtggttcattggcatcgctcatgaataaattcctcctgttgccgccagattcatatcaatcatgctggattgaagaaaaacgcggctgtgtcctcattttatacgtttttaaaagaagggacaagggcaacaatgataacacacatctcgggtggggtggaagagaaaacgtctgttttttgtgtgaaggaaaaaatgttttgtgtaacctacaggaatggggtctggcaatactttttcgttgttactacagcgatgcagagcggaaagactgtttctctagacccacacaaagttcgtctgctatcctgaaaataacagttaaccaaagacaaattgttattattcagggcagcgatgctgctatttttattttgggcccggtgagatcgttctgctggaaactatatacttgaaggagtgtcctacgttgtggtaaatgtctatgaagaaatacgaaaaggtgagcgtggggcgtgggtgagcattgctgcttatctcttgctgtccgcctttaagctgattagcggatatatatttgcttctagcgcgttgcgggcggatggcttcaataatgtcaccgatattgtcgtgtcggttgctgtactggtggggctgagaatttcccaaaaaccaccggactctgaccatgcctatggacattttcgggcagaaacgatcgcggcgctgttggcgtcctttattatggctgtcgtcggtttgcaggtgcttattgatgggatcgggagcatttttaagggcggaaagcaaataccgaatatcacctccgcgggtgtagctgtgatttgtgcggtgattatgctgggagtgtacctttacaataacagactggcacggcaaattaacaataaggctttgctggcagcggccaaggataacctatcggatgcacttgtcagtgttggggcagcagttggcattatcggcgcacagttcgggctaccctggctggatactgtagctgcgatcgcggtaggattcatcatatgtaaaacagcgtgggatatttttaaggattccacgcacagcttgaccgatggatttgatgagcaagaactgtctgacttacggagtacgattgcctgtatacctggagtagaggggattcgggacgttaaggcacgtgtacacggcaatcatgcgctggtggatgtggtcattgaggtggatccgcaactcagcctgattgaagggcatcggatcagcgaccggattgaggaacgcctgcaagaggttcataacacgatgcatgtccatgtccatgtagaacccaaattatagattaattattaaattgttagtattaaaagtgactttagacctatatgtaaaaggcgtatacgcttccttttgtgacgtttggattatatctctcttcctgctgcttttactataatgaaggcatgtccggctatattcgtcggaattggatatgctcttcaaattcgtaaaaacagccaggaggtgcaacattgagaagacgcgtgatgggaatgctcatgacgtcagccgcgctgttggcagcaattcatgtggcgccgggtcaggttgacgcagcggcatcaacagcatccacaggacagaaggcggttattcaggcggctgtaaagcttagatccggtccttcgactacaggggatgtagtcagctttatgaagcagggagaggccgtaatggtattggagaaaacgaacagctattggtataagatcaagacttctgatggagtaaccggatacactagcagctccgacaagtacataaaaattggcgctaccagcgtcgctgctgctgtcactccgtctaccactcgtaaatcggaagccacagagtcagttaaaaatgtttcagctaaagaggcagtggcctcagtgaatagttctgccggtcaaacgaaagccacgattcaaacgtccgttcgtttgcgggcggaggcatccacttcttccgaggttttgggctatttgaatgcaggggatgtcgttacgattaccgacccaagtaatgcttattggttcaaggttaccgatgctgatggtacggtgggctacgtcagctcgtctccacagtatattcgtattggtgagggcgttgttgtgcagcagcctgtgtctgctccggtgacaaccactcctgatactaccgctatacctgcgacagcctctcctgtgtcaactatgaacatgttttccggtgatgcagcggctgccatagagcaggttattaacacggggatgacttatctcggaactccatatgaatatggttcagatcgcaacagtacggctacttttgattgctcggcatttacccgtcaaattttccgtcaggctgtaggtatccagcttccggcagattctcgttcacagggtgagtggatcaagcaaaacagtcagccgaatacggacatgactacgctgaagcgtggcgatttgctcttctttacaaattataatgcatcttccggggcgtacacgtccttggataattcctcccaaacgattacacacgtagctgtatatttgggagacaacaagcttctccatacgttttctgtagcgggtggcggtgtaaaagttacggatttcagcaagccttggcaggatcgtttcctgtttgggggcagcgtgattcaataaagcgccgctaactgttaaaaagctgcatcaaaaaaggatgttccacagccctgttaaccagggtgggaacatccttttttgataaacatttagaatattgctcttgtgcagctagcatccgataactatgaaacccgttttcttccggtaaagagtgaaatgacgaacaacaccagaaatatcacaaataatattttagcgattgtagcagctatggacacgacgataccaaaaaaacctaagatcccggcgatcacagcaaaaattaagaataaagcggaccattttagcatgttctgtatcctcctttaattgtatataatgtggcatactcacgctccgatagagcgtggttgcagatgacaatgacttctatagattattcgtggctgtgccatcgttatatggtgttttaaacggtgcgagagtccgtgaatcataacgtttggagcggagaagaagccagcctggacgttgtttcgtgtctgaatctaaagggtaactatgcagtaatcataaacatcatcgtgaaagacgaaagagaggttacgctatgttaacacaggtcagcatttttattattgctatcgcatttgcagttctcgttattttcctcatcaaaacgttaaaagcagcacaaggctctctggataaggtgactcaaaccttgcaggatgtacaaaaaacgatagatgaactgagttatgaagtaaaacaaacggttcgacatgcgaatgacatcaccgcagacgttgatcataaattgaagcaagtggagccagtgatggaatcggttagaaacttgggagaggtactcagcgaagtgacgctggctgccaagcaggcttcaacagcgttaatgacacggtttcagaaatcgcatagcgctgcgagtaatacctcgagaacggatcaggcgatcaaggcaacgacaccgaatagacctttgaccgcaacggagcggacggttcagagctacaatgcgacgtatgaggagcctgcggccaaaccgggtaaaaactggttgggttatgtagacatcgctgctggggtgtggcagaaaatgcgtcagtagcatgcatagtggctgaaccgtaaactataggaaattcattgaaagggtgagatttatgatgaagatgttattactagctgctggtttgctcactcccttttccggacaggatacggttcagcaaaccgtttccccgcaaacagcggggcatatggttaggactgtgcagacgatacccgctccacatgctgtaccagcagattttcataccttaaatggcatatccttggatgacacccgtgcggatgtgttgaagaagctaggtaagccaatacgagtcaaaaaagatacgctgctgctttctacagaataccaatatccagatgttgtcgtaggtatgcgtgaggacgtcgtttcttatgtgcatgtagatcctgctgctggtcgaatcaaggtaaatgataagtggctaccgctgcaacggaaaacgctggatcaggcgctgggtggctcgcaattcacggcggaagacggagaggtctatgtacgcggacaacgtgcaatcaaagtgtttatggatgagacgtctgataaacctaagtatgttgagttttttgatgaaacggagtggtaatcgatttttttgaggcgtggtataacatggaagtttcaaatgaatatgtgaagtgtaatagtcagagaagtcaatccttaaaggagcgtgagaaacatgaatcagaccaatcataaatcttatgccaaagtggtagataacggtgtacaagccgttgaagcagtaaatgagttgcgtaacacgggctatcgttatgaggatgtgttcgtgctcgctcatgatcaggatcggacagatcgtattgccgatacggtggatgccaaggaaatcgggattaaggaagagggcgttttcgattcattagccaacttgttccgttcccgtggcgatgagcttcgagctaaaattacttctttgggatttacagataccgaagctgacttttatgaaaaagaactggatcagggtaaagtgctggtcattgctaaaaaagcgtgatattgctgttcaccataaaagcaaagtgacattagattcgaaaaagaggaagttgaccgcagcacaagtgtttcgcgggtcctccaaaaacatagataagganntccttatctatgtttttggaatgccttcttacggaaacactacttccaatcaacaagggtgttgccgtttaagtaggtatagtataatacatgagttacagataaggagaggccaatgagaattctaattgttgacgataacccgacgaatgtcattattattcgtgaaatactgaaaaaagaaaattatcgggatgtgatctctgctagctcggccgcagaaatgttggagcatctgggaatcggcgatcgtaccattagtctcaggccccgtccttccgatattgatctggtgctgttggatatgatgatgcctgaaatggacggcattgaagcttgcagtattgtgcaggaatatgagcatttaaaagatatcccgattattatggtaacggcggtaggcgattccaaaaaattggccgaagcactagatgtgggagccgtcgattacgtcacgaagccgatcaacaaggtagagctcatggcgcgaatccggtctgccttgcgtctcaaacaggagaaggactggcataaggatcgggatcagcgaattcaggatgagttgaagctggccgcgatggtgcagcaggcggtgcttagtcctgccatccatgacccagtgctgcaagtgaatgcgctctatcagccttcctttgaactggcgggggatttatattcatggtatccgctaggggaggggcgatatgccatcattttgctcgatatgatggggcatggcatttcttcttctctgttttgcatgttcattgcgtctgtacttaaggatacggtgaccacatatgtggagccagagaaagtcatacaagagctgaatcgccgttttaatcaactggatctgggcaagcagctggtacagtattattttacggcgatttatatggtgattgatacccgttcacggcgaattgactatgtaaatgcgggacatcctcccggtttgctgtttaaccaggatggcagcattaccaaatttgaccgtgcatgtagcccggttggtttgtttgataagattgatgcagaaatgcacacgattcattatgaaggaactggacacatcgctttgtatacggatggtttgctggaggcggtggaaggtgaatatgaggagcagttggagtatctgactgggtgtctgcgtaagtatgaggaatggaatgaagaagcgatgctggatgcattttttcgtaatgaggtgccacaggatcgtgatgatgataagtgcctgatctggatttcattgaaagagggagagagcttgcatgaaaatcagaaataaactgctgatcggctttggatcgcttatggcaatcctccttgtgctgacgctaatcagctatgaccgtatggggagcctgaatgagcagctgaatcaggtttaccaggaccgatatatgaaggtccggaaaacaacggctattcgcggtcaggtgaatgatatggccaaagttatggccaacctgatcttgaatcctggctcctccgtcagcgaggccaaacgtgagcttgatgatatttctgctactggaacgaaagtgctggcaagtttgcaaacaaattcaggcaccagtgaagagcagcagcaggttgatcgggtagccgtcgcctggaatgaatttctaagttacgaacaaaggttagtttccttactgggacaagatcgcattgatgaggctaacgctttccgcaatagtactggtttgcctgcacaagaggaggcaatggatagcattaatgcccttgccgtttttcaggatcgggagattgataacgacatgaagcaagccaatcaggcttatgaggaatctgtgcagattaccacaattttgatggccgccggtctgatcatgggcttactggttattttgtgggtgctcccaagcattgccaaaggtctaaatatcgttaatctcatgattaatggttttggcaagggaaaatacagggccattagccgaatgagtgtttcttccaaggatgaaatcggggaggtcgctcgtgtatttcaacaaatggccggagacttggaagaaaagcggagatttgagcattctgtccttcaaacgcagaaggatcaaacttggcttaatgccaatactgctcgggtaactgagctgttccgtggtgtgaattcactggagcaggttgctcagatgttcattagtgagtttacgcccatcttgggaggcagctatggagccatctatttgcaagggaaagatgtagaagacaacctttttaagttatacggttcctatgcaaaggtgactggcgaaaattcgattagggacgttatccatgtgggcgaaggcttgctcggacaatgtgttctggatcgtaaaccgatcttgattacagaggctcctgacggatatttgtccataggctctgccttaggagaaagtaagcccgtgggaattatgattttccctattttgttcgaggatgagtgtatcggtgctgtagaaatagcgtcactggatcgcttcagtgatctggaaaccaagctgtttgctcaattagtagagagcttggggatcattctgaacaatatcaagggacggatgcgtgtagagcaattgctgcgcgaatctcaggcacttactgaggaattgcaatgccaatccgaagaactacaaactcagcaagaggaactcaagcgctccaacgaaaatttggaggagcaaacagaagaactcaagcgttcagaggaattgttacaacgtcaacaagaagaattggagcattttaatactgaactgattgccaaaacgagagcgttagaagaacaagttcgagaagtggaagaaaagaacgacgagatcgaacatgcacgagctcagttggagcaacaggcaatgcagctaggaattacaagcaaatacaaatccgagtttttggccaatatgtctcatgagctacgcactccgctaaatagcttgcttattctttctcagctcttgtctgagaacaaggaaggcaatctcaagccaaagcaagtggaatatgcacaaaccatttatatgtcaggcgccgatttgttgaaaatgattgatgaaattctggatttatccaaagtggacgctggaaaaatggatattaaccatgaagcggtccacttgaaggaactggaactgtttgtggagcagaattttgctccggttgcagcccaacgcgagcttcaactgcataccgaaatcgaagagaatctgccggatgccattatcagtgacggttatcgtctcaaacaaattttacgtaatttgctgtccaatgcgttcaagttcaccacggaaggttctattactttcaatgtatcccgggcaaacggagagcagcttcctggtctgctaaatccacgaagatcctatctggctctatctgtgcgtgatacgggcattgggattgcttccgataaaacggatctgatcttcgaagccttccaacaggtagacggtacaaccagccggaagtacggagggacaggactaggtctgtcgatcagccgcgagctttccagattgttgggcggcgttattacggtggaatccgagcagggacagggcagttgcttcacactgtatttgccggaacaaacgccaacggctgaggatatggattctcattcgagagaggaatttaacggtacggttgtgaattcggattttgagaatgtcgcagcctcggcagagacggatcttcccatgattatgcctgcaaaacggttgccattatatcagatgccttcgaaaaacaaagcggcggacattatacatccgggggatgaccgaaacgagattacctcgcaggataaagtgctgctgattattgaggatgatattaattttgctaatattttgtacgatatggcccgtagccggggctttaaggccctgatcgctctccaaggagacgatgggctcaacatggctcggtcttatttgccggacgctattatattagatattcaattacctgtgatggatggctggtccattttgggcgagctaaaaggaaattcatcgacacgtcatattccagtgcatgttatttcggtcatagatgatgtgaagcagggcttgatgatgggcgcgattgcctatctcaaaaagccatcttcgaaggaaagtctggataaggcattttcacatatcaaatcgtatacggaccagatggtcaaacgtcttcttgtggttgaagatgatgataatcagcgtaaatccattattgagctgatcgatcatgatgatgttgccattacggcagtatcgacaggtcaggaagcactaaatgagctggctacccagcggtatgactgcatggtactggatctgatgctgagcgatatgactggttttgaactgctggatcgtattcgagagaatgagcagctaactgatctgccgatcattatttatacaggcaaagatctggatagcaaagaagaaacgcaacttcgtaaatatgcagagtctattattattaaggatgttaaatcgccggaacggcttttggacgaaacaacgttgttcttgcatcgtgtagaggcgaaccttccagaggacaaacgcaaaattttgcagaagctatacaacaaggaagagctgtttgaaggtaaaaaaatattattggtagacgatgatattcgtaatgtatttgctctgtccagtgtgctggaaagctatcgtatggaggttacctttgcggaaaatggaagagaagcactggaactgctggaacagacacctgattttgatctggtgctgatggatatgatgatgccggaaatggatggatatgaagcgatgcgacgtatccggctaatgccacaattcgagaagatgcctattattgccctgacagccaaggccatgaaggatgatcgttccaagtgtattgaggcaggcgcttccgattatgtgaaaaaaccgattcaaaccgaacagcttttatcattaatgcgggtttggttgtattcgtaacccaaaaaaatgggtaatataaatcgacacatgattggagcggcataggcaaaacctatttaggaattggagagagattatgacatctaaggatatggcggataatgctgctaatgaagtgaaatcgaatgatactgagcgggaaatgattgagattgagctgttgctggaaggtatacatcggctgtacggctacgattttcgtaactatgctctgccttcgattaagcggcgtgtttattatcatgcgcagtccgagaatgtaagcacgatatcaggactacaggagaaggtgctgcatgatcgcagcgccttcgatagactggtacaaagcctttccattccggtgaccgagatgttccgtgacccggagctgtttctgaacttcaggcagaaaatcattcctattttgcgaacgtatccgtacattcgaatctggcatgcaggttgttccactggtgaggaagtatattctatggcgatcttgctgcatgaagaaggcttatatgacaaggctcgcatttatgcgacggatatgaataacctgtctttgcagcaggcgaaggaaggcgtatacgggatcgaccgaatgaagctgtataccaaaaattatttggagtccgggggcacacaatcgttctctgaatattatacagccaagtatgattcagtgatgtttcatccttttttacggaaaaatattatttttgcggagcacaacttggcgacagaccggtcttttaacgagttcaatgtgattttttgccggaatgtcatgatctactttaacgacgaacttcgcaaccatgtacatgggttgttttatgatagcttgagtcattttggtgtgttggtgcttggggccaaggaatccatacattttaccgattatagtgattcctacgagccgctggaccggatagaaaaaatataccggaagattaaatagagatgcttaggaggattccatggggcttcatgaaccgattcatatattgctggtagatgacagacctgagaacctgctcgctcttgaggcagtgctggagagtgaacaatataatctggtaaaagccacatccggggaagaagcgctgcgatgtctattaaaagatgaattcgcacttgtagtccttgatgtgcagatgccgggtatggatggaattgagactgcgaagttaatcaaggccagagagaaaacaaaggatattccgattatctttatttcagctaacagcaaggaagcggagcatttgtttgcgggatattcagctggtggtattgattatatggtgaagccgttcatccctcaaattctcaagtccaaaattgaaggcttcgtgcaaatgtatctgacaaacaaacgcttgaagacacagtccatgctgcttcaccacaagacgcaggagctcgagaagatgaacagcgaactgattgccgccaaggaggcagcagagattgctgccaatgccaaaacggaatttctggcaatgatgagccatgagatccgcacaccaatgaacggtgttattggcatgattgatctgctgatggagacagagctgcagaccgatcagcaggaatatgctgatatcatccgtcgtagcgcagacgcgctggtagcggtcattaatgatattctggactttaccaagctggagtcaggcaaaatggaggtagaggaatatccttttgatctggtttcctgtatcaaggaagttttcagcctgtttacagtagaagtcaaccgaaagaacttggagctggtttattttctcgatgaacagatgccaccggtgttatatggagatatggggcgattgcgacaagtgttgattaacctagtatccaatgccgtcaaatttacagaccggggcggggtatatgtcttcgcatctgtcaaagagcaaagcgacaatggacttaccgttgagttttctgtgaaggatacaggcattggcattgattcggctaaggtcggaaggctatttcagcctttttcccaactggattcttcaatgacgcgtaaatatggtggtaccgggttaggacttgccatttgtaaaaccttggtgaatatgatgggcggagatatccgtgtagatacgagcggagaacaaggcgtgacgtttcattttacaatgaagcttggctttgctgaggaaaatgaactcgagggggagtccagccacgattgggaaattccacatcaggagtctccaagtcgtaaacctgtactggtggtggatgaccatccgatcaaccagaagctaatggttaatatactggataagctcggtttagcttcagatgtggcagcagatgggcaacaggcgcttgatatggtcatggcgaatcaggactatgactatatctttatggacttgcaaatgcctgtgatggacggtctggagtgtacgggtagagtgcgtgaacaattggcgggaagatcccaacctgccattatcgccatgacggctaacgtcatggagggtattcagcctcgatgtattgaagctgggatgaacgattatattagtaagcctgttaaaatcagcagtgtaaaacaggcgttgctacggcattctccggaccattttccaatgcagccgggtaaagatcaaatcaatgaagcctagatggtggcatttggtagtgtttaaaaagttataccgtgattcaaacgctcgtataatgggttagtatgtagggaaatcttttttcgggagagtaggcctatgaatacaaataaaaatgagaaatttaatgcaattacagaaacaaccgatggcgtaaataccgtttatctgagtggagagttggatctttcggtagcacctgattttcgtctggtgatggagcctttggtgggggagtccagccaagatttgattattaacttgagagaccttaaatacattgacagcacgggtattggtatcttgttatccattttaaaagcaaggcatgggatggaatctcgctttgctgtccaagaggtaccgcctcaaattcaaaagctgtttgatatgaccggtattgccaaattctttgtcccccaggagaattcccaataggaaaggaaagaaaaagaaatgaatgctcaaattcaaaaagtagttcttaatttgccggcaactgctgactttgttgatattgtaagattaaatttatacggtattgccgcgaaaatgggattctcttatgaggatattgaagacatgaaagtggctgtatcggaagcctgtaataactctgtcctttatgcatatggtcatgaggggggagtcgtggaagtgacatttgaatttgatgaagcttcgttgtccattcgtgtcaaagatgaaggggagagctttgaacgtgtggaggacccgtcccgtatcgcatccttgcatgacaaggagttgaatgatgcgcagataggcggattaggcttttatctcatgcaggcgcttatggacgatgtccatatcttgaatgagacaggaaaaggcaccgaagtggtgctggtaaagcgcctgaccagaagtgaggaaagagtatgaatgaaaaggtaactcccccggagtcgatggatgaagccgttggtctaatctgggagtaccagcaaacaaaagataacgagattgctaccgtgctgatccgcaagtatgagccgatggtcaagatggctgccgggaagatctcccgtaaccgtccggacttatacgaggatttatatcagaccggtcagatggctttgatacgtctgcttcagcaatacgatatcagcttgggtatcccatttgaaccgtacgctatgaaaagtatgttgggacatatgaaaaattatttgcgcgacaaatcctggtacatccaggttcctcgccgtattaaggaaaagggtgcgcttgttcaacatgctattgatgaactgaccgttaaattggaacgttcacccaatgtggatgagattgcgacctatttggatcttaccgtggaagaaacgattgaggtgcttgcaggccgtgagtgctatcactatgtttcactggactcgcctttatcccaggaagagagtgcagctacgttaggcgagctcattagctcggatgctaacgattatgacactgtggaaaaacgaatggatttgcagcaggctttaagccaactgaaggagcaggaacaaaaggtgcttcttctggcatttcaggacggtcaatctcaacgtgcgattgcacagacgttgggcgtatcgcagatgagcgtttcccgtattcagaagcgggcaacagaaaagctgaagcagattatgtctaattcctctatttcatgagaagaccgcggaattcttggcttaatatatttggcgtcacatcgtaaggacacgttattccgatatgggaagcgtgtcctttttataaagcgaaaaaggttgggaggaaggttggaatccatgacagcatttgaacagatttcttcctttcgtggaggatgggaatggtgggacatcagtgctgggaattggcaggattcggtcatacagcacttgaaggagaagctcccagaagccgcggaatggctggacaaggtagaggacagtccatccagctttatatctgtgcgctttccagatggcaatcagcccttaatgtacgggtcgctaatctactccgttcaggaggagatcgacagtcagcgtaattgcaacaagttttattttctggttctaaaccaaaagttagtgacgttaaatctggatcaaaatacccgtgaaatcatgcacaccgcggaacgccaaaaaatgctggaacagtgtgaggatgcagctgacggcatgtttgtattggcgagagccgtgcttcattattttcatacaggtatggataagttcgagatcaacctgagaagactggaagaggagatggagaaaaggaatgcccgtacgctgatggattctatattgaatgcacgtttcgagctgttgtattggagcaatatgttcattcctttttcagagctggtgacggcttctcgggaggcatatctggatcaactggaggagaattatttttttaagcagttactttaccgtgttactcggatggaaggacttttcctgcattatgaaaaggaaatcgacacattgatctccattgacgacgccatttccgcatttagggggaatgagattacgaagacgctgaccattgtcaccgccgtatttacaccagcaaccgtagtgggcgctatatggggcatgaactttgaaaatctgccttggattaaaacaggctggggttttaccaccgtgattattgccaccttgctaagtatggcgggaatgtacggctggctgatgatgaaggggtggacaggagacttattgaaggctaacaagcgcaacaaattgtagtggttgattacagctgttacaatttacaaataaaaaacgatccatcgtaactggaggctctttgaggagtctattaccggttacgatggatcgtttttaaatgagatagggacaattacttagtaccttggctcattttgatatatcctaataattcggcgatgaaatctccgatgaccggaagatttaactgtaccaggaaactgagcaaccaagcgagcaaggcgagtataaccactgtgcccagcgtaagaccgagaccacgtgcaatgcctgcggtcagattgctcataattcttcttttagtgctggagtagttctccagaatatctttgaattctgctctttcgagcgtatctgctatttgatctaagcgtttgttaagccgcttgacctcatggcgcagctcaaaaggatgctcatttacatcaaagtccctctcctgatcatgtgttttaacatgattatgagtagaagaagtctgcttggatgaaacttcatctggctgatcttgagcctgtaggggatgaaaggttcttttgttgttcgcggtaagatcatctccataggaatttggcttgttcattgtcatcccagcctttctatcatttaaaaacagccagcttcttgcatgctggctgttcagtgtagggcttattttttgccatcagaatgtgtagctgttaggaatttgcattcaattgtttttgcgtatccttggccgcttgagccgttgcatccataacttctttatccgctttggctgcttcattagcgacatctgcagaagccttggttacgctggatacgatgttgtctttgctctcggataccgttttggctacatctgctgttttggtggaaacggttttggccaaatctgtcgctttgctgctcactacagatgccacgtcctttgttttatcagagacaactgtaattttatcagacagatcactacgcaaatcacgacccggcttcggcgcgaacagcagggctgcggcagcaccaatcaaacctccaataaataaaccttttgcaaaacctgaagtacttgccatattttgattgtcaatgttactcatgttatatcactcctcttatagaattaaagaataaaaaatatatatataaaattttaggtagcccttcttaatagcctggacaccagtccgagcaagaacacgaacaatgcggttccgagtatggctggaatgactgcaaaatctccgatgaccgggccccagtctcccaatagcatgacacctagccaagctcctacaaatccagcaatcatagagcccgcaataccgccaggcatttcatgaccagccagtgcatcgccaatcaatccgataataatagccattacaatacttagtacaattccccacacaaggatcgcctcccttatcctaagttcacaaaaccataacgtttttgatgaatgctgagcttcgatattgctgtgccttgcttacttcgtatataaacgtcgtgacccggagtgaaacaaaaagccgtctcggacatttaccggtggggggtggaaggaagctgcatgcgcgcttgccaatagatcacaggaacggtaaacaccagccaaattatacccgcaatatagccacccacgatatctgtaggaaagtgaacgcctagatatacgcggcttaatccaatcaagagaatcagtagtgcacccagagcgcacggaagaaagagcgaacgcccacgaatctttcgttctatggcccaaatggcaaatatcgttccgaaaaatcccatagaaatcatcgcatgaccgctgggaaaactataacccccggcttcaaccaaatgttgaagtgacgggcgttcccgttgcaaaatttccttgatgagcgtatttagcacccacatcgccgtaaagctgcttaggatcgcaaaggaataagcttttgaacggaggctgacccaacacaaggtagcagcaccgagggcgatgatcaacgacatgcggagtgaacctaaagatgtaatgaatatagcgatggttagcagttggtaacgagcagctgctgtgtctggaaaaacggcatcctgtatgcgttcatcccaatatagaaaaggagctgtgccaatccacttcacagagtaggcgatgagaagcaacacagcgatcatgataatagatgcacacagactacgacgcaaatagcttggtaggaaccgggatgattggggttcatgggatagcatatgtaataaatctcctccttatggctgtaatagattcaatttttcgtactattaacttaactaataatgaacttaagagcaaaaaccgacggagaagacaggctgattgaggcatataagcccggggtaaagggatcgtatcacagcgtttgtaatgccagggccggaagtggaatagtcatcacgaagcaaagctgctttacggaactgtaatccatggaggtgttaaggatgattaaaatagtgacatcggcagaaagacatacctcaaataaagggtggattcatagtgagtttagcttttcgtttgccgattatgaagatccgagcaatgcccattttggctgtatgctagcccataatgataacgagcttgaaccgcagcaaggcttcaaaagacatccgcatcacgatttggaaatcgtcacctacgtgattgaaggccaattgcatcatagcgacagcttagggcatgagcaggatttgaaaagcggctcgatccaggttctgagtgcaggcaccggaattgaacatgaagagcgaaatactggggatgaaagaccggttcgttttttgcaaatgtggtttttacccgagagtcctggcattcagccttcttatcaagtgcaaagattcaagcacagtgaacgtctaaatcggcttcagcctgttgtgtctggttcagaagtggagggagctttatccatcgcgcaggatataaatctgtatctgagcagattggaaaaaggacagcagcttgaatatccgcagcaagaggagcgccgcacccacatctatgtagttaacggtcatgtggaagttacgtgccaggatggggaatttcagttagggcctggtgatgccgcgcgaattcaaaaaagctgtacattaaagatacgagctacaggcaatgaggatatatctgaattggtgttagcggatttgccttgaagcatccttgaatgagtgaagaagtgtatgaaaatgcgcatatgcattcgaaaaaataaagctcgtatcccggtgcacgtctgttgagacgagcggagatacgagctttatttacgctgacagggccactatcatgaaggctgttgttcatgatgataggttgtaatacagccaagctgtattcctataagctaattcaggaggacttacgcaatctacccagttcagaaacaatagcttcaacctctgaaatgctcaggttaggcttgcttatcaccatatcatagacatcatggatgtcctcgtattgctccagcgagaaagcggatgcctgcatagcagcaccactcgccatacggagcttggttttaataccctcaatcatatactcaatgttggcatgagacggtacagacaaatccatcgttaattttccatcctttcataacaggggaagttgcctgtattgtatcatgtttttgttgtagaatgtactgaaagccagattaccgatatacaaccgaatcaaggaggatggacaaagttgtctttgtataatcgagcttccgcacccggtcgctcgtccttagaacataatgtaaagaaaacagatcaagatggactcgcgccgtttttccgagaaattcatcatcagcatgctatagataagttgacttttgtttgcatcggtacagatcgctcatcgggtgattcactcgggccactggtaggcaccatgctcaaggagcaaggctttccgcacgtgattggcacaatgacggagccctgtgatgcagatcatctggtttcatacttggagtgcattccccaagatcatcatgtgatcgccatagatgcttgtcttggacagcacggctcaacgggaatgtttcttattgcgcgtgaaccgctaactcctgcgcgatcggtggggctgtctctgccgtctgttggtcattatagtgttgcagcgattgtgaatgagcgcagtcccaaaccctattggacactccaaatgacgtcgcttcacttggtcatgaccatggctgcgcatattgctaatgcggcggcttatgaatttggtttaaaaacagcttcgcaagattttccagagggttaccgtttcagatattgatggtctgcttaataatatacatcagcatgttctactcactaatatattcagatccaatagattatatacagagaaggaagggttccacatggaaaaggtattatgcgaaggaacgacgatctgctatgccgaacagggaaaaggagatccgatcattctattgcacggattttgcggaagctcttcctactgggatgaggttgttcccttgctatcccaaagctatcgttgtattgttccagacttgcgtggacacggacgcagcgatgctccactaggagcctatactattgatcaaatggcagatgatgtgcttaaacttcaagaacaattggacattcctcaggctgcctggtttggtcactccctaggaggctatcttgccctttcggcagtgcagagacatgcagaacgcctgacagcctttggactgattcattccacagcatatgcagatacggatgaaggtaaagaaaagcggaataaggctgtatccaccatccaaacggaggggattacgacctttgtagatggactcgtaccgggactgtttgctcctgatcatgtggagtcgatgtccagccaattacttaaagtcaaagaaattggctacaaaacaccaccacaaggagccgtaggagcatcactggctatgcgcgagcgtactaatcggcgggatgtattgtcggcttctgcattgccagcccttttagtagcgggtgagcaggatcaggcggttcctccagcgcggacgtttacaacagatcgggccggagtaactcaggttaccctaccagaagcaggtcacatgagcctattcgaggcaccagagttattagcgaacaccatcttgacatttttagagcaaaacttgaaaaggtagactaaagtaagcccaaaaaccggaaccttctgatgtgataaacagaaggttccggtttttggatagtcaattatttttaggtgtgtaaggtgtctaatttatattgcttttgttaaaggcaaacgctgtcggcaaaccatcaatactctccagatttttctcataggcatattttttaagtgcttcttctcccatctgaatcgagacttccttcagcttttcccgttcgctcgtgtatgtcatgaagggaacagcaaaaccacatgaattctgcaccatgtgaacgtccacaacaatgatttgtcttgcaccgggaagcgggttgaagagagggtacagttcattccattgcttagtatcgggcagcgcgacggtaccagtaccatagagctttagtacactgggagcgccctcaaatgcacaaaacatgattgttacccgtccgttctcgataatgtgggcgcttgtctcgttgccgcttcccgccaagtcgagataggctaccctttggtccgatagaatacgaaaggaatcatatcccttgggggaaaggttaacgtgccctgtcttggatagcggtgctgatcctacaaagaaaatgtgctgccgctgtataaactcttgatgttccggtaatatcgagctaaattgtttacccaaactccatcatcctttctcacaaaaatattcatataaattttgtttctaaagaaattaattattatgaattattttgtgggatgtttaaatatactgattattttttgtttcgtgtgaaacaaaaatatcacaacactaacgaagaagcaatattgattttaaaaaaaccgtcattcgctagtcacatgatcagctacaaagtactgtaccgtaggaattcactgtcatatgtgagcattctgactacctgattattgatgttattaactgagggtgaaggttataagtggtatttctgcatggtagggcatttggcttttagacaaggatgtcttacaatcagaagacagagtttctggttgtctaggcatcgggatgaaaggaagggaacggcttgcttagaaaagattatttgctcagtatgatggaagaattgacatccgcagtagcatcggtgctcggtctaaggcgtgaaaataaacatgtcgaagcgctaaaacagttagatgatctgctcaacaagcagtttcgtcttcgttcagatctgctcagacgattgccgccggaacaaattattgagcttttccgattgggccctggaattgaagcagacaagatccagcaggtggctcgcattttagaggaagaagccgtgatttacctggaaaccagtagaacagacgagggcatacgaatcttgatgaaatctcttcatttatatttgtacagcgatacgaatggcgcgactcgtgatctgcaggtcctgcctgaacgaatagcgtgtatcgtaaaactggtgcgtgaatatgagcttccctctgaaaccagcaaactgttggctgttcattacgagcgagaaaacaggctggacgaagccgccgatgtctggtttggattggcatgggagcagccagagcttctttccgaagcggaggcgttttacagtcacttactggataagaccaatgcagagctggagctgggtggaatttcacgccaggaagtcaccgagggtttgaccgagatcacccaattacatgaaagaaagtgagatgtaccttttggattcactgcgcgaacttatataccaattgaccacgggaggatccctcataacagcgacgctgagtcagcttcgcaaacgggaggatgcttcttttactaaagtgcaaatcaaacctgtagaattgaaaaataagctgcattaccagtttgcttttcattatagcaacaaagtcattcatgaaaatctgacccctgacgaagctaatgagcgtatgactgccttgtttgaggacacgttccgccaaggacttctatgcgccaaggatgcagactaccaagtgctgatcagtaaaaaatataaagtatccattctgacaaagtcaccgagcaaaagtaaagccgacctgtctcataatcgcaaaaagcaatatgtgctcgaagaaggggagcgaattcctttcctgattgagcttgggattatgaatgaggatggtaaggtactggcccgcaagtatgataagtttcgtcaaattaaccggtttctcgaaatggtgcaggatgtattgcccagccttccggtaggccgcccattgacgattgtagattttggctgtggcaaatcgtatttgacctttgctctgtatcactatttggctgtacagcaaaagcgaccattgcagatcgttggtttggacttgaaggcagatgtcattgaaacctgtaatgttctggctcaaaagctgcaatatcgacagttggagtttttggtcggtgatatcgcagactataacgaactggaacaggtggatatggtcgttaccttgcacgcttgtgatacagcaacagatgcggcgctggaaaaggccgtccgctggggagcatccgttattttgtcggttccgtgttgccagcatgagctgttcagccaactagaaaatccagtattggagcctttgctttcccacggtattttaaaggagcgtttttctgcactggcaacggatggaatccgggccaaactgctggatatgatgggatatcggacacagctattggaatttatcgacatggagcatacacctaaaaatattctgattcgtgccgtcaaagggcaggcgggagaacaatccgttttgtggcgtgaatacacagcatttcgggattttattcatgctgatccttatttggaacgcgcttgtgcggatttgcttcccgaaggagcggggaagaagcagacacatagctaggaatatagtaaaagtggagccactgcggggtggctccacttttttgtagttcacagttcatggttgcagtacgccaatatctatccgccataggcgcttctaaaagcggtgcacaagacatcgcgatccaccttccacaatgccgcgagctcctcgctgacatcttcgtcccaccagtcgcatagtagtttgcgattactatggttttccgcaatccagataaggtgtccgacgaccttgcggcagtatagctcctcgccctgcttgaccagatcaggagcaatgtgaacaggcagacgtttgcaggttcgatacaactctttggtacatgcgcggcggataccacgagccgtgggtaaacgggattgtgaattgtcatgtttggggaatttgccgggaggcatattgtaccccctcctctctctcccaacttatgcgggcagaggagccggggtcactgacctccctatttggtcgaagtggcgacttgttctgccgctgtgatacactaatgaaaatagagaaacaggcagggagtgggaagagaattggaccaaatatctagtatcattaattatttgtttgagatcattcgtagtcttgggtattttggtattatgctaggcttgatggttgaggtcattccaagcgaaattgtcctcgcttatggtggctttttagtatcctcgggtcatattaatttttttggcgcagtcgtttttggaacgattggcggggttctggcccagttgttcatttactggattggacgctatggcggcagaccggtattagataagtacgggaaatacatacttatcaaaaaaagtcatgtcgaccatgctgaagcctggtttaacaaatacggcacaggggtcattttcacagctcgctttattcctgttgtgcgtcatgccatctcaatccctgccgggttggctcgaatgaacgtatggcgttttactattttgacaacgctagcgattataccttggtctgttttgtttatatatttaggtatgttgctaggagacaagtgggagcaaattgacgaagtggcagcaccttacatcaaaccgattttgctggttgcccttgcgctcttgatcatttattttgttatcaaatggattttgtccaaaaacaaaaaaggaagtgtataacatgagccgtagtaatgtatcgcaatacttcggaaagggcttaagccctgaacagtttatggagggcatggaaaagaacaaagaaaccttccgctctgggtacgatcagtttgtgtggaatcgcgaagaggatcgagagtattttgaaagcctgaaccatcgggatgatctgcgcgtgcttattttggctgccgactggtgtggggatgtggtacgcaatgtgccagttgtgttccgtgccctggagaatagcgggattccgaccgaagtattaatcttggaaaaccatcaggcgctgatggatgacttcctgacaatgggcggacgtgctgtaccgattgtgatttttgcggatacaggaggtcacgtacttggccactggggaccacgccctgcacatgtccaacaaattatgatcgaattcaaacgtgaaaatccagatcgggaagccgatgattatcaagaaaaaatcgcagctgctcgtaaagaaatggctgaaaaatatggggagggaaccgaggtccatcctgtgattgttcaggaattacgtgagctgatctcgggattttaacttatggtgctatctattcgcagctttaatctcggtccacttcagacgaacgcttatttgcttcaaggggatgatccacagcgcgccattattattgatccaggaatgaatccgggtcctttgctgagggcgattgagtctctgactattgaagctatcctgctgacccatgcccattttgaccatattggtggggtggaggagattcgcaatgctaaaggatgcccggtgtatttgcacgccttggagcaagactggctcacatctcctaagctgaatggctccttgatgtggccagaggtatctccaccaatctcaaccggtcctgccgaatatgatttggcggaaggtcagcaattgaacctgatcgggcacacgttcaaggtgttccatacaccgggccattcacccggaagtgtcagctttctgtgtggcaaagatcttttttccggggatgtgctattccgtcagggcgttggacgcacggatctgacgggtggccgggaacgggatttatacgattctattcaaaacaaattgtttccgctcggagatgacgttacagtctattccggtcacggtcccaaaacgtccatcggttatgagaaagctaacaatccgtatatccggtaaatgtgatgaacctttcaggaggggcaaaattaaaggtgtgacaagttttgccccaattcgacaacaaattataaattatgtatagacaaaggtttttatttttgttaacataaatttattaaagttacatactaaactcgcgaagcacgcaagctgtggatgaatcccggtttgcgttcttttttttgcccattaagaggataaagaggcatgaggccgtcagatcacaagggggagcaagaatgaaaagaaaacatatatatggggtacaacgtgagattggaggtagtttccgtgttcccaatataatagatattgaagattctgtggtaggttccgaaccgaagatcataacttggaaaaaggtgaaacgacggggcggaatcccttcacaaaactggcatgtgagattgaatgaacacaggttgggacgtggagacggtcgattatgaagatacatagatgatatagacaagctactttttttttagtagacttagcagataagttcagacaaacggggggggctaacgatgcatcatttaggagctagaattatgatcgtcgcggatgcttttgagcagaatcttcctgtgggcgaacatggttatatcattgcttacgaccgtaatgcggacaatgcttttgactatgtcattcgcgtaccgaaggtgaaccgcaatttttttgtaccatccggggacatcgagctggaggagagtattctcaagctagaagccgagcggattgagcgtgaagcgctgatagattatgcccttgctactcataatgagcaactgttcaagcatgtaatgaacggtggtcttgattcggtagagactgaagaagaagaaaccgcggcagagttgttgtcacaggctgattttatcagacaagtcaatttgcgtgcttggatataggggtcggctactgccgactctttttaaaaatatataatgggcacaatctcagctcttatagttatctcgaaagagcaccgagaggtgctttttttatattcttttagcaacatttccctcattgatgtacagtttgcttctgtaccgcgtcaaagattgaattgtaaagggttctatcctataattaaaaacgttatttcaaagttcggtgcagcattttttaatatcaggattttgcaaaattcgattccagtcatttattggactttttgcaaaatcctcatatacatgaggagggttttgtatgaacatttccacggaagatgtccgtcacgtagccaagctgtctaggttgaatctgaccgcggctgaagaagaaacgatgacaggacaattaaacgccattctccattatgcggagaagctgaatgagctggatacggagcaggtaaaaccgaccactcatgtgctgcacgtcagcaatgtcatgcgagacgacgaagttcgtgaaagtttgacacatgagcaagtgatgcgcaatgcacctgaagaagaagacggacagtttaaggttcctgctgttctggaatagatctcatatttgaaaggaggatgcaagttgagcttgttcaataacacattgcccgagatacataacaagctgcatcaaaaggaaatttccgtgagtgatctggtgggacacgctctggagacgattggtgcgcgggaagacaagatcagagcttatattaccgttgacgaggaacaggcccgtgcatccgcacgtcagctggatgatcagctgatttccggagaggaaagagggttgttgtttggtctgccggttggtattaaggataatattgtgacagaagggctgcgtacaacatgtggcagtcagtttttgaaaaattttgatcccgtttacgatgccacagttgttagcaagttgcgcgcagcgcaaactgtgacactcggtaaaatgaacatggacgaattcgccatgggcggctctaacgagaactccagctttttccctgcacgtaacccttgggatttagaacgtgttcccggcggttccagtggcggctcggctgcggctgttgcagcaggtgaggcttatttcacgctcggttcggatacaggtggttccattcgccagcccgcttcttactgcggtgtagttggcctgaaaccaacctatggtctagtatcccgttttggattggtggcttttgcctcctctttagaccaaattggacctattactaaaaatgttcaggattcggcctatgtcctacaagccatagcaggctatgaccataaggactccacttctgcaaaggtagacattcctgattatttgaacgctttaaccggggatgtaaaaggacttcgtatcgctgtgcctaaagagtatcttggtgagggcgtagatccacaggttaaggaaaaggtgctcgacgcactgaaaacgctggaaggattgggcgctgtatgggaagaagtatctctccctcacacggaatatgcggtagcgacatactacctgctggcttcatccgaagcgtcatccaatctggcccgctttgacggcgtgcgctatggtgtgcgttctgacaatccggacaacctgcttgatctttaccatcagtcccgtacgcaggggtttggtcccgaggtgaagcgtcggattatgctgggcacctatgcactcagctccgggtactacgatgcttattatttgaaagctcaaaaagtgcgcacgctgattaaacaggattttgatcgtgtatttgaacaatatgatgtaattattggacctactgcgccgacaacagctttcaaaatcggctcacaagtggatgatccattgacgatgtatttgaacgacattttgacgattccggtgagcttggctggcgtgccagctatcagcattccgtgtggtcttgcagatggaatgccagtcggactacaaattatcggaaaggcctttgacgagtcttccgtgctacgcgtagctcatgcttttgaacaaaataccgaatttcacaagcagcgtccgcagctgtaatttgctaaaaaggagggaacctattcatgtctacaactacatccaaatatgagacggtcatcggacttgaagtgcacgtggaattgcatacgaagtctaaaatattctgtggatgctcgacatccttcggagcaccacccaactctcatacatgtccggtctgtctcggtcatccaggggtattgccggtattgaaccgtcaggccgttgattatgcaatgaaagcagcaatggcgctgaattgcaccattgctgatgtgagcaagtttgaccgtaagaactatttttaccccgattcacctaaggcttaccaaatctcacaatacgatcaacccattggcgaaaatggctggattgatattgaagtgaatggtgagacaaagcgtatcggtattactcgactgcatctggaagaggacgcagggaaattaacacatgttgatggtggctacgcatctttggtcgactttaatcgggtcggcacaccattggtcgagatcgtttcggagccggaaatatcttcgccggaagaagccaaggcctatctggaaaaaatacgtgccattatgcagtattgtgacgtatccgatgtgaagatggaggaaggatcacttcgctgcgacgcgaatatcagtcttcgtccgcatggacaaaaagagctgggaactaaagcggaactgaaaaacatgaactccttccgtggcgtacagcgcggactggaatatgagcagttccggcaggagcagacgctggacgaaggcggaacgatagtacaggagacacgtcgttgggatgaggcgcaaggtaaaaccttatccatgcgtggtaaggaacaggcccatgactatcgttatttcccagacccggatctggttacactgcatatagatgaggaatggaaagaacgtatccgtgcttcgattcctgaattgcctgaccagcgtaaagctcgctacacttcggaatatggattacctgagtatgatgcgcaggtgattacgtcctccaagccattagccgatttgttcgaggatagccttcaattcaccaaggatgccaaagcagtatccaactggattatgggggatctactcggttatttgaacagtgccggtgtagagctgtcgcaggttaaattgaccggtcggggcttgggcgaaatgatcggactgctggagaagggaacgatcaatagcaaaatcgccaaaacggtcttcaaggaaatgctggaaagtgataaactgccacagcaaattgttgaagaaaaagggcttgtacagatcagtgatgagggtgcaatcttgaccattgtcgaacaagttgtagcagctaacccgcaatcggtcgaagattacaaagccggcaagcaaaaggccatcggcttcctagtcggtcaagtgatgaaggagagcaagggaaaggcaaaccctggccttgctaataagttgctgacggaagtgctgaaccgctaatggcatagatttgacagggggcttgtcttttagggacaggccccttttgcatagacgctgagaacgattggcgcgaacaaactttagaatcctgatggcattttatgagtttccttaggagggaaaacagcatggttaccctatgttcattggaagatgatgatattgtcagtcagatatggcgtctacagcacgttgcctataggctggaagctgagttgattgggtttgatgagattcctccactgatggatacattggatacgctgagaagctgtggagagtctttttatgggtggctggaggaaggtgaattgctaggggcactggctgtgcagtctgagtcgcccgattcgcttacccttacacgtatgatggttcacccagatcattttcgaaaaggcattgcagactcattaatgaagcatgttttgaatgaatatcaaaatatcccgttgtttatcgtctctacaggaactttaaatactcctgcggtgacattgtatcgaaaacatggctttcgccccgtatctgcggcggaggtcgccccaggcgtggaattaaccacctaccatctgcataagttggaatagcattgagatatcattaaattggcattaaaaatgcacataagcccacaaaccgcgcacccggagtgggaagcacgacataaccgggaggagtgacttgaatggataatccgtggattatagacgattcacatatcattttacggcttttgctgtccatgcttctcggtggattcattggctttgaacgcgaacgttccaatcacgcagctggtttgaggactcatattatggtcagtcttggttcgacgctgattatgctactctccatttacggctttgccgattttattaaagaagctaatgtacgcatagatcccgctcgtttggctacggcggtaatcactggcgtaggctttttgggtgcagggacgattatgttcacaggtaaatccattaccggactaacgactgcggcttccatttgggtcgtggctgccattggtcttggggtcggagcaggcttttatttcccgtctattgcggcaacggtgctcgtgtttttaaatttatgggtatttaacaaagtcgaactccgatatatgcgtggacgcaagcgtcatcttattacattgtacggattgtcgtctcacggattgctggagcagatttcgacttatttagagcaagaaaaagtggaaatacgtaaaataatgattaaagaacatgaaaatgtcccatttcacgaattacatccagatcggcagagtatggaggtttccctagaggtgctgtcccgtcatgattttaatcccgtacgtattgcagctgatttacgacaatgggaagatatagctgcagtctctgttgagtaatagcctacctttttttaacagttactcttaaatccgattggggtactatgtaagcattgaagtatttttcagcggagccacgcatgggattcaaaggggaggatggcatgaactcggaacaaccgttaccgtctggagaggctgggcagctacaagcgccggaacagcgggaacaacccagacaggggaagcgtctaaaatacgctaaatttcgcaaagtgattgccattatcatggcagcattgttacccggactgggacatctttttctagggctgtttattagggggcttagttttattgtgttgctcctgctagatatttttgcgatgctgtatgtttcttctgatggcttgaggattaacatcccattacttattttgcttggattgttcatacccgttttatatttttataatgtatatgatgtcttacagtcagcagattacatggttcgttatcggcgtaagccagatcgttatgcacggatggatgctaaaggccagcaaagtagtcctttttatgcatgggagagaggctttgcttttgctgtgctgatggtggcaggcggtgggcttatgattttgtttcgcatgaaacctcgctggttgagcaacttctttgaggattatggattcctgacactggccattttattaatgatgatcggtttatccctttttctaagggaagcctttctatcctttaagcgtaaaaagttgaaagaaagagggtgaagctggcgtgcaccgtaaaataagagtcggtcgctacacctcttcgcttctgttgatggctgtaggcattttgcttattgtagatgtgtttcaaaatactgaatatatgcttcagctcctcgtttggtggcccgtaatcttcgtgctttggggactggaatatctgattttttttgctgtgtactatcggaaagaaggcaagtctgacaacggaaggcgattcagacctgacctaaaagggattctgtccgctttggtagtggcagcctcggtttttatcgtgacccagcaaaatcattatatgtatctgtggaaccgggtcagtctcaatctgacatcagcctctatggattttagtcaggctaaagagaatcggtatgatatgggtggtgtactggtacctgtaactatgcagacgtctgatttagtagttgattcggttaatggtgatgtaacactgatcagacggcctgtgtccaatatagaggtacgtgggactctatgggtggatcaagcgcctgctgccgaagcggacaagattgctcaggcttcttcactgacttctaccgacggcaagaccatccagattcgtccggaggcacagtcatacggagcttcaagcaaacgtcagccccgtgtgaacatgctgatcaccgtgccggaggaccgacggttcaatgtgcagattagaacctccaacgggaatattaccctgaatggagttgatgctattgatagcattcggctcgagagcggtaatggagatctcaccgttaatgacgctatcggcaatgtcaagggaggcacgctgaacggtcaggttaaattgcatcggatttctggagatgtagatgtgcgcacgaaccgtggcgatatgcaggcaggagatattgaaggagctgtgacactacacaccatggtaggtgatattcagctcgctcgttcggaaggggacatcacagtagatactcagaatggtgacatgaatgtgctgaattctacagccaagctgaatgcaaattcgcttaatggctctatcaaagtgcatagcgagcaggtgggcggagattggaaaatatacagtgctgtcggtgatatcgtattggatcttccgtcgaatggagattttcagttagagggttcaagcagttatggtaatcttcaatccgattttccatttaaaatagatagtaaaagtatctcaggccagaacgggacaggtaagtatgcgatcaacgtagagggtaacagcgatttaaccattaaaaagttactgatgccgtcgttacccgacttggatgattccgggggtacgactgcgcccgatacatctgaaagctctccggctgaaaccggagctcctgagacagatacctctataggaacatccggcgacaatacagcgcgttgacaagaaacttgagtagaccgtacaatgtgagtaggtttagaagtaagttgtaaatagatgcgtggtaattgataggatcgtaagtaagggataaggcggtggacatatatggcggcacgcgtccagcatgctttggaacttctgaagaagacaggtgtacgcataacaccccagcgtcatgccatattaaactatttaatggaaactatggggcacccgactgcagatgaaatatatcgagcgcttgagtccaagtttccaagtatgagtgtggctacggtttataataacttaaagatgtttatagaagcgggtatggtacatgagttgacctatggagataacgccagtcgttatgatgccaatatttcggagcactatcacatcatttgcgaaaaatgcggaaaaattgaagatttcagttatccctatttggctgatgtggaacgccatgccgcgttggaaacaggcttcgaggtgcatggacatcgtatggagttacacggagtatgcaaagcttgtagtaacaaacaaacgtaacgaaacaaggaatagaagttttttgtgcggtatgtatatattgtaatggattggaaacgtgaggaattccccataagcggggatttaccgcgtttttttatttaaatcactttatttttgtaattcaaagttcatacaatggaggttcaatattggccagaaatcattccagacgccgccgtaaacgttcacgattcaaaggagcggcaagcctgctattatttgcagcgattatatgcgcaattactgtcgtatggtttggtaatccccttcacgagaaacccgattggcagggcagtgtccgtcctatttttatgcagggcaagttgactgggtatgaagctcaaagctcgggcaagaacatgctgatgccgcttaaattggtgcaaagtcaaattgatcctacggttcgctatgaggatgatagccaatccgtcattatggcgacgagacaaagcctgctctatatgaaggtttcgaaggcacaaggggaactgaatggtaagacatatgcgcttagcgtagcccctcaggtgatcagtggagaggtatatatcccgatagaggctgtacgtgaagtatacggcgtttctatacacgaagaccctgtaactggtgctgtcatcctaatgaaagctggagagaaggtcaggttggggagtgtagaaaagaaggatggcccacgggatgctagaattgccttacgtaaagaagcctccagcctatctttcattttgacagatatatctcagcggacgaaggtacgtatttggtccaaacaaggagattggtattttgttcaattagacaatggctatgcgggatacattaagtcagaccatatcgctgaaggagaagagcttgtgatcccttcggctaaagacgatttgtccatctcggaaaaacattgggagggtaggccagtaaacctcgcttgggaagccgtctataatcgcaagcccgatccttccaagtttgatcctatgcctggagtaaatgtggtgagtcctacgtggttcagtgtcgtcgatcctgagggcactgtagaaagcaaggcagatcctgcctatgtcagctgggcacatcgcaaggggatggaggtttggggcttgttgagcaacagctttaatcccgaattaacaactgaagcattgtctacctttgaacgtcgaaaggcgattgtagatcagatgatttcacttgccctagaaaatgatctggatggtattaatattgactttgaaaatgttcatacgaaggatggccccaatgtcacccaatttttgcgggaacttaaaccgatggctcgggaacatgatttgattctgtccattgatgttacgcctaaatctcaaagtgagatgtggtcagcttttttggatcgaaaatcattgggcaccatcacagactacctcatggtaatggcatatgatgagcattgggcggctagtccaaaggctggttctgtcgcctcgctaccatggacggaagcgtcaattaagcgaattattcaggaagatgaagtgccgcctcaaaaagtgattttaggtattccgttatatactcgcgtgtggtccgagactcccaaagaagggaagattaaggtcacctccaaatcacttggtatgaagtcagcagccggtatcatagccgaatttaagttgaagcccaagtttagagctgctgaaggccagaattatgtcgagtatacagaagacggcgtggtcaaaaagatttggctagaggatcagatatctctgaaggcaagagtagaacttgccaaatcgctgaagctcggaggaattggggcgtggaatcgaacctttgcagatgaaaacgcttgggtaacactgaaaaaaataagtgaataagataaaaatttatacaattgaagaaggaagtttcttatttatgtagaaatgatcacatgtatccaaatatccaatttgcggtcatagccgccttgcagatatggagggagaagtgcagctaaccaaattaaacctaatgtatgatgaaatgttgcaggaagattcaataggtattatttcgtacagaaagccgggagagtattttcacggttcgatgttgtatgactttgatgaactcattctaattattggagaaggcaccaagccagttcgttctattcaacacttatttatgaatggattaagatgccaagtgttgtacgcaacgctcagttgtctgaaggaatggattatcgctggtgaacaagccaacattatagattatgtgctagaaggtcgtattgtctgggaacgggatgagagggtccgttttttaagacaggaaattgttgattttaacgatccactacgggagcagaagcgatttcatgagttctcccgctttctggtcaattacgttcatggtaaaagagcggtgcgagaagggcggatcattgacgcttatcaaagtgttctgaaagcattggatcattgggcatctattgaactcattgaacgggggatttatccaaagattcatttatgggttcaggtacagcctctggatcgaacgattgacaaactgtataacgaactcaccttaagtacggaaaccttggaacaacgggttgaactagtattgcttgcttgtgaattttcagttatgtcaaaaatggaggagtgctcatctccgctattccgtatattaggcagcagacgggaaccctggtctataaatgaacttattaaccatccagagctaaagaatcttcaattggatcttaccgtcgtgctccgtaaactggtatatcgttcacttattagagaaacagctgccggggattttagggatcgtgggcaaaatcgtgaactgcgttactcccttatttgatgtgcagggttgatttgtcaggaagaaaggttgttaaatcgacttctcttcctttttttgtatgtgatttagtatttatagatagtcacaaaatataaattattaatttaggttgacgagtatataaaatatgtgctaagttataactcgccccattaagcagcatgaataatttagaactgtttaaagcaggataaacgtgttgcatcaagcggaaaaataaattttcaaaaaaaaagcttgacgaaaaatgaggttatgtgttacattatttaagtcgccgctgagacgcggtggtgaaacaaagtgagacattatacaagtttgatctttgaaaactgaacaacgagtgagtaaaacgattttgttcgcaaaatcaaaacaagagatattttatct

(The sequence listing continues in the following parts.)

What is claimed is:

1. A composition comprising a wheat seed and a bacterial inoculant for controlling a fungal root disease on a wheat plant, wherein the bacterial inoculant includes a Paenibacillus microorganism at a concentration of at least $3.3 \times 10^4$ CFU/seed, the Paenibacillus microorganism having a 16S rRNA gene nucleotide sequence comprising a sequence that is 100% identical to SEQ ID NO: 3 or SEQ ID NO: 4, and wherein the bacterial inoculant enhances a growth parameter of the wheat plant of mean establishment plants per meter relative to an untreated control, and wherein the bacterial inoculant comprises at least one element selected from the group consisting of one or more gums, one or more clay or peat based carriers, one or more nutrients including carbon or nitrogen sources, one or more antifungal or antibacterial agents, one or more seed coating agents, and one or more wetting agents.

2. The composition according to claim 1, wherein the fungal root disease is caused by a pathogen of the genus Rhizoctonia or by a pathogen of the genus Pythium.

3. The composition according to claim 1, wherein the bacterial inoculant includes the microorganism of the *Paenibacillus* sp. 10.6D as deposited under NMI accession number V17/004922 or the microorganism of the *Paenibacillus* sp. 9.4E as deposited under NMI accession number V17/004921.

4. The composition according to claim 1, further comprising a seed dressing.

5. A method for controlling a fungal root disease on a wheat plant, the method comprising inoculating a wheat plant with the composition according to claim 1.

6. The method according to claim 5 wherein the fungal root disease is caused by a pathogen of the genus Rhizoctonia.

7. The method according to claim 5 wherein the fungal root disease is caused by a pathogen of the genus Pythium.

8. The method according to claim 5 wherein the bacterial inoculant or inoculant composition are inoculated onto a wheat or canola seed.

9. A composition comprising a canola seed and a bacterial inoculant for improving growth of a canola plant under water limited conditions, wherein the bacterial inoculant includes a microorganism of the genus Paenibacillus at a concentration of at least $3.3 \times 10^4$ CFU/seed, the microorganism having a 16S rRNA gene nucleotide sequence comprising a sequence that is 100% identical to SEQ ID NO: 4 wherein the bacterial inoculant enhances a growth parameter of a mean establishment plants per meter relative to an untreated control, and wherein the bacterial inoculant comprises at least one element selected from the group consisting of one or more gums, one or more clay or peat based carriers, one or more nutrients including carbon or nitrogen sources, one or more antifungal or antibacterial agents, one or more seed coating agents, and one or more wetting agents.

10. The composition according to claim 9, wherein the bacterial inoculant includes the microorganism of the *Paenibacillus* sp. 9.4E as deposited under NMI accession number V17/004921.

11. A method for improving growth of a canola plant under water limited conditions, the method comprising inoculating a canola seed with a bacterial inoculant or inoculant composition comprising a microorganism of the genus Paenibacillus at a concentration of at least $3.3 \times 10^4$ CFU/seed, the microorganism having a 16S rRNA gene nucleotide sequence comprising a sequence that is 100% identical to SEQ ID NO: 4; wherein the improved growth comprises an improved mean establishment plants per meter relative to an untreated control.

12. The method according to claim 11, wherein the bacterial inoculant or inoculant composition comprises the microorganism of the Paenibacillus sp. 9.4E as deposited under NMI accession number V17/004921.

13. The composition of claim 1, wherein the Paenibacillus microorganism comprises a sequence that is 100% identical to SEQ ID NO: 3 and further comprises one or more sequences having at least 97% identity to one or more sequences selected from SEQ ID NOs: 11, 12, 13, and 14.

14. The composition of claim 1, wherein the Paenibacillus microorganism comprises a sequence that is 100% identical to SEQ ID NO: 4 and further comprises one or more sequences having at least 97% identity to one or more sequences selected from SEQ ID NOs: 7, 8, 9, and 10.

15. The composition of claim 9, wherein the microorganism of the genus Paenibacillus further comprises one or more sequences having at least 97% identity to one or more sequences selected from SEQ ID NOs: 7, 8, 9, and 10.

16. The method of claim 11, wherein the microorganism of the genus Paenibacillus further comprises one or more sequences having at least 97% identity to one or more sequences selected from SEQ ID NOs: 7, 8, 9, and 10.

* * * * *